United States Patent 9,567,581 (SELECTIVE REACTIVATION OF GENES ON THE INACTIVE X CHROMOSOME) - sequence listing, part 44

SEQ ID NO: 4638 - DNA, 120175 bp, human
aaaaaggcagcctatgggctgagcgggggatggggagagaagagggatagggccagcaaggcagggatcgaacgagtgtctggcagccgggagcccagcgaagagagcgagcaagcttaggaaaacgagcgaagtaaagggagtaggggagactgagactgaccggtagccaggcaggcggacggacgcacgcccggacagactgagcaggcgccggagaaccactcacaggttccccccgcctttccctttgaaagctaggattttgcctttcccgtggcgcccgagagagaatgctggactctgccgacttcagcgcaagctaagatttctcagctagggacaaacgatcagcccaatcctgagaaggggggaaccaagcaccccgtccccatccccctcccctcccccgactaaactcgggcgccaaacccagcccttctctaaccaccctacttcctcctctcctttctagcatggtggctgtatggacagtctgacagaacagagactgacatctcccaatctgccggccccccacctggaacactacagtgttctgcattgcaccatgaccctggatgtgcaaactgtagtcgtttttgccgtgattgtagtcctcctgcttgtcaatgtcatactcatgtttttcctgggaacgcgctgaatggagtccagccacctgagctgtcgcgaactctcgctttgatttcatcccgagagccaccgagaaaaaaaaaaaatcacagacagagacagggaaagagagagaaagaacaagctttcttactcaggggggaaaacgttttgagcttcaacatggcctcgctgtgatatgtatgacgttggtatattatctctccctaaatcttttgtcgtgtcttgtcttttaagaatgcctgcgcgtatagttgcctattgcttgagtgaaattgttgatgaagaaatgctttctatttaagtgtgcatgcgtgtgtgcatttttaatctatgtggcgttcatggagcaagctctgcgtccttaaacagtggctttgctgtctgtggtgtcttaactcatttccttgaagactacctttaaactccatcagggaattttagtcaaaatttctctcttgccatcaggagtgcatttgggtttgtttgaggggaaaagggtttgtggaagagcatgatgaatatttgacatcataggaaagacagtctttgcagtggatatttagagggaaaataatcgatgcaaggaatggatttagggaaaatgcttctttagtgtctaaggagaagcaagaatttgggaagtgacacgggtgtgttgtgctggcagttggtgactgtgtcctttgaatctcaatttgctctccagggttcacaattttcaattttgaaagaagccacatttaaaacacttcttgaaccttaaagctttaagatatttaaaatgtcaatttccttggaatcatgaaatagtatgtgaaagcattctctgattttttgaactggcaagagaggactttgacaggagctatttgggctccctttcccaaagattgtacccctggatttgagtttggggattttgtttgtctcatcaaaaaaaaaaaaaaaccccacaagaaagaaaaaacagctctttatccaccttgggaataatagtatttggatatggctcctttgggataatctcgtttgcaatgatgttcttgaactacattttaaatgtaacttgataaggctgatgagaaagtggtgatgctattgtttgctcccgtttgttactttaagatcagaggtctctgtaattgaaacattcccataacaaactgaaagtctgtaatgtgctaaattaagagttatcaaattttggtgctaaatttgaccaccaaaacccaaaaacgtctagaaggaaagggatgagagcatggaaaacatgagctggaagcaacattccagtttgagatatgactgcttgtctgtatcagatggtggtggtggtttctgttgttattgctattgctattatttttatatttctgtttcctctgagaaagctcttggcagagccaggaaaaaaaatgtctcatgccagtctgtataatacttgtttttttgcgttttgattttctttctcccctgttaatgtaggcaggctttccccattccattgcttacctggcttgaaataatgccatttatggctcatgtattatagcagtgaatcaggacacatacacatctacacacatgctccccctccacccatgtgggtggctgttcatgtctgatgtgcaaatctgctggcattatgctgtcaagttccatgtccggttgttcagtctctttggaaatgattatgaaaggagaggggctgtgaagggggcctttgaaattgtcttggccacaggacccagagagtattatttaatggcgtcagagggtgttttgggcctcaaagcatgctatccttgacttggtgtgggtgagaagctgaggtttttgtgagattagtaccatggtgtaaacatgatctgggaggtttgctggcattggttcttattaattactctttggtccgtttgtggagaccccctggatggaactgagaacctatttctttgcaaagataatttagtgagtttttttccccccttagcttcattgtattatttaaagtaagcttatatcttttctgggcactttgttttgatacagtgttggagagtggggaatggctctatgctgggcagctgcagacctgtttttttgttttgttttgttttgttttttgttttttccattcagcagctgtttgaccttggacaatttttttcctcctcggtgggtttgggattcccagtaacattggcattttttgatggctccactaggtgacttccaagttcttgcattttatgattttatgacccctagacacttgaagttgtggggggtgggggggatgagctggaaagacaagtgaaaaggaaaagaaaatgttaatcaaagggtgatgggaggaggggaaggatatctggtactacagcctggataacaagtttaagcgaaggggttttttttgcctagttatttgggaaggaaactgggacagcaataagggaatgctttttgactttttttcccccaaggggagaaggggtctctgagactagtctttgatctaggtttatgacttaaatagtgtcacgaaatgccttctcctctgtgagcctgacagacctttggcagaaagcctctgggaatgtatgtgtgtgtgtagggtgtgtggcagtatgttcatgggggtgtgtgggggggagcacactcctgagtgtggatgcggggtgtggtggtaggaatgaagaaagacagtattgagttccacagttctgaatagcctccttgtgctaggacctataaggatttcacaaatgctgggatggatgggtatcacccatgccattcctcttttcaccacctaaaacccctcaggctaaggaggtgtcttgaatgagcccttccattagtaatttagctgttgaaatgggttagcgcttttaaaattgtctccaggcaaataaagggatgttgctagccagatggcaggccaccatctagcaaccagaagggaatttgagagtagagaacaaaaggtagcagtgtgactttttacttgtgtgaatcctaaaggtttggcatttctgcttcagacttgtgaggatatttttctctagcaaaaagagaaaagagtgggagaaaatgagaaatgcagcccagagaagcggaaccctatgcattttgacttgtcttcttttttccttcctcctctgccttctctcttaatctttctccttcttcctttcttcccacccctgacaccacctcctcctcccacctccccactgtaaatgggtgagaagtaaaaaagagaagaggacttttcctctctgatttgtcccaacttttcccaataaagctcctccattcccttccctcctctctggcccctttgagtagaggataagcttttgccatgtaggaggggcaaaatcccagcttagggattttcgctcctggatccccatcaaagaattaaagaaaatgccctctactggtatcctagcaacccctgtatcactgagcacccactgagctccagagcccaccctttaaaggcccaggcaccaataactctagaaaaaggggactagagcctagtgggacttggagagatgcttttggggagggaacaaagaaagaacagaatcccaatttcctgcaaatgcctcggaaacatgtccacagcagacatgtagagcctagcctcgtccagctatgagattatttattagaaaactcctggtttcaaattcctttctagtcagtcccatctccttaagattaactgtgccattttactgcctagctttagtgccagaagctctgccggtcctgaaaaaacaatttttttcaccctaacttttggctgcatcagggagggggtgaagtgatatcttggtgggaacaaactgaacagcattcttcttccattgagacagcctccatctgtcagaacctgcagtgtgcttgtgcagtgtgccccaattttgtctgtggcttggggaatcctgatcagcctagctttatagaatttgggaatttttctttctgtggttttggtgtagtagtttctgacgggggaggctggacaagttgaaagagcaagtttgataatggagctggtaaacagggcttggaccctggctcagagactctcacccaccggtgtgtgtgtgattcagctactagggagctgaaagatcccaaaaaggctgtaggtgaggtgctcttctgcccttgaggtaaggcccagattgagagcaaccagagggcacagtctggtggtttgaaggatggtaacaaagcatgtcttcctctttagcctttgtctgccatctcagtttctggtcccttgacctgcagagtgcttgctctgggcagggatataagaattgagccttttctcccaaaataactgcctcctcagaagacctcctacaaggcatctggatcttgctccagtggctttgccccaagaaatgggatggaggaggggaatcttggactctctagctcttatttccagctctgcaacttgttctaggccaactgagtctctggctttccaagaatccttgatgaaggtttagcttctccagtatctgctcagagtgtctccttctgtcttaggtggatctagctccatagagtatttagtttattgtactttgctctagcacgaaagtacaaagaggaaaaactagaaggggaagaacatagaggggagagaaggctcaggaagcagtccagtaatgacaatactaataactccttatcagtgcacgggcctatagcgtttatgaaggaatttcacatcctttctaacttgagcatcacatcagccttgtgaagtgggtagagatgattgtaattcccagtgttacagatgaggaaagtaaaggtcagcaagattgttgggatgggagtgggtctgcctttcaaatagagaggagagtcagagttggtcattcctaactagtgtgatgttgaatgtagggagggagggcctgacgtggtggctcacgcctgtaatcccagcactttgggaggctgaggccggtggatcacctgaggtcaggatttcgagaccagcctggccaacatggtgaaaccctgtctctactaaaaatacaaaaattagccgggcgtggtggcacacgcctgtagtccagctacttgggaggctgaggcaggagagtcacttgaacccaggaggcggaggatgcagtgagccgagatcatgccactgcactccagcctgggtgacagagcgagagtccgtcccaaaaaaaaagaaagaaaaggaaacaaaagaaagaaaggagatttgggagtcatccctgaagtcatactagcttcctcagctactcacatttttaataactttcatttgtatagcacttttgctcagaattttcattctataaaatgcctttttgtcttgaatatgcatcaaagagttctgtttagttttatgaaaactcactatttgggatcttcaaggtgagaggccagtgtgaattgctgaagcctaaaatacagaatgttttcaaggaactgtagttttaatacaattgttcttctctttgaagcacacttatttttctatatttctttaaaaatctgctgcctagaactgttcatgctactctaggtgccacctgactgagatcaagtgcaaaagaactttgttttgtctgtgaaatgtctaataatgcagccttctactgattctcaaccctcactgaacattcagatcacttgggaagcttttttttaaatacccatgccaggtcccctatctgaaagattctgatttaattttcatgggctagatcccagggagctttatttatttatttttttaatttaaagttccctaaggtgattcaaatgtgcagccagggttaagagttagccttttgagcatgtaggtccaaaccatttactgtctagtccagtcctctactctcttgtgaagttggccacttcagggttttttgaaccaaacttgctacattttatcttgacatgttggtccattattctagctttctgtggattttaaaattttttcttcatgctgtgctacaaattagcagtcccttctagcactgcatcagttaaattctatttgtttggttggactattgttctagcctttgggaggtttttattttttttcttcatgtcacacaacaggttagcagcctcttctagtgttgcattatttgaacaccaaataaatggcattcgagtcgttgattcaaagaaatgtttactatgatatgattaatgctagctcttctgtcacctcaccagagcccctcttggagttgggacttgttaatttttgtatgtatctggtcaaccagtgcagactgcacctggttgtgccagcatttatcctaccagggtgttaatgtgaataacatagcacgatagatttgttgtatgctttgtgggcatcaagatatgctaggttcatagcaagcatctgccaaactgatagccccatcagaaaaagcagtataagttacttggcctcttactcatggtaaatctggttgcaggctccagagcttcttgttttctttctgtgcctacaatgcaaatgtttctaaactgggttcagaacttggctgagggtcagtactacaactgtagtttctgtgtattactttctcctctttgaaaaagcaggacataatggatttagctttaaaacagaatatattttgtgctcaaagagttccggaaattctttgtgtatgtttctcttgttgttttgcttaattgtttccattaacccagtggttctcagcactggctgcacatcggaatcacctggaatattaagagtaacaacaattcctagaatctttgggagagatctgattgagttgatcatagtggtttcctggcatcaatatttttctaagagttccctgaggtgatgggaatgttcagccaggggtgagaatgactgctatggaatgcttcataggaaatgttagctcagcctgtctgacttatcacacatgtgactaggcaagcttcacagatggtgaaattttattctaggactgtgggagcctcgataagtcccaggggcttgtgctcactctaaaaaggaggaatcaaccctagggaatgagtagtctggagacctaattgtatttaaaataatcagctgtgagatggtttgaacacttcaggaataaaaaaaaagtcagttcctacacatttgctgtaatgatggggaagattctgctcatttgctagtgacctcaggcaaattacttctctcctctgaaatttggttttcttcatcagcaaaataaggataggtggatttgatgacttcaaagatttcttctagctccaacaatatgtgcttattttgtgattaatattaatgatcaacacgagtacagatattatttaaatctagcaggtaatccagagatccattttagcaggtttagaatacacagagtggttttaaggatagcagttttgccttcttaattatacttggcttaggtttcttttagaacaagtgaacttaggttgtattctttgagcacacactggccgccaagcaggaaaggagactgtatgaacacgcattggctgccaaacagggaaggaagtggtacagtgaattgagtagctagggtatgccagtttgggattctgtttattaaagagatatgtcatggataattgagaattgcctctcatagatataataccagtctcataggtctgaaaaagatggattgctttgacagctcagagccccttcctgcagtattttaagtagccattcacttggttaataatactacttctattaataagaatttcaacaaataaggtttcctatgtatttcatgggcttcttcctcaaacctaaaagtagttaagaaagtgaggctcataaagattaagcagcttactcagtgtcaaacaggtagtggtagtgactagtggtagtggtagttctagtggcctagaacctaggcgtcttgataccacatcctgcagtgcttctggtatagcctgcatagtggactctgtggtcaggatgcagtcatgactctgagaattaaaggggttttactgacatagagcagtattcaggaggaagctttgaagaaaggagcaaaaggggcaatgtggaggaagaaaaaaggtttagagagggatgtgttcaggccagtttttctcttgcccttatcactcttatgtgctagttccaggcccctgatgggaattggccattgatctttgagcaccaaggttgagtgttggtagcagagaagaaggaaagttgtacatgcatggcagaaggatagcatagggaaggcagacttgcagtaggagaaaaaacaagaaaaggccttaggagccctaggattaagccctggctctgtacctaccttgctgccagatcttgatcaaggcccttcccacctaggcgtcagcttccacgtcactaaaatgagagtggtttcagtagaagaactatgttctcaaatggaatgttagccagaagcttctatataaaacaggaaaaagcacagatggtctggttgaaatgggcatgggacaggtatggaggacagagtctaaagttccagggaaccatcttgcgtatgcagattttggtcattaggggaactggaattagaagagtggagatggctctgccaagcccagccatagtgcttggggagatagagcatccttggatagagttgtgtgatgggggtgggtatttcatttaagtggccaggatttacagagaatcacttaggggcagatattaaagtgcctagtacaacacactgcccccattcctttttttacaagtgagaaaactaaggcacaggaggggaaagggatgggtccaaggttgcagtgatagttctggaattctgattctttagatagggctcttgcctgctgtaacttgctacctcccctataggtttctggctctatgctcccttggctggatcagagacctgaatgctctttcaggtttggttggagaaagcaagctgacgagaggctgggagaacaagagctttatataacctcctggagagggagcaggcctgttagtagtccttggagttccagggagtaggatggggatgaggggaacacagagtctcctgaaggccacattagctctcctgaggcagagcagtagatgcagccctgtgagtggccatctaccctcagggcccagaggaggccagcactgcacatccatagccagctctgggaatggctttggcagctgatttctccgcctgcctgccttcattagagaaaggaaagccatgtacctccgtgcccagctggctgcaggaaggatgtactaagagcccaccccccaccccctcagagtgtggtgcctaaaggcagtagctacttttagctgaacctcccacagcctctcctccacccactctctccctcctccctctgtgaattgtgcaggatggcaagaaggctggggagtaggtgccttggcattgggatagaggcagaggaggagctaggcatctctaggaggggctctgataagccctgcatggcaggagggcttagaacaaaagcaaaatgatgagattgctttgtgcttaggacccaaagggagttgagggatttattaatttcctttggagcatgcaaccagctgaagttcatgtcttgtaaatttagactgaactgcatgggaagacttacactctacttggattaagaggaaagcaactggggctagtgggtactcacttgattcttaactactcctcttgaacagtcttacacttttcagtggattttgtacatcgtctcacttgattttctctgtggccctgtgaagtgggtagggcagagattatctccatttcacaggtgagaaaaagaatgttcaaagacttattgtcacatagctgcttctagcctggccttctgggcttcagctctggaagttacagtgccacttaaagtcactgcagacagctatattttctagaaaaataggtgctggagctgtcctgattctaatctcctcattgtggaagctggggaactaggtccagagaagaaaaggacttgccccaggaaatgtagtacatctgtagtagtgctggaattagaacattgccatgcaaggatgtgaattcctggacctgcaagatgtgcaagccactgtggtctttcaagggttgtttgggaaacctgtgtggtgtgatggaaagcaaagtgtcacagaactaggagtttgttatttttcagttcaggcagaactgtgggtgactgccccagtggaggcctgacactcagtaagccctctataaagatttggttgaatggaagatgtacacatgagtaaaaaggaggtgcaaatgtgaagtcagttgctgtgtgaccttgaacaaatcccattgtctctgtccctcatttctgtctgtcatttttggaggactctttttacttctctcccttggaagaagaaaggccctgtgacccggcccatgtcttgggtgcttggtggaaagctgttttgttttctgatttttgttgttgttgttgtttttaaataagctttcttttatttatcccaagctccatttcccatgcagtcacacactcgctgctatgaagagcagactaactttgtctctcctcatctcctgcaaagttaaaagaggaacttggaagaaagccaaaattaattgtgtttttatttagcaccttcttaagtccatcaagccataaaccacttaggcacatggcaattaaaaaacaattcttggcccctagatccttggctaggatttgtgatggattactgggttttcatgatatgatcaaaaactgttttagaaattgcaggttcttgcccaatgagctgtgtagaacaaatcaacactcttcacttatactcgcattattttgtttggaaacatctcactgatctgggggcaggacaagaagataaagactactgtatagccttctgctcctgacacatgttcttttctccattacactattaggtggccaaagccaagattattttcccaattttatggctaaggaaattgaagctcagagaattgctttgattgactcaggtcagtactgcatcttaaagtcagtggtgagctaggaagaacatagtatatagcgttaggtattatcaactcaccagtaccaagtgtctctaggcaagccatttaagattccctctgtagtttgcttctgtctaagtattttgttgttgttgtttgtttattttttgagatggagtcttgctctgtctcccaggctggagtgcagtggtacaatctcagctcactgcaacctccgcctcccaggttcaagcaattctcctgcacgccaccatgcccagctaatttttgtatttctagtagagacggggttttgccatggtggccaggctagtcttgaattcctgacctcaagtgatccacccacctcagcctcccaaaatgctgggattacaggagtgagccaccacacctggctctaagcatttttacaaaagttaatcaagatagaagaaagaagtaggcatatgctactggataattggataggttggcattgaaccattaattggtattttggtgcatctactggatctacaataaattcatctggatatcacattgtccagggatacatgagaggcctttcaaaatgaagaaaagtggccccagattctgtagtctttggtgacctacttagtttggacgctttctctctgtgggtttatctggccatgttcttaaagactgggccttgatcctaaaagcaggctctttaccattaccagtttctatggtcatcccaaaggatggggaagaatgatttggataaactacatgtcattttgcctgggctttggtggagattgtatgccattccttttactccagttggttcaggccactgggaaaatgagtgtggaatgacaagaatagggagacaaccaatagcttgctgagggttagagggggcctagctgggatgagacatctgcaggtgctaatccacgtgcacatatctacacactgattctttgtggtgttggggggagcaagcagagtttgtccatagtacttcagctgagaagtgactgggtaacagtgagaggaacccaagcattgagctcgttccttcagtgtacttctggggaaactgaggtctaaggagaggcaggaacttgcccagagtctcagaatttgtccgtgatctttgcctattctctctagtcagccaatggctaatttaccttacatttgtgaggctctttagatgaatgaggggtggctaagcctcttgggaaaagcacctgtgattaccacattcaggaagtgacagagatgaaatctgaacccaggtcttttgtcctgcttaagagcagattgacccagacttgaaggaaggctgttagaaacaaattgatggggaagaaaattggttcagctttgctgtctatccatgctctatgcccgtaccttcacatacacatacatgatagatcatatgtgatgcacacttacacatactcagacacatgggatgtatttgggacacacatgggacacacagctggaacatattttcacattaacacacttggaacacacattcagttaaacatgggaggaatattcacacttgcacattctcagcacaggcaggatacacacacaggaacacacatgagggatacttgtacgcatctgcatgtgtgaatgcacatggatgcatataaggcacaattgtgcacccacatacatatggggcatgctgagatgcactctcagatatactgttacccaggacatgcactcctatacctgagatacacactcctaaagactacttgggcaaacaacactccacacttgagtgttgagtcacacttgaacacacctatgggacatatccacatgctccacacagccatgtgggacatattttgatgcagaacacgtccttcccttagggccagccagctgtcactttttcctaagtgggcatgacagggaactggtcccagctggtgggcctccataagtttgctctggctctcctttaaccttgaaattagacttgagagggcagtatgctcagtaataaaatggatgttcaagatggcatgttttgtagcaggctctgtaaggtaaacagggttcagagcagagccctcagatgtgagttaacaggcagatgcagaagaatggaaaacacaaattgggattgatcaatgcagaaagcttgagcctgctccttcatcccccagttcacttacaaaccattgtggagtgatatggttatgaagcaatgtcaaagaaggcctaaagtcactggatattaaagtttatctttcttgggaatgaaataacagtctggactagagcaaagatatctaaattgtgggtgttagggtgtgaggggaagtggtaggatgcataagcgggagatccctttgggcagtggcccatcctctcctgggttagtggtggtctgagaccagcctcatccttaatgaccacaacctagcccctaggcacagcagcttgggtcatctggccccactaatgaatacctgctatttttagagttcctcaagctggaaaccaggtcatggtgtcctggggaagcctttgtggtccttggtacctaaggctgaagctggaaagacagggccctagattgggtctgagtgaagggtgggaagcagggggacacgtagctggggaataccaggctttcctgggagcagcatcctcagagcctcagttgggttactattaactataacagcctcatgcccatttctcagctttggctttgaggtcaagaaacatgagtttcagttgctactctgcctcttacagtgtgtctcagtcacgttcccctctgctgtctgagtcttacttgctttatttataaaacatccagtattgcccttagatgatggaaaggctcagctaggctaagagttgagaaaatgttttgaagatacacttttctccatgcataaagctgcatcatcattgtccctaagctggattcaattcctgccaacaattggacctgactcctattggagtagctgtagacagcaaaggccaaaaaaaaggagccaagagaagacaccctcatggagtcaggttggtcaaagtcatgctgagattacccccacatatacagatgcttttcaatgccaggtcagtcattctgggaaagaaaacagatttgcagcatttaggtggtcatgtagctttggctcctcaggaatctcctaggtaatgagagaaggggaggcatcaggagcagggatttcttcctaaactaggaaatgcaagaccaggtcacctgtacctgccacctgccagaggaggcagcctagagtgccagctctggctctaagagaatcctctttgtgtttgtgctcatggccattttatctggtttgctgagagggagaaggtcagaaactagactatgtagttcaagtttccccctgctgcagacattgtgggcaaagttctcctgaccctcagttttctggtctgtggaatgggcttaactgtagtctctcataagagttttaagtgcaagacttcattgtgacataggatgtgaaaagtgtcttgtaaaatgttgaacatgtgttcctgctgtttggattgttaagatttcatccaggttgtaattacacatagtttggaggtaattgagaaacttcactttatttctctacccctttcccataccgttcttttaaggcattattatatccattttacaaatggggatactgaggctcagagaaaagagaaacaagtctgaggtggcaggattaggtggtggtagattcaggactagaagccatgctttcagattcccaacccaatgtactctggccctgggctgccaccaatgaattccagtgctaaaggaatctgccagaggttacttaagtaaatatatataaagagttagatttttctctgacaagcagtacagggggttctctggggcacagctttacccagcactctccctgcttgcccaagagagacacgctgattgtcccttcatccctcctacagcagctcatgtcctgctgtctcctgcatgttggaagcagtgaagaattggagatgttaggctgttgtgagaagcaatccttctgccggtttaagccacttcaagacaataggaggattcttggaggcacaaaatccaccttggtcacccgcacctcctcacagttttttgggtacccctgacctgcctaaggggttggctgaaagggatctaaggaaatatatttgagggccttgatctctggaggattgtgctaatagttgagggataagattatggaaataatccaagaaccaaaactgggagtgtctctggagaccatttgggctgaatttcacctggcctcaatgaggacattaaaacccagctgggcttaccttttctcccttagtgtggttttcctttgtacaccacagattctcgtgttcagtcagatttcctggagtctttctagcttgcttgtttttgctattctgagcccagaagagggaaggggtgacacattgagtggagtggtgagaggaaagagatggaggaatctgatgagctcaggccttgaggggcaggcattggaggaaaagggcttttgtgtctctcttcatttgtattgctgctgatgcattattttcctatcttccactgattggctgtgggagcctaatccaatctgttgttatcttcacttttgctgctcaaacctccaaaatgactacagtattcattttgagggatgtcttctgtgggattggataagcagtggggcagggaagtggggtggggggaatgcggtgcttcaggaaaaatggggagaggaactttcttttcttcaaatttgagagcccagagaagtgaataggaaaaggttagctggcacagccctgccaagaagtagccatgcagtttcctaatctcttttgaccatagataccttatttttaaaattttatttttggataggaaatatattcacatgtttcaaaattcaaaaggtccaagagagtgcacagtgaaaagtctcccttccactccctgccctctgcagaggccaccaatgagtccttccagaaaaatgttatgtggatgtataaacaaatatgaatatattcctctttctcttttttatggtaatatacaacacatattgttctgtaccttgctatgctttggagattctttgatacttcattgaatttcaccttttggggatgtgaagatgtgctgtggaaagtagaggttaagagcactgattctagagggaaactgtctgggttcaggtttggattctggctctatgaacttcaacagttacttcattgtttttctgaactttggtttccttatctttaaactagggatcaaatgagttattatatgtaaaaacttagatttgtctctgacacatagtaaacattcaataaatgttagccattttttattattaggaaaaaaaccccactggaccagcgccagtagatctaggttttctcctggcctctgtgctcctgggatagctgggtaacttcctttgttcacaaattagtttccttacctttaaaatggaacaactcatccccactctgcttatccccaggatttctgggtgggtccagtgagctcatgaatatgaaggcaacttagcaattgtgatgttctgagcagatggaagaagtgcaacttaatattttcatagacactactttgggtggcttgaacccagtggtctgaactgggtggaaaaggcagtgtttttccttctgccagtggaacccaaaagccatccctgtactggtgttgtattttgagtgggagatagcccatggcaaaattttgaaatactcaggttttgtcttctgaccttttttattccaccccatccctctcctgacttccttgtttcattttttttggggggccaccccacccctgtcaaaacctgcttttagaagcaaagcagcagcatatgtcaaagatgacctcaactttccatttgaaataatttaatacagctggctcagagaggcgctggatctgcccaagttcatacagcaagtccagaatcaagctacacctagagctcattcttcccatcccagtttttattactgacatttgcattttagtgtgaatttgaatttgagattccttagcaaaaatcatctggtcgtgggggagattctggaagtatctttactaatccttcatactgaagtgttcttatcttttaatcttcagggtcagacctgtttgggaccctgagcagggagggaaagtcaggttctggttttagtactgaagggatgatgtctatagagcagtgggagagaagagcaccagaaaatgttgaaagcggtaacctccaaggtgagacttagggagaaaatattagttctttatatattaaattgttaatctcattgttatttaatttctattttgtggagtttttttttataaaacacatactacattaatatttaaatattgggataggtgtttcttgttttgttttttgtaaaataaattttattgtgtatatttgaggtttacaacatgatattgtaatatagatagatagtaaaatggttactgtagtgaagcatatctgtcatttcacagaattacttttttgtgacaagaatagctaaatgtttgtatttttgtttttaacattagaggtacatgatccaaaaactattggctaccattcttctaagactataggcttggtttctaatcttggcagctctgctgctaactaacttgatgccttaggaagcttttctcattggagcctcatttttcttacctgtaagaaagggaggactgagctaggtgtgctaactagttacttggaaatctccaatcctgaccacctctgagtataagaatccactgcctttggggctcttgagctgagacagttaaaaggagttcaagccctgacaccttactagatgctttatccctctatcagctgccttggtttccttcccttctctacccccaccactttcacctagcccagactggtagatgcttccttacataagtttagcgaacctacttgacattgttttgttacaagcacaaccacttttcctgtagacacagacctggtgccatcccttctgagctttgagggtgtgtctgattttgcttctattttgtcctctctggcagcctaggtttagtcgttgtatccctctggctaagtctttggtttcaaggtctgaggggaagccagctcagccagtttgagtcccttggggcctgacccaatggctgctcactgaatccctctgccacttcctcatccaggactgggctagacttttttaggagaacatagtccattcctgagcataaaaggcttctgacatggactagaggcattgctaggtgccttggccttggctggatgtcttttctctcacagtgagccaataggtagagggaaatcattgcaccactggaaactatcttccactttttgatgggctgtttaaatgcagatgtcctctctgggctgtaaaaactccctgggagatacttacattctctttggaaacgtatgccaaggtctagagtttttgcaagcctgtgtccttgctgggcatgctcagtagacgtaaaggtggtttcagttaattgaaatatattcatttttcctgcttcatctctagatataggagcaggtcacagtgctcctaactaaatgttgtttctgttcttgtcactgtaaaccagatggtcacatttaacgacgttaggacccttagttccaacctatctcctcccctgctcctcccgctaccttcagctctcctttctctacaagattttaacacgacatctgacaaatggataaaaaatgaatttccctttttctctctgccttgcccacccaccctctgcctgtggtgttgagtatagaaccatgcatgtgggagtcatggaggacagattcttcttgtagttctagccccctcctcctaccttctggaaacaaaggaaccccacccctgcccagaaaactccaaggcctggcttcaagtcgtagtccaggaaaagttaaagctcccaggactggtcctaaggcgactacatgaagaaattcaggaacccagatgcagaccttaagatgagtttaggtcgcctaagggatctgtggctcttagagcatccctgcatattccctaggtttgtcctggtcagctcccatatctcagggtagtaaggcaacaaaagtctccagtgggtagctggagctcggcattcacaccaagtccaagaagacgagcatggctcccagggcagggacattttgggtataagacccacgctggctcaacagatgggtgaaggtcagggtaacctcaagcttgagatggcatgttctgactcaggaactcatggagagggcattgctgagtccattattattatttttactaaccatctgtctcttagaatattggaggttgccttggggagatttaatacagctctaggaaatttcttccagattatagcatagagagatgctgctaggacttgctgttagaactagtggtagcttcagtgcctgaaggttgggacgggaatgagggtggaacagagcagaagcaaatagtctctcaaggcaggctgggagaaatcctctccgacaggccaccgtaattcctcagcctttctggaatctgacacaagaaggataagcctagagttggagttccagagattctggtttcttttgagtggcccagtgcagtaagaggaaattcctgcaatataaactctctggtcccagaaagattaagacagttggtttcagtgtggcacgtgattcagaatcactctggttgcttgttattaataaatatggtacggtggttctgagcaggggtctgtggacctcacattaagaaacagtgttgtaatgcgtcagaagtgccaaaatatcccagaataacttgacaattactcctgtttccaagatattttgtagatacaagctaatgtttatcagattgggagctgttgtagtatataggaccttctctagccaacatcatctaggttggccattcagaaacatgtcttctctctgatctgtgcaatccttggcccatttggctgcattttctttaaaggggatcattctctaaacaagaccaagttcttaacattgtgaactttgaggcagcagctgggtctcacttcagaaactcctgggcccatttggctgagctactggcttgggtttcttaccatctattgctaaggtccagacaagcaagcaacaacccttttctcatctgttgggtcaccattagagcagagatcaccttttaacttcctttggaagaagtgcaggaagaagctgttctttgttattagcctcagtgagaaaatattctggatggcatcatgccctaaggggcttctctgggttttccaagctaaaatgtcctaaaaggtcctggaaagtgtgaatcggcttatgaccactgttcatattgggctctagatcaggtggtctgtcttgctcaaggctgaccccatctaggcctaccttttgtgtctgccaggtgtggctgaacagtagatctttcattttattaaagtgaaaactggatagtataatgggatattgaaggaaactgatgtgtaatgactcacaaatcacacacccaaattaggaaaaagatgattttgtgtcatgaaaaaatatatgtacatacttccattcagcatatttagagtcattatcacttgagtgcattaattattctgccaagaaatgaaattatttacttgtgggcaatagcaacacccacattgaaactggaaacaatcaagtgcaaaatgttaaaacctgaggaaaagaaaaagcaactcttgggatgtttttgatattcacagtgggatttttcttacctagcatctatctctgcctctttccctggtgatcactgggcaccagtgcagatctttagcaaaaactggcctgccatagaagccacctagcaataaatcctggcaacaatggactggcatatagggcagctgggtacatattatgtaaacaatttccttggccccataaattgttctgccacctgacagagatgcttactctattgctgtgttctgcctcagagtttgcttgcttttagaactcaagtcagaactttaagtggagtatacacattgttcattatggattaagcttatgttttagacctatcattcagaagtatatactctggttatttgaagaataacactctggtcagcaacttgaatagctcttccaaatttttgttttctgcttatcctaggtagataaggttactgaaagaggcagagagagagagaggatgcagcctggagtcatcagagaagggattacggagtaggtcggccacaatcacacagctaggaagaagcagcctggccccagtgtcgctacgtgtaaccattggctaaggatatggccaaatcagaggcacagaagtaggattgatcattattttattggaggcagtagcaggccatccagtgaaatgttgagcaggcagtaggaaatgtgggactggaggtgagtgacagctgatgtcatgagaaggatgcaagagactcattttgacaagagtggtggaaagcccctgccttgttagaggtaaaggttggatccagagatgaggctagattaaggagagctttgagatagtggggagttactgaagcttcttgagcttgaggagtgatactagcaaaaatgctttaagattcgcatcattaaggcatagcttgaggaagggacagacctgtaagggccaaggaagccggttgggagacagtttgagctgatgaggaccaggataagacagtgggaatgaagagaatgcgttgtatctgagagggagagacatgaagaagaaagaaatagcagggccagaagattttccttaaatgggaaaaattgagaaggagggagaatgggggaatatgatgaattttgcattttattggaggtggtagcaggccatccagtgaaatgtggagcaggcagtaggaaatatgggactggaggtgagcgagaactgatgtcatgagaaggatgattcatctgaagaactaagtggagagaacaaaaagcaaaggtccctattgacttttgaatgcggcagtcaagggtttaagtgggaagcccacttctcaattttcccaggtagtctgactgtgttgccagcaatgcttgagtgagttatcttcaggaaaaagttctcatttttttgagcagaaagcagtaaaagcatcctatcaagcacaaagaagggtgaggagaattaagctgcaataatgacatccccgtcctttgcagagtaagtgttagcctcagtagaataccagagctggaagggacttgagaggtcatctgtatggttccagtctgtcacttgacatgtaaaaaaactgagacgggctgggtgcggtggctcacgcctgtagtcccagcactttgggaggccaaggcaggcggatcacctgaggtcaggagttcaagaccagcctggccaacatggtgaaaccctgtctctacgaaaaatacaaaaaattagccaggtgtggtggaagatgcctgtaatcccagctgctttagaggctgaggcaggagaatcacttgaacccgggaggtggaggttgcagtgaaccgagattgcaccactgcgctccagcctgggcaacagagcaagactctatctaaaaaaaaaaaaaaaaaaaaaaaaaactgagacagggaaagggacctgtccaagatcatttggtgagttactggcagattttcttccaatagccaatctgagtctttactgtacaccatggtacctcatagctattgttggggcagcctggttcacaccttcccaaaaatagggaggatgattatccttcaacactttgggcaagatagccagagcgttttcaaggctgtattaaaaggaatctagctttttcaggagagagcataaaatctcagcttgttttagatatgcttaagggagcaagggaaaataatttgctcttgcccaagtttagctgttcaggagaagggggccttctgagaggatacgggcagacaccaacctgagaaaacctcataggcaaacccctgtcatgtccctccttttcctcctacggagcttcttggaaggcaggtccagctcatctaccttcatggcaattggcatatttgctattccatacatgtgaggttcacattttttaacccattctcccttctgctgcttcttattaaaacactaatatttctgacagccaccaaggctaattaaatgtctattttgggggtggtgctgttgaactagaggggaagaacaagaagttgtagataagtggcatggctctaaaagactgggtgacagccataatcccaagttttttcctgtgttaacacagcctgacattgggcatgctgcttacatgaccccaaatacccttttgcagacatttaccaacaactgaggaaggccttgtagataggaagggagtgctggaggcagggagcacaacatatggtgtggcatggggaaatctgtgaagaatgaggcatcagaagaggcaagggtagggcctacactaggacagtccattagggcagtggttctccagatgtgattcccagaccagcagcatcagtatcacctggggatctatttgaaatgcaggttctcaagctgcacttcagacctacctaatcaatactcaaggcctatgtggcccagcaacctgtgttttaacaagacctctgaggaactgagaatcactgctgtaggtcattcacagggtgagctggtccccctccctgccatttgactggttccatgggggactggcaaatagcaaagctgtagagtaaggccaactggagatttaaatctgctccaccacctactaactgggtaactgtgggttacttgttttatctcacaagtcatcttcagtaaaaatggagatgttaatgcttacattggagaattatagaggttgaaatcacaaaagaaagccctttatccagtttgcagcatatgttttctacaagtataagcttctcttgcttcgtccttccctttataactcttttactttccttctgtctttcccatttcttcttctgttcccactgaaagggtccactggccaccccaagctcactgcaaacacacatgccttttttggtcacagagaccagccttagatctcagactcccagtgcctccagggtatagcaatcatatttctaggttaaaaatcaaggcacatgacagctgataaacagatatatctactttggggagcaattagatagaatatttgatattaggattgtcttcggaaatctggatacaaagaaataatatcctattctgtctttaagcataatgcaggactcttaaccctccccatcctcttattcatgtccaaaagttttgttgatgtgggagtgggaaacactatgtgtcccactcacttgtaagtctgagcaagagcttccctatatttagtgcttcctctgaaatgtcctggggattgggaattattttgttagaagccacagtagtgctgtcctaaggctcagagctctttgagtaccttgctagaatgatgctgctccatcttctggctttatgataggcttgcaagatgaaggatggtaacagttggattttggcagggagggaatataaaccagtttgggaatagagaatataatctctgctatagctactcccaaatggccttttcttggttttcttttttatagctctgtaccatttgataatgttgatgagctcttgctgcttgaaactcttgtctttgacttttgagagatcatgctcctttgtatcctaatgatgtgctaacagcttcttttagttttatttatgtagctctttttctgttccttacctcacattccatctttaagcataaatcttgatttcccaaggcttctggccttagcacttttttccagggcaaactctgattttcacaatttcttctgggccattgattcccaaccctgtatatataccctaatctctcttgagcttcccacccacctgcatgtcctgctggccccccatatttaacaccttaaagagaaaatttgtcatcacttcttttgcaaagccaagccaatatttcctcctaatttgtcctatgctttaattgacgtttgcacccaaaaattaactttgacctttttcttttcctcagactagattcaaggtccttcaaacatgacttcactcacctttttagccatcactccctccactcccctttcccaaccctaacctctccaaactccactacttgttcaccatcacatttcccagtcttcttctctgagacttggcttaatctcatttctctgcttcaaatgcccctccctttcctcctgtatctggtaccatcctacccatcctttaagggctatcttcattgccacacaaaacctttctatagcccaatacccatgtgtaatcaacctcctttctctgaagtcttgtactaggccagcacatgccaggcactgtatatccaccatctgagttcaccctctctataaccctgcctgtgaggcaaacattattacccccattttgcagatgaaaaaactgagacccaaggttgtatagttagaaactctttggcttttgtgaaattatactcctagatgtcataattacatgctgacaattacatttaagtttgtgtttctgactcctcttctattcctcacctcctattgtcattgctactttctaaagtagtaaagcccagaatcgaaggtaggtatgcgtgcccataaaaccacctttgcgtcctgctggaaagatatgcattgttggtacctggaaaccctttgttcttcaggtaaggactgcagctgagtcacagtgagcagatccctgcacacagtaggagctcaatgaatgaatgttggatggaagatggatgagcagagcaaagtgcattttaacaaaaattgtagcaagttaaaagttaattctgtacacaaatggaagatttggaaccaatttccaggttaagtttagtttacattttcaaaacaactcagaagatgagggaggaacatccctttgctccggcttgtgtttgtgaggagagaacacagaagccccacacagctgttaacgccttctggattagcgttcctctcacctccatgcacatacctgtcagctctcagttcagtgttttataccctacaaagcagatggtagagtagaattatccccattttataggtgaagaaactgggacccagaggcagaatagtttataagttaagagcagagtctctagagccagactgtgcctctactggaataatggcttcagtagttattggctgtgtgaactgcaaattatttaacttctttgagcttcagctacctcatctgtaagatatgaatagtaatagtttttccttaaagggctgctgtgaggcttgaatgaattaatgtatataacgtgtttagaatagtgcctgacataatagcgctctttattagctaacatcatcataattatcattacacctttagctagtagtataacaaggtcttaaattcagattattttttctacctgtattccctctctgtggtgttatgttagaaaaaacactagtccagaaggctgaccatttgatgactgtaggcaagttacttttgttaaacctcatctataaaatgagggcatgaaggtgatgatctttaaaattctgtccaattctgacagtcattgattctaagtaggccctgacaacaggcttgcaagttggttagttgtttttgtgaccactaggtcctagattggctttgtccagggtatagctgagccttgtgacctgagggcccaggtatatcagctggactaaatgggggacaaaagtcagcgatctgcttctgggaaaagccaggcatggagttcctgaaaagaagactgcaaagtaaaaaagtatagacagtggaatcagccagatctgggcctgggagacctcaaagagcaccacagatagtgtcctgagcagaaggttggtaattgatactgagatactctttgacccttgataaaaagctatggatatagctttaaactacaggtcttaatggtgctctgggttggggctgtatgtgcttactgagttctaacaatgcccacttgggacccatcttttccaggagaggggagacttctctataaaaatttactttagtaagccagtgaccagcttttctttttcttcactgaggccaaaacaaggagaaattgacttttagtacaattggaagaaagcaagttcaacataaaaatgaatgtcctcagcatcaggggcacctatgattaaaggtggctgtgtacatctcctgtagggttctttaagaataggagccaactggcttatgatatcatagatggagttcagtatagataatgagtagacattggtagtacagtttgataattgtaagagcacacaaagttagaagacccagcttcataatgtattacttgtgttattggctgaaggactaggtcacctttctgagcctcagtttcctcatctttaaaatataggtaaatggccaggtgcagttgctcacacctgtaatcctagcactttgggaggctgaggtgggcagatcacttgaggtcaggagtttgagaccaccctggccaacatggaaaaacccccatctctactaaaaatacaaaaattagctgggcatggtggcgtgcgcctgtagtcccagctacttgggaggccgagacaccagaatcgcttgaacccaggaggtggaggttgcagtgagccaagactgcgccactgcactccaacctgggcaacagagagagattccgtcccaaaaaataaaaatgaatgaatgaatgaatgaatggtaatagtgaggcccagttgattccgtaaggatcaagtgatgtagtagatgtgaaaacacttagcaaagcgtaaagcatgaggtatttgaaaggtggtgttgtgaaaggtcctgctggaaatttattttttatctatcctgaagagctcaccctatgccttaccttctgtggaaggcacaaagatgaatcctgagccatgacagatgcatctggcaggacctgaacaaaacatgttaacttaagtcaaagatcagcatgtgtgtatgtgtgtgtgtgttcatatatatgtgttcgtatgtgttgtgcatttattttgagaacctagggttattctgtggctagcatgttggagggtagatatatgagacaggatgtatattctatagactatttctattgtcttaaagttgttttagttttggtcttatggagccattattgccttgagcaaagtaggctgatggaaaagctgacttctagaggacttgttcagaaattcaatgcttgggagagagtgcttgagtctctttgcctgataggccatgtgttctctattctggaatctgttaccccaaatgctgagaagactgatggcccatacaagctggaacagttgagggaaaaagaacaaataacacagtgagcaggatggtaaagagaggcagactacctccccacccccaccccatccctatcaccgtgcttagatgagtttcatgaatgtctgtttgctggtatggcagtggaatagatgtctgcctgctcttgtgtggagcccagtcctgctagccgtgaagtctagtgagcagggttagcgtgcattccatgcacaggtcctgccttgccagctgatctccagctcatcacttgcttgttcagttttgccatccatcaaatgcagaattcaacccagacctctccccctactgtatctcacaggatggttgtacaaatcactgagagaatgtgtgctaaagttgagtttcttgggtacaaggcatcacagaaagccatattctttcctacccatgacctctctggatggcatcatgtgtgagtgagaggaggaggctgcaggactggggtccattatgcgtgaggaatgttatggtctgttaccccaggaggagggtcacggtggggttaaataatgtaccaccaactctcaattggtcagttccaaggaggaggaggaaagggggaggagcacagggaattgaaagcaaataagcttgagtctcattttagccattgctgtcagcctctccacccattcctgacctagagctgccttgaagcaccaaggagagatggactggagctttctttgttctgcacaggagaagttcatgattagggataaaaagcatgaggcatatgtagtacatattcatattctgggtcattccatgcactggctaacagagagttgacagtattgtttgtcttgcggtctaatggaacttttgttccagtgccatccccctcacccctatctctcaccacttgagtatatgagtttctctgtaagtagtagagctctgtgggtgggggaaggggcaagcaaggtagctgtgtggactgaacacattctcattttgtctcctaagctgatcactggagattccatcgttagtgctgaggcagtatgggatcacgtcaccatggccaaccgggagttggcatttaaagctggcgacgtcatcaaagtcttggatgcttccaacaaggattggtggtggggccagatcgacgatgaggagggatggtttcctgccagctttgtgagggtgagtgtcagtcttcactctcctctcctatttccttggctgcctgtacctggcttccccttcaccagcctctgttctcctgtttatttctctcctggtggcttttctcatatttttttcctttttttaaaattgtctcatacagagaacctgggcttcctttaatctgtgcccttttaatttttagacttttcatttgtctcttgtttaacacccccgccccaccacctcccacctttgtacaaatcacttaccttgtctgggtcttggtttcctcttttggggttggccttggtggtttttgaataagactttttaaccctatattgctgtgaacttttgtctttcttatctctcttttttctgctttctatttctcatcttttttttattctttcttctcgtagtttcttcccatctcctcctcttgctcctctgctcttctctccttcctgtctacttctttgcctctcacacccctgtgtgttgtcactgtgtattcagatgttaatataagagtgtgagctccctgccccccaggcgctagagcttactgatatcaaattttacttttttcaagagaatcaagtggctgggatctaaatgtgctgggggtgggaagcaagtggcatgtaaggtcttgcaagccttctgcctctttgacattgtaccatgaagaacctggcccttaacagagaggctcttgggaggaatttctcagcagtttttgctttttctgggtcactgtaaaggaagtgatcccaatgtgcttatgacctcagggtgctatgggagaataacattggttaggtgtctcagctcttattttttcttggaattgtgagctggaatcagctatttgactattttgagctctgattttcctcatctgcacaatggtcttgacagttctttaatgccagggcatgtcacagtgaatgagataaaacatgcgaaaactgctttgtggcaagacaagtactgaagctacatgagggtgtcttataactatccttacgacagcctatcacgttttgttagtttctcctgtaaaattaggctgaagtcttctagaccccaaacaaaaggtcagaagggctagctagggctcctagaggttgaagggccccaatattagaattatggcaatgtgatataaagaaaggaacagggcatttggagttagaaaactctagatacagttttactaccttctagctctatagcttttggtaagatttttaacttccctgagccctgatttcctcatctgaaaaatagggataacagactttttataaggaattagatcatacatgccaataaggtgtctagcacagtgctagacagatattaggaacttagcaaatggtaacttattttatgattatcatcataattataatcatcaccactacctttttagctccaagaaggtccatgtatcaaggcttcccttgaggttgatagaggcctccttcctcaaggtaaaaaatccagaaagtattgttacctggttgggacagtttaggtgagggcactgcctagaagcagaggaatggacaaaattacctctcattcccttctatcatgagaatcttctaatgaaatatccaatcttttcttctcttcagtcagagtctgcaaatgccatctgtgtcccatctcatctttgctggttaaagaatcagtcccagggatagtcagaaaaagcgtatcaataaccacagaccttcaggactaatgtgaggccctgtacgcatacagctggtatgtcttgtgcttacagacctccctctttaaaagaaggattaaactgtaccaaatgatgatgtcacccaaatccaaatgcatttcattttcaaggaaatgttacttttataataaatagtaaatccaaggatggggggaaatgattgagcaagccaggatggctcagggaagcaaatgacagagccagacttcagaatatcagtgggcagccattaatgcccctaagtccaaggccgggaggagtgttcctacaggaacaaagccccagcagccagagtctagctcaagtggttctcaaccctggctatacaacagaatcacttcagtagcacaaaaaaaaaaaaaaaacaaaaaacaacaagaagaacccaaacaaacaaaaacactaacacccagcctccaggctagtaaaataagatcatttgactaaattggtaactgacatggtgaggtatcttcattccctacctggaagtctcattgctgacatttgaaccctaggatggataatcaagggtggttagtgtggttctgttcaagttagccctacctgttgttacacattaaaacccaacctgcagtctgggaaacccagatgcttgcctcagttctattattagaaatgcaacttgagcagcttcctatgcatcttcaaatatcagttttcttccttgtaaaatggggacaattcagtcttgtaaaaatgctttgttacctgtgatatgctggatacttgtaaagaggaattataataccatttagccactgtacaggaacttaccaggtatatgtgtcttgacctattcacacctgtctcctctgttgttcagaatttcatacttgtatgtgcttatgtgtgtgtatatgtgtgtgtgtgtgttctcaggttctttcctttctgtactggggatatggcttcacaagagcaatgtaggagctgatataccttcccagtagttggtaaggttaaatgaattaaacttgctgaacatcagtcctcatatctagttgtcgacatcgtcagctgttttcctgggctggtttccctgctaggagctaagggtagactgctaggatatgattgtgtctctaagtagcaaatcccacctctgtggtgggcctccttttgtctaatagaccctaacttcaagtcattcaggctcttttcctttgtcactgtgcacaaaatgaaccttttttttctgactttgggccatggcctgaggagagcttgctgcctaattaagggtaggttgtggacaggacacatgacaacctgttactgatgggaggtgaggctcgtgtgacaaggcatgggtttggtcagaaagtaaagagcttgctgaggtgtcatcaggagctggatatatacttttcttgttctttcaaattctttatttctctggtttctggcctgcttggaagtatggagatgaaaggatcacctaagccaatcattaccatcatttcttggctttctacagaccagatgtcatggaaacccaacttttccttttcaaaggaaagcccattgttccagagtgtgacctggcttttatttatgtattatctctttttggctgcaaaaagagatacttgggaaaagcttttcacctctatgaaaccctagattcactgtagatttagaactgaaaataaccatcttagccaagagtggccaacttagatgcttacaggggccaattaagtgagtgaaacaaattgagacaaggggtaagtgggcacctgtgtccaactgggagatccatgccccatctaaagacagcaaaagtgacttggatggttcccatcattagagtgggatatagtggagaggaaagcccagaggggccagatcttctagtatttcaagaaaagccgggaattggatttttatgtaaaactctttatatttaaaaaaatgttaatgaggaattcatatttttaaagaagcacagtgagagtcaaacaaaacacatctgtaggataaattatctcccaaggacccagcttgttgccattggtcaccctacctccacgttgtataaatactgaggcaacatgggcccagaaaatggaaatgacttgctttctcatgtagggaattagtggcaaagccaggacttgaacccaggcctcctgaatcttaagacaattttactagacagtctttgtctaataagtttaatgtcttggcttcctttggtatgttttctgccaaattatttttttcctgtgaataggtcacatgttcctgttttcttgtaggccttgcaattttttgttgaaaacttggcattttcaatattataatgtggtaactctagaaatcagattttcttctctccccagggttttctactgttgattgttgagggctgtggttgtccatttgtttagtgactttttccaactatttttgcaagaccgtattcttgttatatatggtcactgaagtctctgttcttttatctcattggtcagccaataacctgacatttctttaaacatctggatccaagaagaaacaaacaatactactttcctggtttttgtagcttgactctgagctggagtacccacttgagactgtgccaggtcatcaactcttctgtctcagccttctcctcctgtttgtatgtagatcacacatcctccagaaatataagcctatggtcctctgaggtttttttctgagcatgcatctggtcctgggcatgcgtgttatagtgtgacttccctggtatgcatggtggcccttatgaatccttattccccaaagaaacttcctttttagcttcctccttcctgtgctattgcatgtgtttgctatttgtcctgtccacaatcccttgtcccaagtgggcatgagcagtgtatgtctttaaatctttcaacaaaggcagccacagcctggaaagcctctccagccagaggtcaacctctgtgctagtccctcagtgccaaaaaggtcaaaatgcacagctacaatattgtaaagaacaaggtcattatctcctggcaccagcaagccacaccaggaatgtgggccactgtcacctcagccactggggaatggggaatggtaagaggataagcaaaagtgcttcaatgctctcttaccaaatttttgctgcccttttctgcattacacagtcccctgtaagttgctgcaagttttggattagattctagagttccaaaacaatgtgttctgtcattcattgccagtttaaggttgtttcagtggaagaactgattctttgtgtgccctgctccaccacttttagtgatgttgtccccttctgaatcttaatcctgtgctttctggcctatagcataatcaagaaagggcaggcttgggctgctaacaagactgttaacacttgaggacttaccttccattccagactaaaggcaatagtgtttttgcgttcttgagaggagtttcactataccaacccttgtttatccattcaagcttcaaagtgttcataagtctctagtcttaaacatttatatcatttatgtagaaggtcttgcttgtggccctagaggtaacacattataggttgtgagtttaggctgacattaacagggagagtctttctccctggattatggctatttctctcccctgtactagaatttcaaatgacattattataactcatttgcattcacataatccatcttaatggcttctcactatgcacattttttggattacatcatctagtacatcatttggctaattggaggttttttatttttttcttttaatatggagacctcttcagctcagagagaatcttaaatgtagctgttacatcacccagatgattcctccaaattaggtagcacaggtcaccctcatagaaatcccaagttgaaagcaaccttgagagtcatatagcctatccctcagcctccaggcaggaccagagctaaaattaccctgggcttttgagaacctggccagcatctgtaaaccaagcttgaactactctgttatttccagctactagcccttatgctgtagtctgagccaatttcttgaaacatgttgcttttttcaataggaagatggtatttaagagttgacaccagtaggagacattctgaatggttttcttggctctggggctttccaaggccctattgttgacccatagcatggatttgtaacctggttggctgcctgagttgaggctatgatcttgggcctggcacctgtttttctctgtgtaatcaacccccgggtttatttggggattagcttagaccttcctagcatcgtgtatatactgccttggtggtgtgatgacttgaggagaggaggaccatgactgagtacctggagatgaggtctgtttctgtggctctttgtaaagtacaacatttttggaaaatcatcatacttgtatatatatattttcttttttcatcagtatatttatcattatgagtaagagtgaaaccacttatctttacatggctctagtgctattaatatcttctcaccagtatttactaagtcctgaacaaaagtgactgtctagcacttagcaacagccacctcctggagtggtctagacaagtactaagggtatctggcatcttgagaggtctgttgtcctctatattagagggtcactagagaaacaatactcagaagtgggttggtctctttttttagttttcagaagtgaaaactgacagctccatacctcttcaggccaccagttatacctcaggacagatctgaaatagtttgtccttaagttgaactagaatctgtctttctggagcttctactcatgggaagggtgtaaatgtccaagagaactggctctggagataatctttctggattagaatcagagcctttccatttattagcaaagtggccattgtatgcttcagtgatctcatcattaaattgaggatataacaacacctatctcattaagttgtcaggagaactaaacaaaatacaggaagagcactgacaatgggatctgacacataggaaacactcaataataatactggtaatacttgcagcaaactcttaatgtaaatggtagaaataatgtcctcatttttccctgctcctctctcaaaccctcttggaatatactgactctccactctgtctatagcccatcagagatctgaaacctcagaccaggtcagccaagcctctcctgtcctccaggcttctgagctttcaccttttagccattatttggatgaatcagtttcttgttgctgctatgtgtgagtggctagactgaggccatccgggcatgcaaggcccactccattcagccacttgtatgagaacatgggctacatggaggcctggacatgctgacactgccaggctttcaagactaataggaatgatattacaactaatgaccctgctgaacatgtaattggacaatgttctttcttggctgttctgacctctaccaagaggcataataatgttactggggccatacatcagcagttagcttccatttaggaacaaataaatggtggaacattgtgttatatgtaggaacccaagaatggattgaaaaacttctttttaaaatatactggggaaaaaagccataataatagacctgaacattctgcccattggtccaactctttgttttgataagcttattaaggtagtacagttattgacattgctgctcagtagagcttggccctgaatgccatgtgccatgtgtgcgatggactcattcccatatttatataaagtaagcatagcttactgttaagcgtacatttaataaagatgctatatacgggacagggccagcagtagccctgaaaaacagtgcagccagatgaacttgaatttggggcaggtcctagaggttcactttcccttgtgggttgggataggctgagagtgtgtgcgcagtgggtaaggtccctcccaactgaaaatattgggagaaagtccagcccagtaggtagagtgtagcatcagtaggcagcagacagagggtggtttgttgtcatgacaagtgactggtattattggtccaacgtcaggttgtttagtgtgcttcaataagcaggtaaagcatggtgaccaggtatccagaggcagggagtatgcagtgaaaatggtttcttaatttgtagaatgaaggacttaataaaaattcattcacccaacagatgatcatcaaatggctactgagaagatacagaggtactctagaacttcagcccatcctctaagagtctgatagtagatgtgaaaacttatgcataagggaggtgatttgccaaagctctgtcactttagtcaagttctttacctttgccaaatctcacttttctcccctgaaagatggaggggttggaacagatatactccaagaacttttctagcccattctccataatttcttcttctttttttttttttctttgagacaggatcttatgcttttgccctggctggaagtgtagtggtgtgatcatggctcgctgtagccccaaactcttgggcccaggcagtcctgccacctcagcctcctgagtagctgggactacaggcacctgccaccacacccagctaattttttgtattttttgtagatgcaggatttcaccatgttgcccagactggtcttgaactcctagactcaagcaatccacctgcttcagcctcccaaagtgctgggattataggtgtgagccaccaccctggctaatcttgttttagttgaggtaaaataaacataacatcaccttccccatttcaatcattttaaagtatacaattcaatgcatttgcaatgttgtacaaccatcaccactatctcattccagaacttttttatcaccacaaaaagaactccatacccattcacactcattcctcactcctctctcctctcagtctgtagatggtataatgttttgtacaaatgttagcaggtagaaaatacaggatagttagggaagggattaaattcataggaactgaggtcaggaagaggcatatgacttcagtagctataggagactacatcagcctggatacaggctaaaaggagtaaaaaacataagacagatgttgcgggaaaagcctcaatagggaacaggtgtcatctaaggcattggtactatcctggaggatcagaaagtaaatgagaccctgccagacttgcctttaacttgttagtaaatggcatagcccaaacaagatcacattccaactccaaagccagtgtttgccacatcaccatcctgaagtgttttttttttttcttttctaaatgtctgtcaaataattgcaagctttctgtgagatgggtaactcaggtcagcttgatttcagcattctgcttagcgtggctttcatcatgaaatcggtacttccatatctgaatagcttaaatggaagtcttctcttcattttagctcaaatagaaagaaaatcaaaggaaatacagaataaatgaacttctaaaggtcctggcagagcactccttttttggctacttaactaattaacctaaattctatcaacgtctaagcaggataattccatgaaaaccaatgaaaggagaagacttaggggtagagtggagtgtagttcttattagaggcatctagttttcttgactgggaaggaagctatgttatctgtgaagggtttccctacactccaatccacccccattctagcttgagttctcactttaagaagccttgtcatgggcagaaatcatcaatacctccagcctcgactaagtaagtctccattcgttgggaagggtttttgagtctggttgtcaaggaggtggcatttggggtataagaaatttgggacaattgcaaagcaattacaaaagtacttcctaaaactcttccctgactagagaggacaatgtttctcatatgttgcttcattgttctaggggcagatgatgccaacctaggggataataacaagaacagctaatatttgactctgtgctagaaactgttttacatgcacagtttaataaggattaaataaactaccttatttaatcctcacaacagccccatgagatagatagatattatttctatttcagaggtaaggaaactgaggatcagaaaacttaaagttgcttactctgtgttactcagaggtagttgtagagccaggatttgaaatcaggatcccgagtcttcaccctttaccactgtcacagactgtctctcctaattttggcctaagagtccagagactttgcttcaatcctgactgccactttgatgcatccccctgtctggccttggatttctcatctgggaaatggaaataaaaaggtttgcttgcctgccttgcagggctgttttgaagtccaagtaagagagttcgtgggaagacactgttcttgaactaggttttcagagaagccagggacaaaagaagaatgatagaaaagagtagggaaggccttcctgaagaaggagtagggggcaggctttagaaggatacaaggtacagaggtgtgaataaacagaatgtgttggaatgaatgggaagggtagcttgcctgaggtcacacgtctgtgttgaagagcagtgaaactcggtgggtcggtcccattttaatgtgctgatgggaagccatgaatgcaaaaacagtatattcacacaggtcttttctttttctctttttgtctgttatataacaaaaattttcattgctctggttgaagctccttatttctcattgtgttggtgctggagagggagaacaatttgttagcagccttcttattatgatacttcatataattagtgagagttattaaatcttcccttgaggggtagaggagtagtttctgtgtctgactgtacataccgtgctgattgtctttgtgccaggcaggaatgctaagtgcttcctggcatgcacattcaggaatccctaagcacttctgatcctcctgaaagctgagactggggctccaaaactgggtgtgtgtgtgtgtgtgtgtgtgtgtgtgtgtatgtgaagtgggagctctgcttgcaactaaccaggttcctctcagtccctcacattcacctttgtatccacacttcaccattgcttcactgtggtggcagagaaaaggccttttggtgacctttgttattgaagagttcacgttccctccaatctctcctttatctgtgttttgcccttttgtagtgtttgctgagatttttggctggcaactttattcagacagagacagagctcatgattagaatgattagaattatctgaaaaaggaaagggctgccttgggagacagtaatctcatcattcgttgtgttcaagcagataggctgtgcaattgctggcagggtatgttgtcaagggagtttatgtattgattggggagcaaggggtggcatggactagtccaccttccatttcctttataaactgattctatagctctgagagtctattgttcaataagactggcaataacccctcaccttctcaaaggatgtcttgctttttactcctctctggttgattagatttggcctttgaaaatatcaaggtgagatttagacaataccgcttacccattctcttctcagaaatattacactgctggagacaggggccggctggctttctaagacactccttgagcctttattgactttatgaaggaattactggctggatattatggtagttttcttttagaactactgatccatttgcagggaggggctactaaagatgttgaagaggttgtaccaagggctgggtaatcatcactttatcatatggaacaatggtgagtctattggaatatgcatataggtatataaatgcaaggagagaggttgacaaggatttcacacaaaatccataaccatggtttcctcaggagaggtagaatatggttaggatgaggaacaatcaggggaaatttcaccttatctagacagttttagctttttatgtatttattttaatagagatataatttccataccataaaatttaccattttaaagtatacagtttagtgggttttagtatattcacaaagttgtataaccatcaccattgtctaattctggaacatatttttaaaatcatttttaatagataaaactgtatatatttgggggatgtaatgttttgatatatatatatgtatacacatattgtggaatgattaacatatcatcatctcgcatacttatcattttttgtagtgagaacatttaaaactgtactttcttagcaattttccaataataatagtattctattacataactatgccatattttggtttatccattcatcaattaatgaacatttgggttgtttctacttttggttgttatgtataatgctactatgaacatttgtgtacaagaatttgtgtgagcatgtgtttttatttctcttgagtacgcacctacgagtggaattgttgaatcatatggtaactatatgcttaactttttgaggaactgccaaaatattttccacagcagctctaccattttacattcctgccagcagtgcgtgggagttccaatttcttcacatgctcgtcaatacttgttattgaccttttaaattattacagccattctaggacgtgtgaagtggtatctttttatggttttggtttgcatttctcagatggctaatgatattgagcatcttttcatgtatttattggccatttatatgtcttctttggagaaatgtctattcagatattttgcccatttttaagcgagttgttactttattgttaagttacatatattctgaatactacatctttatcagatatatgatatgcagatatttttcccattactgggttgccttttcactttattgatggtatcatttgtagcacaaagtttttaattttgttgaagtccactttatttttgcttggttgcttgtgttctaggtgtcatatctaagaaactattgtctaatgttacagattttcctctatgttttctttaatgacttttataatctgattccattcagatatttcatccattttgatttaatttttgtgtatagtgtaaagtaggagccaaagttcattctcctgcatgtggatatccagttgtaccagcaccatttgttgaaaaaactatattttcccccttgaataatcctggcacctttgacaaatatcaattcagcatgaatgtaggatatatttctggactcctggttttatttcattgatctttatatctattcttgtgccagtcccccattctcttgattactgtaggtttgtagtaagttttgaaatcagaaagtgtgagtcctccaactttattctcctttttcaaaattgttttggttatcctaggtcccttgaaattccatacgagttttagtaccagtttttcaattttctgcagacaccaggtgagattttgataggtattgcgttgaatctgaattaatctgaggagtattgctatattagcaccattaaatcttccaatccatgaataggagaggtttttctatatagttcttctttactttctttcaataatgctttgcagttttcattgtataagactgcacttcttttgttaaatttattcctatgtattctttcttttcctatttaaatgtgatcattttcttaatttaactctcagattgttcattgctagtatatagaaacataattgatttttatatcctgcaacattgctgaacttatttattcattataaaaggtttttttttggtggattccttatgatttcctgtatatcacgttatatgatctgtgactagagatagttttacttctttctgatgcaatgtcttttatttctttttttgtccaattgctctggctagaaccttcagtataaggttgaataaaagtgatgaaagtgaatatccttgtcttgttcttgattgtaggatgaaagccttcagtctttcaccattaaatatgatattaactatggattttttataaatgttcattattatttggagaaaagttcccttctatttctagtttgtttagtattttttttttaatcatgaaagggtgttggattttgcaaatgccttttctgtgcctgttgagatgatcatgtgggattttgtaaccttatttcactcatatggtgtaatttacatggactgattttcatatgtgaagcaaccttccattcctggaatcgcatctggtaaggtgggcaatttgtttttaatatgttgctggatttggtttgctagtattttattgaggatttctatatttttgttatttggaagggtttgtgaaagattgatgttagttattttttaaatgtttggtagaattcaccagtgaagccatctagtcctgaggttttttttttttttttttttttttctcccatgtgggaagttttcaagattgaatgaaattatttattaaatctttttcttgttataggtcttctcagattttctacttcttcttgagtcagtttctgtaggttgtgtctttctaggactttatccatttcatcaggttatgtaatttattggcatacaattggtcataatattccctttaattcttatttctgtaagactggtagtaatatttcttctttcatccatgattttaataattttaatctattttttctattttaactttttgcaaggcaaatgtgttcttgtataatgtataattttaaaaatagaaaaaaaaatggaaggcacaaaataaaaatgcacattaaagatatgggtatattgctaactccctggctgtctctgtgggtatcagtttctttattacgaaattgagaggatggattactgttgctgaagtttttgaaagcctttggactatagtatttctatgtttgagcatgggattaaaggacatagatgagaatatttgtggacggaaaatagaccagtctgggaggaacccaatattcctaaaggaagtagtaggaagtaagagtggaaatacagattggagtcagattatggtaatattttaatgtcagggtgagggatttggacttgctttataatcagtggagagctattaaggattttgggtttatgggattagccagtcaatgtgatagtcaaggaaattggtctaatagtggtatgtgggaagggtaaaagctagaggatcacccagggacttgttcaggtataaaagtatgagagcaatgacagtgaaaatagaaaagggagtaataaagaccagagattgtctccaatttggaaagcactccgtggtttagaaggaggagggaggagtgagttgtcttgctcatcctcatgtccttcacagttagtggttaggcacagaataggtccaaagtatttgttaaattgaactgcattaatcagccttgcttcggagttcagtgaagttcaaaggctggtttccccagcctttaagcactctaagaggacttccaggacagcctttcaacctggcatgttccaggcattgtctatcttcttacttgtcacccaggcatctatatgtgctaattgcagcatcaatgaagaaaaggtacacattagcctgcacggattgttgggcagggttgataatggctctctggtctgatatttcaaccagggcagataagcatatgggctgacctgtgtcagtgcactctgacatacatgcagacaaagaccttcctctgtacagaacagataagctctcaagagcagaggacttagaggttagaccagaaagtcttatcattaggcccgggggatgttttgtgggaacctgggatcaggagaaaaacagttaggccttatatgccacctttttctaggctaagaaacatcttccctcaaatgtcagctctataaagggcagtgatttctgtcttttttatttgctgttgtatccctaatacctggcacattatccacacttggcatagatttaatgaatgaatgaatctgttagtagttctttgggatgaaagcagcatcttaacctaaggaatgggcttctggggttgttgcagtagagtagatgaaggtgtcttctcagaagctccttatgaaggaccctgctacacaggcctttagttataaccagaaggacttctctaccaaattctttataaggaatctgttttcacttggctgcagttgccttcgtcttttctcattgttatttggaacgacagtgtcatggtgtatagcttgaacctaaatgtggttctatttctgcctttacatctgcttcccctttccttcatatcctgtcttcattcccactagaattgttcaaaatattcatcttattccagctatccaaaagtgaacatttggacctgacttttcttaaactcctaagaagaaaagaaatgattcttattccttaaaggcctgcctatgttaccctttccatagcagagtttagcttgctttgtgagaagcagggaaaagctaatggattattaagagggtgaggttttcattggtacaaatagacagcatcatgtatatgagatgtttgtttcagtgccttaaatcactttttttttttgcccaggtctattcttttgaataattatctctcatattgcttactgattgcattaaaggacagctattagcatattgaagacacaaagctgaccttttagaagctggaaagatatttataatggagcacttgcagagggtgataggttttggatagagatacattttgcaaatttggctgtatatacaaaatacataaaaacagagtgagccctatttactttggcctgtgacaattcagtgagatatacgctggtgacatctctaagttcactgagtggtaatcatgccccctcacctcctgtgagaaaaagaaagaaggaagaatatacagagttgggaagtaactaccatccttctagttctatcccaaagcctcttccccccgagtgattacccactaaaaggcttttctgatggcagaaatagggatgcatctaaattgtgtgattttagcttcttgaggcaggaatgtggaaaaaactggggtttaaggagggaaaatatggaaaatatggagaattgattaaacctgttgagacaactggcaagctctttggctaattacccctgacagattttgtcactctgccaagcgggcccacccttcgtttccttcctgcccccatggtttccccacttcctaggactgtggggggtggcgggaagggctatcttcttgggccttcttgattttcagtcaaagtcatctagaatatccagagacatctcactcggccgtcccaaaggttttttttttttttttttttttttagcttcccactgccttcatgatttaggatggacagtctcaactgttagcgaatttatcagtttctgatgattctaataattgtctgcccaccttggcccaagccctttccttttcttttcctgtcttccttagaaccagaggcacaaagattctagcacagtgtttaaaagcataggctctagagacagactggctcctatcccagctcctctgcttcctgtgcgacttgggatagattacttaacttctctgagcctcagtctccttttctgtgaaatggtgataatagtggtacctatctagcagggctgaatacagtatattgcaagctcttagcacagtgaatggtgtatagttggtgccaattaatagctattgctagtatgtggtggggaagtattctcccatccctatcccagtcttgaagaggtagagatctttgcatgtccaaggcactttacagtcaaattttgatgattatttgtatatcccatcacagaaatcaacactaaactttgttttcaagacacccactctagtatttaactttggcctctatacttgcaggtgcataaatgctgtgttttgacagcaatccaaatgtggcactcaagatgtatagcttaacctttttaaaaatccagttgtgctacctagatgtgctccagcatgaatgaatttagtccctccactctatttacagataggtcaccagagacctagagaagattaaacccatgcccagggcaaaaagtcaccctagagccaggtttcgaattctacttgcacaggtctctggttgaaggttctctgaatacctgagaagttcagttcatcctttttctacttgcctggaaacctcccaaagaaggaagctaactcattatttttcttttgcctgcttccacagctctgggtgaaccaggaggatgaggtggaggaggggcccagcgatgtgcagaacggacacctggaccccaattcagactgcctctgtctggggcggccactacagaaccgggaccagatgcgggccaatgtcatcaatgagataatgagcactgagcgtcactacatcaagcacctcaaggatatttgtgaggtaaccatggtggttcatgtggaggcacttccacgaagaaccagcaaccctcctgggccctgcctgtgacagtcccaagatgttggaaagggcacatagcctcccagattctgttcagtgaggtgaaactgcttccttagggtcagtgaggtaaaactgcttccttagggtttctcaatctctgtttttcacatttttctctctgtctagttttaatatttattcatttatattcattgtctctctgtctttaccctttcttagtcttcctccttctctcccctgcatctctacctttatctttttggtatctgatccagttacagccatctcatgtaagggcttaacctcactcattaaagcaaaatgcatctcccgccaagccagtgattcacagacttcaatatgtaccagagtttctgggggagcttgttaagcagccctctcactcttgtcccccaagtcatgaattatcagtctcaggtaaggcatgagcatttttaggtttaatgagcatccctggtgattctgatgctgctggtcctactctctcacttggagaacaccggttgtgagtttaagcagaaaagagcttggagacaggactccacagaagatggaggctggatggacaaacctgggctccttcagtatgtcactttttttccccaagagctgtctctctacattccctaaccccattccttccatctctctgtcctaaatgaagatgagagccttcactctcgtactctcttaagcttagtagctgcaagttggcatttttaaagggcattttactgaacaggaagggaaaaccaatgggaaatgaaggcagcgttttaaaaggattaaacacacacacacacacacacacacacacacacacacacacacacattctctcttatatctttcttcttgactcggaaaactctgcattgaatctttttgtctccttccttccagaggaggggttaggttctattttctgtcccccagcctagggtccactgtggagtcagtagtacagctccaacatttttcaaagttcttatttctctacatcagtactgcccaatggaacttcctgcaatgatgaaaatgttccatgtctgcattctccaatatagtagctataagccaacaatttatggttgttgaagagttaaaatgtggctggtatgactgagaaatggaattttaaattgtatttacatttaattaactttaatttaggtaaccatatatctgtaatgacagccacattgaacagtatagctctggaaacaccaaggccaaggattttgtgcctgaactttctttatctcaactcattttctcacccctttcaggaagattaaaagttatcttttcccactgccccactccctgccctgccatgaggcagatagagtagaaagaacaagaggtctggggacatggaatgctggtttttcacattctaacttggtcattaattaaccctgtgggcttgaagataccccttaactcctctgacattcaattttcttatttttccaatgggcttcattatagcaatctcttaagtttgttgaggaaattaagtaaatagaatattgcaataacctatgctgtatttggaaaaaggtaattttcttttttgcctcctttttaaatttattcacccatccatccatatgtctttttcttcttcctcctcccttcacatcaatggctgatgctaaaaaaattccccctcggaatgtgctacatggcattcagcatcaaaccactgacatttcattcattcggcaaacttttagtggaattctgttctgtgccaggcctggacataacttctagcctcaaagtgtcgtactttagagcagcatctgcatcacctggaaacttgttataaatgcaaaatctttggctccaacccagacttactgaatcagattatgcattttaacaaagttactatttgatgtataatacatattaaagtttgaggagcattgctccaaaatgatacctatattacaatgtcatagtgtttttcataaaattaagtacaatctattcttcgcttggtagctgagggatgctgtcaagatctaagtcaggtcatatcactcctctgctcagaaccttccaatggctcaccatttctacctgagtaaaagtcaaagttattattgtttacaggggcctgtgtggtcaacccatccttgcctctatgactttcacctcctgctcctttctgctatgctttcgttactactccagctatactggcctcttgcttttccttcagcattactaatatattcctcccttagagcctttgcactggtttttccctctgcttaaagcattcccctccccaccccacatttacatggctcccatcctcagctccttcaagtctttgctcaaatatcatcttcttgagacttctctaagcattctattgaaacctgtaaccttgcactgcctctgcccctttcctgctttatttctatctgttacatttatctatctgacatattatatatttaacttatatattttgtttattgtctgtctcctctactggaatgtactttccatgaagggcagggattttcatctattgatttactgatatattcccccagcacagtgcctggtacatagtagatgctcgataaatattgcttaaagtcaaaattaaatataattgctcacatgtatgtactgctttgattggcaaagtacattcacatcatatgtcatttgatcttcaaacaggacaaaagttgttattgttattcctattttctagatcaacagatttaatctctaagaagcaaaattattttcccagagctctcaggtactagcccagtggaagtccttagaagtttctctcaactcccacacatcttggcctcttcctatgggacacagactcaggacagcaatggaagttatttgtctttccagaaagtagggggtgatatgatcctgctttaaggagtttccaatccagccaacccaatcaaaccttttgttgacaatttgctggttccttatttttcaacaattattggtgctgaaggtaagtatttaaatgggagctatctccttttctcaccctataatcacgggcatcaaagggaagtggagaaagctgcatctagctggatcagaagacagtagtttagcccaggattgtgtaatctttaaaccaaaagctgtgaggagcgaatggtttatcagaaagaataccagactcagaattgggagtgctgggttcaggacctaccttggtcactaactgactggggaatctcagatgagtcttttcaccctagggcttgtaccccatctctaaattgcataggttggaggagctctttaagttctgtttggctcttactttttctctagttctgtaagatgtagatatgccctcactagagaaaaactgtgatagcgagccaggctacttctgcattttctgcttcttccttcttggtaccattggaagcatgtcttactcaagcatggatgtgttaacatggcataaaccactctttctgtaggttatgggagagctctaaacacttcctacttttgtacttgttgaaggggaaagggggaaaattatattcaatataaaaaaagtcacactatttattagaggacattctttttccctcctgggagcagaaagtgctttacaaacatttaagttataacacccttattttacaaatgaagaagtaggaaataaaggggtttttaattgaagttattcaatgaggtcagtaagagacataatcttttcaaatgagttctctgcagattacattcttctttctaaacccagacagtggtataaaataccttcagtttagttctagatcaccttgaccaacaattggtgatattgcctcttataaccttagaactcaaagtacaatcaaggaaactgaggcaagagtaagcagagctaacgatgctttataaagctgtcttgtctgctttctcttgaggaagataatctcagccatctgatacctatgaaataccttctgtcttcaaatgcctccagagaagctggcctagctttcctcactcactctgtattagtgatcataccattcactatcaagaaattcttccttaggcatgctgtagcttcaagtcatttccatttggtatattttaagcctgaggttttcaaacgtattagccatttgggttttcccttctgcaaattgcctatctcaatacatcccaatagtctttacatcttggcacatagaaaatgataacacattgtataagatagtaatatttgtacagtatcctaggataaaaatatgagtcagctagtcagcctaaaatgccaagcccaggggtttctgcctgccataggccctacctgtccattctgtctggacattctgtgctgtgttcctatactttgcccattttcatggagtttcttatgtttttttcttgctgatttgtaagagttccttgtatattctagatatgaactccttgtcaactttccatgttgcaggtatcttctttattctcttgtttttgaataacttttttacttcatttgaagaaagggtttcctatctcaaagagaggaagaaggaaataaaagaaaaccaccaatttgaacattctgcttctaacttacctttgatcatcaccagcatgggaagaactaattagcatttagttgacaaataactgagcagcaactatatgccaggtattctgttaaactttgaggatacggctgtgaataacaaccatggtcattatctcctaattttcttaaaaatgtcttcaagatgtttgtcaggtcgcctatcaggcctcaggttccaggcaaaaaaaaaaagacatatgaaacccctagaatgtcagaactgaaaggatccatggacatctttttcgatgtcttcattttagagacagagacactgaggtctaaactttttgtgagggcccttccctaaagaatttcctaaaccccagatgatccaggggctgtttggttcatcctattttctggtagtttctaggatcttttctggagatcttgggtattgtttatatcccatatcaaggcattacttctagatcaatgcactaggtctcaactcgtagatcagccctggtgggtttaagaacaaagtgaaatagatgggcagctttccttgctgttaccataacaatgccagagctaatttatgccagttgtgactgatttgataatacccacatttatcttagctactctctggcctgccttcccacccatgcccactttactcctaggagacagagattaggctctaggaaactgcctcccttgagccatagtaccctgttccctgttaccattcagatggggcgttcaaagcatacctggcagtaagagccacagaccccttttgttccccctgccctgtgacaggccttcaatgggccctgagtgttatctaagacaaacaaattttatgtcttccatcattcttcatgatgttgcttttcaggcccctccctaccctgctcactcccctctggctgtgtgctattttcttggtgttcctctgaaaagagggtggactcaaaatttaattctgctctcctgcagtggtatgactaccttccaattgcctctcccatttttgcctctcaatatatttcttcttttttctaactgaaaatggtattaggctttttgacaatcacatttcactgccaactcattttaaacttacataccttcaaaaatgagtgaatgagagtagacaagtattgattgaccccctaatctaccctctgttcaccactgatgtggaaaatttgatagccatcaggccagccaaaagaaggggataaaaaaagcaagactccagggagctaatcatttctcctggcctttctttttccagaaacttgtgtggtatagaggtcgagggtgaccctttggggttatccagctactcccatattcttatgtctcatcgcttatttttttgataagggcagtttacatctattatttgtaatctttagcaagtgactatcttagatactatggctgcaggagatcttgagaagacattgggtcttccctcctctttccttgataatatttcattccaggcagccttcttatagctgcattttcttttctttacactctctggcaaagacttttatcccatttttgatcatgaagacaattaaaaaacagcattagaggaagtttaaaaataggaacaaaaaccagccagaatccatcaactataacagaattatttgcacttttgcataatcccttcaaatctgtccatatgtgtatatatttacagagttgtaatcacactgatataccattttatgtcctactttttaacattgtatcataaacaattttccatgtttctacatggtcttcctaattatcattttaactgctatgtaatatttcatcaagctaaatgtaccagaatatatttataatctatcattggctttaaaaataagagttgataaaacattctaaggtcctaccatcctgtgggcattcttcctaatatatcccctgccataacatacataatataatagaaagaaaatgatttccttgagagtggcaataaataacatatttagggacttaggaagttggactgaattctttattcattgtcttttcctaagatcactctcttagttttatttctgttatattttatgctgatgttgacttctagtatcattgttgaattctggtgattttatggtgttttgtttcttccctgagacttttcaaataggagcagtggacacaactattaaatattttctgaactggcttctcagcagataaatgagctatctacgctgccctcttctgtctctcattgtggtcactcatcagtacctattgcttacccagaagtaatatgttgaatgtgccactgttactgttttcccccagctgtgctcctcagcctgccttagggaaaaaaaagtgggagaaggggtaaggaagccttcactcccatttaatgttgagatgatatgctcactgctctccctgctccattgtagctaagacacgtccagagatggtagggtgaaagagacagatagacaggcacacaggcacagaccaacccagacatactaggctctgggaattacatattaggtagggaagggcctacaggagtttattgccattccttctggtagtcaatgtaaaactttctagggaggcagaatttggggagcaacctctgtaaaggtagtggagccaaaagggtgttctgggaattttcttcctgatcaaaaattgcatatgaaagaatgcaggaaattttcaacatgtcagtcaatgagggcacaaatcattagttaaacagatgtcaacacaggcatagactattaatttgccaactatttaaagacacctactaattaatggctaaattggagagtgagaacagatatgggaaggggaagtgagatttgttgtagaggtcagtaaaagacattgaagccagggatgaggatcttcttggagtgtgcccagatgacctcattggtagctgtgttaagggagacaaagcgaggatagggacagggctatatgtggtaaatcagtccctgtaaaactcttccttaggggttcaacccttaagaaaagtgttaagataatttcacttagctttttgatgaaagcaaatgactataatttcttctcaccaagaacatttttatgtgttactgatttctaatgaggacagtaactatcaagtgaaaacctatgatagtaggttccaaatggaagatgcaatttagattggggctgtttttgtcctgacttaagtatgccttgagtctggtttatgttaccccaatgctttcttactagaccaagaatctctttcatcctttttttctctttcatcagtggttatctttattaatgtgttttatgtgtttagggcacatttatgtgtttaagacacatgtgttaggtgttaggacatattaacgtgttaggacacatttatttataaatatatatatatatgatatatttataaatttatatatatatatataaatttataaatgtgtcctaaacacctgttctgttaaaaacaccatgtccaggcacacataggcttgttggctgagctcatctaaatgatcactcctggccagctacctcagatagttgagaaatttgctttgagaaatggtttgacagatatttgcataatgtgaatagtatgaatgcattttcttaaagtatgtgaagacatgaatgtctaagaaaatattgtatgtgtactttgatgtacacaacagggaaagtctaaaatgataaacaactattattcctggttatttcctgacattaaagttcatgaggaaacttttttttgaagaaatggttttgttttgtcaatttctgttcccttgtgggaagtttttctgttctggcctctgttcccaattttttgtcaatgttattaagacctttggtttggtcctataaggaatagaactttagagatgtgaatggatccagctaaaccagtagctaataagacctgtgaaaatgtgctcaaccagcttcttggaaagggatatttgactttgggggtcttcttcatagaggatggagggaaaagactttggagtctttgcactcttaagacttttgctggcaacccagctttcctaattactcactgggggagtgacttccttctgtaaacctcagtttcctcatatgaaaaatgaaaataattattccatgcctacttcttgggaccaaaatgaggctcttaagtgcttaggaagtgtaaagccttctggaagtcagggacttcctcagcctaggctttttctttgtctacagggctatctgaagcagtgccggaagagaagggacatgttcagtgacgagcaactgaaggtaatctttgggaacattgaagatatctacagatttcagatgggctttgtgagagacctggagaaacagtataacaatgatgacccccacctcagcgagataggaccctgcttcctagagcacgtaagtatcttatccatttggggagggttttgagaggtgttaggaaacaatggaaggagcgtttgagctgtctggttctgttcagctcctttttcctgcagtggggaatgggttcctcttgggccttcattttgacccctggtctctagccaggaaacaaggacttagaaaagtgctgtgatttgccctataaatgttaagcatgtgtatgacctgctggttccattcccgaatgtatattccagagaaactcacagaagtccacaagggagcacatacaaggctgttgttgattgcatggcagtgtcgtatgtggtggagtaccattagaagcaacctaggattctccttctttaccattcccctcccctctccctttccttcttggcagttaccagtagaatttttcttcatcttcccttttttgtttctgttaagtttccatgagactcagtattttgggaggaattcaaaatattcactgcacagagaatcaaggaatctgagaaataacaaggaccatggttagtaagaaagtggtccctgcaagacatttatgggaagggcactggagaaggtgaagtgacaaaaataggaaaagaacacatggacttcgaggatggagctctgggaaacaggatagtgacgatttgagtcctgtatctgtagtgtctgtctgggttactttgggcaagtccttcatgggctttggtttgttcatctggaatgtgaggttacactgtatgatctctctggttctttgacatcatctgagtctcattcacaggtgacctagttgttttgacagcatgtttccccttttaataaagtatttatttttaaagatttaatatgtgcacttaatataaaattcaaatgacacacaaaagcatgcagctaaaaataagccttcttggaaatattcctgttttacttctgagactctgtgttggggtgggttccctaagatcactcttatgtttagtgatttggactcagaatatggttatattgaatgtggtttaggactcagaacatgtttatactcatagctatgatttattatagcaaaatgattcgaagtaaaatcagcaaaaggaaaaggcacacagggcaaagtgcagaggaaaccaggcacaagctttcaggagtccatcccccaatggagtcacacaggatgcacataaatcccctaggaatgagttgggacaacacatataaaatgttgtctgccaagaaaactcattagagactcagtgtccaaggttcttattgtgggctcatcatgtagacaccttctgcctagtgtgtactaaaattacagactcccagaaggaaagcaggtatttagcataaaccacattgtttgtacaggcagtctggacacagtgagccactcttatcagggaatagtgggggaaccctcttgagaaccaagtttcaagatgccagtcaaggggaaatatttccagcaggtttttctgagaacagcaatttcaggcctgatacgataactcttttctgtatggtatgtaaactcattcaaccattctagaaagcacctgggtagtatttataaatgttaaggatgtgtatgaccttctggttccattcttgaatgtatattccagagaaactctcacagaagtccacaagggagcacatacaaggctgttgttgattgcatggcagtgtcgtatgtgttggaataccattagaagcaacctaggtatttatcaccagggagatatataagtggatggggtttgcttattgtgaggtattatgtagcaacaaaccgaagactagatgtatgtaccttatagcaacatatatcagaaacatagtattgaatggggaaagtagaatatagaatagtggttctcaaccgggggctgccctgtacattgtaggatgtttaacagcattcctggtctctagccactagatgtctgtagcaatgccttgctacccagttgtgacaaccaaaaatgtctccagacattgacaaatgtcccctggggaaaaaaaagaatcacttatgttttgaaatgataacatacttttacctttaatctgttaatgcagtgaatttggattgaatgattttcatatgtgaaatgaacattgtattactgggatagaccccacttaaacactgtgtgttatctcttttaatgtattattttaccttttaaaattaattgtttacccttttattagttctagaatttcatttttatcagctttacgtagatataatttacatacaataagattcattcattttaagtgattttaagtgtatactttaaggagttttaacaaatgtatatagttgtgtaaccaccataataatcaaaatataggacatttctataactccacaaagtcctcttatctagacattgcaaacaatctgtgcccctactcctggctactggcaaacattgatctcctttttatttgaaattttgctttttctagaatgtcatatatgtgaaatcatacagtatataatcttttatgtttagcttctttcatttaacatagtgcctttgatatccatccatgctgttgcatatatctttcgtttatccttttttattgcttagtagcactccattgcatggatataccacctattcacaaattaatggatatttgagttgtctccagttttgaactctaatgcataaagctgctatgaacattctagtacaatattttttgagaatatatgttttcatttttcttggttaaggacttccagggttagggttgctaggtggcatggtagattttttagcttattagataatgccaaactattttccaaagtttctataccattttgcattttcactactaatacgtaagagttgaagttactccacatggtcatcaacacttgatattatcagtatttttttttttttttggagacagagtcttgcttcgttacccaggctggagtgcagtggtgcaatcttggcttgtagcaacctctgcctcccaggttcaagcaattctcctgcctcactgtcccaagtagctgggattacaggcatgtgccattacacccagctaatttttgtctttttagtagagatggggtttcaccatgttggccaggctggtctcaaactccttacctcaagtgatcttcccacctcggcctcccaaagtgctgactgggattataagcgtgagccatcgtgcctggccagtcactatttttttttttaattttcgccattctaacatgtaggtgtgtagtggtatctcattgtaattttaatttacatttccaatgtatagtgatgttgagcattttttcatgtgtttatttgccatctatataaaaactggtgaagtgtctattcatgtatttttcccgttttaagtgtattgtttgtttttttattgtttagttttgagagttcttttattaaaaattaatatgtaatttacttatttatggggtacatgtggttttttttttttttttttgagatggaatctcactctgtgacgcaggctggagtgcagtggtgctatctcagctcactgcaacttctgactcccgggttccagcaattctcctgcctcaacctcctgagtagctgggattacaggcatgtgctaccacgcccagctaatttttgcatttttttagtagagacggggtttcaccatattagctaggctcgtctggaactcctgacctcgtgatccatccaccttggcctcccaaattgctgggactacatgtggtgttttgatacatgaatacaatgtgtaatgattaaatcagggtaattgggatagccatcatctcaaacatttatcatttatttgtgttgggggcattccaaatcttctagctattttgaaacaagcaattaattattgttaactacaattgtttttataactattttgaaatatgccattaattattgttaactgctgtgatatcaaacactagaacttatttcttctatataactgtagttttatacccattaaacaacctctcttcatccttctctccccacaaccttcctaacttctggtaactactactatactctccacctccatgagatcaactttgatagcccctactcacatatgagtgaaaacatatgatatttgtctttctgtgcctggcttatttcagttgacataatgtcttccagttccacccatgttgctgcaaatgacaggattttctttttatagctcaataatattccattgtgtatatatagcaacatgttcttcatccattgatccatcagtgggcacttaggttgattccatatcttggctattttgaatagtgctgtgataaacaagggagtgcaaatatctcttctgacatattgatttttcttcttttggctatatacaatatatacccagcagtgggattgctggatcatatggtacttctgtgtttagttttccataccattttccataatggctgtactaatttacattccgatcagcagtgtatgagagttctctgttctctgcatcctcttcagcatttgttattttttgtctttttgataataaccattctaactgcggtgagatgatatgtccttgtgattttgatttgcatttccctgatgattaatgatgttgggcatttttcatatgcctattggccatttgtatgtcttcttttaagaaatgtctgttcagagcatttgcccacttttaaatcagattatttgtgtttttttgctattgagttgtttgagtcacttacatattttggctattaatgttttgtcagatggatagtttgcagatattttctctcattctgtatgttgttgcttcactctgttgattgtttcccttgctgtgcagaagctttttagcttgatataatcccatttgggtatttctgcttttgttatctgtgctttagaggtattactcaatagagtctttgtgcatatcaatgacctgaggcatttttccagtgttttattctagtagttttatagtttcaagtcttacgtttaagtcgttcatctattttgattttattttttcatatggtgagagataggggtctagttttattcttttgcatatggacatccagtttgtccaagaacataagttgaagaggctgtcctttctccaatatgtgttcttggtgtctttactgaaaatgaattggctgtaaatgcatgggtatattttgggattctctattctgttcaattggtctatgtgtctgtttttacttcagtaccatgcttttttggttactatagctttacagtgtattttgaagttaggtagtgtgatgcctccagctttgttctttttgctcgggattgctttggctattctgggtcttttgtgggtccatatgaaccttaggatttttttcccatttctgtggtgaatgtcattggtattttgatagagattgcatttaatctgtagattgcttttggtagtatattttagcaatattaatttaacaatattaatttaatattaattaattgcatttaatctataggttgctttaggcagtacattttaacaatattaattcttcccatccatcaatatgggatatctttccctttttgtgtgtagttgtcaatttttttcagcagtgctttttatttttattttagagatctttcacttctgtggttaaatttattcctatttttttttaaatcctgttttaaatgggattgcttttttggtttctttttcagattgttcactattggcaaacagaagtgcacctgctttttgtatgttgattttgtatcctgcaactttactgaatttgttgatcatttccagcatttcgtgtgtgtaggtagtctttaggtttttctaaatataagattatatcatctgctaacaaggataatttgatttcttccttttcaatatggataccctttatttcattctcttgcctaaattgctctggctagaacatgcagtactacactgaacataagtggtaaaagtgggcattcttgtcttggtctagatcttggaggaaaggcttttgatttttttcctgttcagtatgatgatagctgtgggtttgtgatatatggcttttattattttgatgcatgttccttctgtacccagtttgttgtctttttctcatggagggatcttgaattttatgaaatgctttttcagcatctattgaagtgatcatacaggttttgtccttggttctgttaatgtaatgtatcacgtttatttatttgcatatgttgaaccaaacttttgtccctgggatgagacccacttgatcatcgtgagtgatctttttaatgtgttgtttaattcagtttgctagtattttgtttggaatttttgcatctatgtttgccagtaatattggcctgtagttttctttttttgatgtgtttttgtctggtttgggtaccagggtaatgctggcctcatagaatgagtttgaagtattcctcctctttacttttttgaaataatttgcatagaattattatcagttcttttttaaatgtttggtggaattcagcagtgaaaccgtaaggtccttggcttttctttgatgagacactttttattactgttttgatcttgttacttgttattggtttgttcaggttttctatttattcatggttcaatcttggtacgtcatatgtatccaggaatttatccatttcttctaggttttccaatttgtttgcctgtagttgttcatattctctgtaatgatcctttgtatttttgtggtatcagttatattctcccttttcacctctgatttcatttatttgagtattctttttttcttagtctagctaaagatttgttgattttgagtatcttttcaaaaaaaacaacttttcatttcattgatcttttgtatttttcagccttaatttcatttatttctgctctggtgtttgttatttatttccttctactagctttgggtttggtttgttcttgccttcctaattctttgaagtgacttggtagattatttatttgaagactttctttttcttttttgatgaaagcttttattgccataaattttcctctttgtactgcttttgctttatttcataggctttagtatcttgtgttttcattttcatttgttttgagaaatttctattttttaaaagaattttgttatttacccactgatcattcaggagcaatgtatttaatttcggtgtatttgtacagtttcttaagtgctcttcttactgatttctagtgttgtttcattgtggtcagaaaagacacttgatattaatttgactttttaaaatttgttgagatttgtttatggcctaacatatggcctgttttcaagaatgttctatatgctgatgaggaaaatgtgtagtctccagcagttggatgatatgttctgttattttcagttacgtacatttggtctatagtacaactgaaatccagtatttctttgttgatatcttgtctggataatctgttcattgctgaaagtgagtgttgaagttccctattattatggtgttgtagtctgtctctctgtttaaatctactaatatttgttgtgtatatttgggtgctccagtgttgggtgcatgcgaatttataattgttatatcctgtagctgaattgacccatttattattatataatgacattctttgtcttttcttacagtttttgacctgaagtctgtttcgtatgatatatgtgtagccactgctgctcttttgtggtttctatttgtacgcagtatctttttccatcccttcacttttagtctctatgtgtcttattcactagaaattcacttaaagaagtgaacttcttgaaggcagcatatagttggatgctgttttttttaatccattcagccactctcttttaattggagaatttagtcccatttacattcaatgttatttttgaaaggtaaggacttactactgccattttgttattattttctgattgttttgtaactcctgtcttccattattttactactatcttcctttgttgtttagtgatttttctctggtggcatgtattaattatttgcttttgttagtgtatcttttacaggtttttgctttgatgttactgtggggcttagaacatcttattataaactgatgacaacttaactttgatcaaaagaaaaattaaaaactaaaatctctaaaatttaagtccattacttccccattttaactttttgttttctcagtttacatctttttatattgcctatcccttaataaattgcctttttgttttgttttgtttttgagatggagtcttgctctgtctcccaggctggagtgcagtggcacgatctcggctcactgcaacctctgcctcccgagttcaagcgattctcctatctcagcttcctgagtaggtgggattataggcacgtgccatcacactcagctaatttttgtattttttagtacagatggagtttcaccatgttggccaggctgaccttaataaattgtcattatttttgatagatttttttcagtcttcatactaaagttgtgaacggtttacacaccacaattcagtatttgtctgcatagtttattctgaatttgtctatatacgtttaccagtttattttataacttcaggtgttttcttgatacatattagtgttcttttaagattgaacaactggcttcagcagttcatgtaagacaaatcttctgttgatgaattccctcagcttctgtctgggaaagtctgtatctctccttcatgtttgaaggatggctctgctgggcacagtatgggaggtttttttgttgttgttgttttgtttttttcattcagtactttgaatatgttgcccccctccctcctgccctgtaggacttacactgaaaactctgttaccacaggaattgaaactcctttatatgttatttgcttcttttctcttgctgcttttaagatttccctctttgtctgttaacctttgagagtttgattattatatgccttagggtaatcttatttagattgaacatgtttggttgtctttaaccctgtacctggatatttatatctttctctaggtttggaaaagtctctgttattattactttgaataagctttctaccttttgttctttctcaacatcctctttaaagccaatgaccctttgacttgctcttttgaggctatcccctagatcttgttggcgttcttcatttttctcattattttttctcttcttattgtgtattttcaaatagtcttagggctcaccggttctttcttctgcttgatcaattctgttgttgagaccatcccatgtatttttcagtttgactattgtatttcttagctctaggatttctgtttaattttttaaaatttcaatttcattgttaaatttctgtaatacatttctgaattgcttttctgtgttacattggcattttctgagtttcctgaaaattgctattctgcattcttgatctgagagctcacacaacatcatctcattagggtcagtcactggctccttattttgtctatttgggaatgtcatggtttcctgtttgctctttctatggatatatgtctgtgcatttgcattgaaggattagttctttattccagtcttcactgtctggcttggtttggtctttcagaagtatgtctgtctagaggttttgtgcagagtgactatttagttcccttagcctgagatcactgcctccttttcaacactagatggcaccctgaacccagatttgacatagtctttctcaatttcagagtgctactcatcctggatggggaggaatcccaaagataccccagctctgtgggaaagctggatggaggtttgttcccagaggactgatgaagtgtgcttcctgcaacgtgatgctgttaaacagcctttctgatttggtgtcttttttgaggtcagatgaagggaagctggagtttcatgcactgggtgttgctaaccccacccccaccctctaactctagctgcctttgggattttttactctgcaggcattcaagaggcttcttacaggttgaggcaggaataatttttctggaaaggaatctaagatggtggggaagctagctgtccacttttattttttccagtattataggaaccttgattttgagggtgcctttctacacagtgcctggcagcttggggaaggagctattttaccttttgcttgcagtttttcagttctctgtggcctctgggattgtcacaacttcagtcattgagttctggaatattccttttgataatctgggcagtggctagttctttttggttttctgtggaggagagtaaagctacatatactgtgctattttggtgacattctcagttatgagaattatatattttgttaacaagtcctttgtcagataagttatttgcagacattatatcccagtctgtggcttagcctttcattttcttaactgtgtcttttctaagttgtgcatatttatggagtatgtgagaaatttttaacatatgtataatgcatagtgatcaagtcgggttttagggtacaatgcattttttttaagtatagtcatcctactctgctattgaacattgaatgtattccttctatcttatgtttgtaccctttaacccacttatcttcatgttctcccttctcacctgctcacacttccgtctctgttatttttccaccctctacctccatgtgttcaaattttttagcacccccaaataaatgagaacatgtgatatttgtctttttgtgcctggcttatttcacttaagacaatgacctctagtttcatctacgttgatgcaaatgacataatttcattctttttatggctgaatactattccattgtgtagaagtaccatattttctttatccattcatttgttgatggacacttagattgattccttatctttgctattatgaatgttgctgcggtaaatatgcaagtgccagtattcctttgatataatgatttattttctttaagtcaatacacagtaatgggattgctggattgaatggtaattcgatttttagttttaagagtatcttaattttattgaaatccagtttatcgctttattttattttatgggtcatactttttgtttcctactttctttgcctatctcaaaatcataacggttttctacttttttaaaaatagaagttatatagttttattttttacatttaggcctatgatcccttttgtggtaatttttatatatggcacaaaatacagatcaaggttaattggtttctgtatggatatttgttaaaaaatactgattcccctattgaattgcctgggcacctttgtcaaaaatcaattaagcatatatgtgcagatctatttttaggtatactcttctgttctagtgatctatatgactattcttgtaatagtaacccactttcttgattaatataggttcatagcaagtctttaaatcagatagcataactcctccaacttagttctttttcaaaacaattttagctattttaggttatttgtatttctatataaatttaagaataatcttgccaaattttaccaaaaacaagcaaacaaaaaccctatcagtgttttggttgggattgcattaaatctgtggatcagttttgggaacattgatatgatgagtcttcaaatccatgaacatttaactgtttatttcgatttttttgtgatttctcccaggattgttttttagttttcattgtatgattttgaccttttaaaatttgattgttttaaaaaatatttaaggtataaatttaagatgtacaatgtgatgttttgatataaatgatgaagtgatgactacagtcaaacagattaacatatcatctcacatagttacttttttgtggtaatagtatctaaaatttactctcttagcaaatttccagtgtataatacaataatgttgactctagtccccatgctgtaggttagatctctagacttttcctgtgtaactacaactttgtgccctttgacttatatcttcccattttctcccaccccctcacctctggtcaccaccatcctaatctgtttctatgtattcattttttttttccttttgattccacatataagtgaaatcatgcagtagttttctttctgtgactggattatttcatgtagcataatgtcctctaggttcctccatgttgtgacaaatgacataatctccttccctccttctttttaaagtctgaataatattctattctgtgtctctgtatgtatatgtaatatatatataaataaattaaaaatagaggtaatttattaaaatataggcaacatattacatatacatatacacccgacagtttctttacccatttatccattaatggacactttgtttgcttccacatcttggctattgttaatagtactgcaatgaacatgggagtgcagatatctttacaaggtagtgagtgcatttcctttgggcatatactcaaaagagggattactggataatttgataattctatttttgatttctttgggaacatcttaaaggtattattttccacagtggctgctgtaccaatatatattcctactaacagtgtacaagggtctccttttctctaaacccttgtcaacacttgttatgtcttatctttttgataatacccatcctaatagatgctaggttatttctcattgtggttttgatatgcattttcctgatgattaatgatgttgagcatcatcgtatacctgttggctatttttatgtcttttttggaggaatgtctattcaaattctttgctcatttcttaattagtttatttgtttatttgtttttttttgctgtgaagtgatgtgagttccttatatattttgaatattaaccactttatatattttatatatattaaccactttatgtatattttgaatattaaccactttacagtttgcaaatattttcactcagtctataggctacctttgcatgttgttgactttttttttctgcatagcagctttttaatttgatgcagtcccacttgtttctttttgcttttgttgcctgtgcttttggtgtcatataaaaaagcacagcagtagtgcttttagtagttttattatttcagctcttatgtttcagtctcttatgcattttgagttgatttttgtgtatggtctaaaatatgggcccaattttgttcttttgcatatagatatccagtttttccaacaacatttattgaagagactatacgttccccattgtgtcctgttggtgctcttgtcaaaaattagttcactatatttgcttcggtttatttctggactctctattctattacattggtatatctgtttttatgctagtaccatactgttttgatttccatagttttctaatattgtttgaaatcaaagagtgtgatgcctccagatttatttttatttctcagagttgctttggctatcaagggtctagtttggttccatagaaattttatatatgtttttgtctatttccatgaaaaatgccattggaatttagataggggttgtgttgaatctctatatcactttgagtagtagggacattttaacaatattggttcttccaatccttgcacatgggaaatctttctatttctttgtgtcttcttcagtttctttcatcagggtgttttggttttctgtgcacagatctttcaccttcttgaataaatgtattccttaagtatttcattctttttgatggtatcataaatatgattttttaaaatttctttttttgatacatcattataggtataaagagtgcaactgatttttgtacactgattttttttttgtatcctgcatctttactgaattcactttttctaacaggtttttttctttttaatttttggagggagtcttttgggctttctacatatataatcatcttatctccaaatagggctagtttacttctgatccaatttggatgcattttatttatttttcttatctgattgccatggttagtatttctagtactattttgaataaaattggcaagggtgggcatccttgtcttataccagatcttagaggaaaagctttccatttttcaccattgattatgatgttacctgtgggcatctcataaatggcctttcttatgctgaggaaatttttaatattaatacctaatttgtgaagatattttatcctgaaaggatgttgaactttgtgaaagctttttccacatctattgaaataaccgtgtggtttttaaattattccttttgctaatgtaatgtatcataataattgatttggatttgttaagccatacttgcatcccagggataaatcccacttggtcatgatgtatgatctttttgatatgttactgaattgggttagctactattttattgagaatctttatacctatgatcattagtgatactggcttgtagttttcttttcttcttttttttttttgacagagtctcgctctgtcacccaggctggagtgcagtggcgcaatgtcggctcactgcaagctccacctcctgggttcacgccattctcctgcctcggcctcccaagtagctgggactacaggcgcccgccaccacgcctggctaatttttttgtatttttattagagacggggtttcaccatgttagccaggatggtctcgatctcctgaccttgtgatctgcccacctcggcctcccaaagtgctaggattataggcgtgagccacagcgcctggcccttttcttgtatttctgtctgactttagaatcatttgggagtattccctttagttcttttatttatttatttatttatttatttatttatttatttattgaagagtttaagagggattgctactaattcttatctgggtatttggtagaattcagctgtgaagccatctggtcctatgatcttttgttgttaggagattttaaatgactacttcaatctctttatttgttaatgttcaggctctctatttcttcttgattcaatcttggtaggttttatatttctaggaatatattcatttcctctggtgtttccaagttgttgtcatataattgttcataatagtcccttgtaatccttttcatctctgagacatcttttgtaatatcttcatgttcatttctaattttatttacctatattctttttctctaaaaaccaagtcttagttttgttgatttttttccctaagtttttctgttctctgatttatatctgctttgatcttttatttttttccttctgctatctttgagtttactttgttcttctttttctagttccttgaggtggaatatcagattgtttatttcagattttttttaatgctatcaacgcccctcttagaactttttttgctgcatcccaaaggatttggtatgttgtgctttcaatttcatttgtctcaagatattttttaatttcccttttgattttttctttgacccatttgttattcagggatatgttgtttaatttctactgatttaagaatgttctagttttcttcctgttactgacttgtagttttatatcatcatgaccagaaaagatacttgatatgatgttgatcttcttaaatttgctaagacttattttgtggtatagcatgtggtctattctggacagtattccatgtgtgctttagaagaatttgtgtgatagcctgtctgcgtgggtcagctttggtaacatgtggtagtgagactagaatccctagtttgggaccctagggctgtttgcaggtacatgcatggtagctgtgctgggtcactgggccagagcatccaaggaggtagtacttgcttaagtacctagagaatgcaaaggctcctgtgctgagtccctttgccaaggcacctgtggtaggagtagctcaggcagctctgggcatgggggagggaaagctctggtggatcagggatctggagaatgtgaaagctgttggcctacatcaccccttcccactgggctatagtaaccacagcagcagttgggcagctctgggtggctccaggaagtagagaagaagaagggacatggctcaggcatgttttttgttgttgttgttgttgttgttgttgtttgtttgtttgttttttctcctaaaactcaaaaggaagaaaaaacaacccatggacccttagcagtataagctgcagggcgtctgctgatactatactagcagttggttttctcagcaggaaaagctgaaaaagcttctggggtctgtgactgtgaacactgaagaatcttgagaggtaaaatctacaggaggtacccagtggctatgagggctattgaggtccttgacagagaggcctactggggccctgtgccaaagaggccacggcagatcactgcgactcctgctactttgctgatactgatataaccaatccctattctttgctctctgctgtttccagacatctaggctatatctgtcttttcagagatctgggtgggatgaaactgaagctggtcattagggcagtgtcccataaagctggggaagctggttgtacactcctgtctcctccctgtatgtaggacacaagatccaagatccaagttgctgtttcataatgagcagtaccagctatggggacggggtgatgcaagcaaaatgaaactgtttttcctactcgttttgtgtatttgttttctgactttttctttcactatattgctgtggcttcttaagtggacccctaagcttttccagaattattttttgttcatggatagctaccaaattgttgttgtttgctgaagaaaggaaggcgatatttcctactctgccatcttactgacatcctctcctaaaagttgatttctaagtatttaaaattttttcggctgccattgtaagtggtattttaaaatgtcaatttcctatagtctattactattacacaggaatacggttgatttttgtacattgactttgtgtcctgacacataaccaaattcactaattggttccagtattttttttgtagatttcttaggattttatgcatatacaattatgtcatctctgaaaaaaagagtttaatttcttcttttttcagtctatattctgtctatttccttttttatcttatttcactggccgggatatacagtacggtgttaactagaaatggtgagaacaggcatctttgtcttgttttgatcttaggggcaagcattcaatattttaccaagtaattagcttaacgtttttcatgggtgtcctttattacattgtggtagtgtctttctatttctagtttgctgatgtctttgtcataaatttattttctcaaatgcttattcagcattattgaaacgatcatgtaatttttctcctttaatctgtcaatgtggtaaattacattgggataagtctgtcctgatcatggtatattattctttttatgtgctattttgcttgtttttcaacccttatataacaactctatcttgattttttgttgatcagtttctattgcctattgtttctcttgggttttataaatattttctattctaatgtatcaggttatcttttattaagtacttgtcaatatataataaaaattatagagtttttttaaaactttacttggaattaatttcaaacttatggaaaggttgaaaaataagaaccatacaaaaaatacccagattcccctgttgttaacattttaccattttgtcttatcatttgagtgtgctctccctctctctcctgactctctcctcttcccctctctttatgtacatatttatatgtccatacatacatatacacacactcatacatttttttctcagccattagtgttttaacttgcatacatcttagattccttacctctaaacacttcatcacattgtgtttccttagggacattttatggagataatatcaggctctggattgtgtgattccttcaaacagatatttatttatatttttagcttttccagctactctcagtggcagggtttgcctgcaacaacttagtctgtcattgccagaagtagagtcactgatctcttgctttttgtgatccagtcccagagttttatttccatgctgtgttttactcttattagggccagtgttcccttattacccttcttttacagaatgtccctactattcctatgtactcatttttctataagaaatttacagtcagtttgtcttgttactgaataatttgttttgatatttattattaaattatgaatcaatttaagaataattgactcattatcattttaatatttctgcctaagaatatgatctgtctttccattacttcaagacttcttttggggtccttggtagacttttcctttcctttttttcttttcccacagcaagatggattctggatatactctgagtattgtaacaaccacctggatgcttgcatggagctctccaaactgatgaaggacagccgctaccagcacttctttgaggcctgtcgcctcttgcagcagatgattgacattgctatcgatggtttccttttgactccagtgcagaagatctgcaagtatcccttacagttggctgagctcctaaagtatactgcccaagaccacaggtaagggatcgagggagtcaggagtgaatgagggaacttcctctatctgttggttctcattgagaatacatgtccttttgccctttctgagcttctgttaacttatctgcaaaacaggatgatacattcttgattgcctcatagccaacagggtacagaaggcagagctatcactggctttgttactcacacaaaaggagggtcctttgccactatatttgggttaaaatctgaaatctgcctagggctccagaaccactaaagcatataagatatgatttgttagagaagcagcatcaatccaaaaacgaacccaaagatgtaaaccaaaccaactggcccacacccatggctcatgcatctgggtctgaaagttagccccaaggagaccaagcaatggagctaaatcatacttgtggactgataatattcactaggtaaattatatatggcataattcatcttaaaagttccagaaaaaagtttttaagcatagctcaaagctatgttagtttcttaggccaaaacaacctcagagctttttgggggtttggtgggcaccaaaaagataggacattcgcctgggatttgccatttctgtacactttcaccttgtgactggaactcctgcttcaaagtcctcttgccatctaggtccctgattccctctcctctcaccccttgcgctccagagtgacagtagagtagctcaggcagtgtcaggcgacatcaatttctgccctttctcagagtgacccgttgggcccagcacaactcccacgacatagacaaccccttttggcaggtctcaggaatctgtattaagatgatggctcctgccatgcatgtcaagagtagctcggatttgaaggcaactaaaggctgatgccagcttggaagcttagtaagataggtgttcagataggtagggctgaaatacaggcagtcagaatggcccctgagggagaagattagatgaagaatgataaatagagaagaatactgactttgcttacagatgattgatataattccctaccctaccttccttaagttgatgagaatgaagactgcatgtaagagggaggctagctgacatgtctggaagtagaaaatctttgttctgttgttctccccaataagaggctgggcccagacctcatctgagggctttgaccagggttaggctggaccacagctattcctttcttctcctgccgactgctaaaactagtaggacaggttagagatgggcacattccccctctagccattttgagaaaggcagccagctaaagatggcaaaaataggcagtatgggacactgacagtgaggaatccatgactgagtagtcttggtgtagaggaaatgaacattgtcatgccaggactgcccagtagaactttctgcaacaatgcaaatagtctatatttgtgttattcaatatagtagttacccaccacatgtgactacttgagtactaagaaacatagctagtgcaactgaggaactaaattttaaattttacttaattttgattaaatatggctaatagctaccatgttggacagtacagctctgtgctttacttccaagaaagtggtttagagcactgatctcctcaaatcagagaaaggaaaggtacaggggcagaaaatgggtccaaagagcaggagcacttacttatgttagcagcttctgtgctgcaatcttcccttctgtcaccactctacctccttctaagtgtcaggctcagacatcttgccaaggagaaacttcggtgatgtcacagagcccaaaagatccccatacattggagcaactaactgtaaaagaatgaaatgtaacagaaacaaatgtagagtgtttccattgggtctaagataagaaataaatagctcacggacaggctgagagagatacagcttctagagtgtgttttgaagagacttaggaagtgttagttggccataagctcaatatgggtcagcaatgggatccagaagaaaaactgataatagctaacattcactgaggctcagaataaagacttttctaacatatttgtcttgagacagaatagactggttaggaagtatagtgaaaagcctttcactggaggtgataatgtaacattgtttgagagccatggctctgacaggtgtgcagatcacagattggagtgagggatgtgaactaggaggaggtactacgtaggatctgccctggcaattagaagtccctttcctctgcctttctttggtccatcaacccactattcaatgttgtgggtgtgcagttgtgcagttgtgcaaagatgtgcggttgttgcacatctatttttttctccttccttttttaaaaaatggtactgagagattaagcagactagtgaccacaaggcattttcagtttctctaaagaaaggtgttaacactgaactgtaaggcatcctcttgtcttctcagtttatttttgcccccactgaatggctgagatctcactatcaatctgcctttcccaagagccatttgattgcaaatcagaaaagaacagcagaaaaaaactggataggatatgtaactctcaacacgtctgctatccagagtcccaggatgtggggccaagggttacacgtctgagactaggggttttaagaggcatcccatgtgatggctctactacggaaatgtttgatttgtaataatagtactgctaacatttgttatatgccaagagtaaaatagtttacatggatgattgtatttaatttatgaaaccttcaataaactatacttttccccattttacagatgaggaaattgagtcaatgagagagggagtgaggcttgccaaaggccatactgctagtcagtgagaaaaactggcatttgatcccacaaagtctggcttcagactttatgctcttacccactgtgctacattctgtttctatattgtgcaaaagcaaacgtgaggatatttcagagtgattttgggcagaagctccatagaaatagatgatggaagagatgataaggtggtctatactgtgtcatgtgtgaggctcccttcttggtccttggctggctgtatcagataggacacaaaaaaagtgatgtaacaaaatagtggtccatttgtctctcatgtaaaagaagtatgtattctgaagtttatgactggtatggtggcctcatggtcatcagaaacatgagcaccctacagctatctactatcctatacctagggtattgaccttgtccttatggtccaagatggctaccagaggttcggccatcacatcaacattccaagcatcaggattgagtaaaggctaaagaagcgtatgctctctaccttaaaggtgatttctcagaaggcctacctgatagagcaggagcaccgtcatcttggacaaacactgccacttcaagttccagctccctttctagcctcatgcatttcaaggaaatcacttcttttctaactacaagcagccagaaagagcagacagtaagagagctcaggcacagaaggaggtaggggggaaagtctcttgagtaactgccaaacttcaccctcatacaatgggccccagtaaaacagtgggcgttaataaacacattccttttccttcaggtgcactaagatagagaagatgaaagcagactcaggggatatgcctgcagctgcaaaaagatgtatgggaacagacacacaactctctcttcccagataagcacaacaaagaggcgcaaaagcagtctatgcctctgataaagtctcccaccctgaatccttaaaaactcttagtctgtaagaaagtgtggctctgacctaactcggccagccgctcctctcaggtttatttaaaatcaacctgtccctgttgactgaaaagccatccttcatgtttctctcctctttctttaattcttacactacgcaacacttctatttacatatcagtgtacaaaacttacttgcatagtcatttttgctgaaacaaaagatagaaaatgtagtctttaggtggtgtgggttcccatctgaaaatcaggactctgttactaaggaggtagaggagagtggatgttaagattggcacctagcacattggttctttggcacattggttggttcaacttgcactcttttgttttcacagtgactacaggtatgtggcagctgctttggctgtcatgagaaatgtgactcagcagatcaacgaacgcaagcgacgtttagagaatattgacaagattgctcagtggcaggcttctgtcctagactgggaggtaggaaacttaccaaccagggtattgggaaatctgaatagcttggcaaaagcttcccatcttagctaaggacaggtgaagagaaattacatttgaagagcaacagtaaggatttagattagactcaaggtaaaatttcttgctaatgagaagtgttggatacttgaataactttctaagaagcttggagaaatttttgtgatgatacctcattaagaaatgaaaggttcatttcttcaggtattgccaaggaacaattagggttgattcagtagcctttcaaagctctttctggatttatgaccaacagattcacacttagataagaaatagtatatactaatttacttccagacacagaatacgaggttggttctcctgttcccaaccatgcaggacagccaacatacttttttttttatcggtgataccacctcaccctagcacatctattaggtctctctattaggcctgtacactataggccacaaccatcatccctgccaaatccacagttttcacatctgtttttaaaataatccctgattatttcattgcagacagccatgacttctctgaattctgaaagaccttcccttcctagatgcccaccaaaagtatcaggagtaatgacatttcacatatgtcttgcaggcccaggttgtgcaatctgatagtctgctggctaaaataaccaagataggagaggctggacgtgctactagggagggattagcaatcttaagccttgtggtcacaatatagaggtagggtctgctccctattccactgacctcaactcaagtgtcattttcagtgattaagaggtagtatttctcttaatacttaaagtattttagcccgttccaagggaaccaagcatcatcctcacaaacagctgcttaaccaaggcccagaaaaaagtcactttccttttattctgctacctctgtcctaccttaatgtagattgctgaaaaagaccacaattctgatcagctgacatccttttgggctatatttgaaggataatgttcccatataagtagaacagcactttgatttgcagagaaaggaatttgtctagatgaagagaccctcattctcttaagcagaagccagcactgggccagacttactagaaaattgtgggtccttttttccttgtgttggcattgctttggccatttgcctgattaaaggcagagagctggaccaaatgacttctagcaagcccatcaactctaagacactctaaaattaaggtggattagctggccttattctctctcgttggcagggttttttgtaagagaaggtgcccagcagcagttgtcttcctattccctggagcatctccccaacttcccaatgcctagaagactttctgattcccctgtgtgctctgggacatcagtccttggagcaggagccatggggaaccaaaaatagcatgaaattacctggcctactcagggagcttcagtagcaccaagctcaataacactgagctatgatttaaacactcagcatctcagaaggaatttcctgcatgtatgtctgaatggggccacaaaaacacagttctaacagtgtctgcctcctttattagcctgattgattggtactctaatctcatgtaagcccacacatcccttgtacgctcctgcttggtgaagcctttcttcatctaaattgacatcctacttcattcaggctgctataacaaaataccatagactgggtggcttataaacaacagaaatttatttctcataattgtggaagctgggaagtccaagatcaaggaaccagtagattcagtgcctggtgagggccctcttcatagactgttgtcttctcattgtaacctcacatggcagaaaggatgagagaactctttggggtctcttttatgaatgctattcccatttaattcatgactgcctcattctcatgaccatcatcccccaaggccttacctccaaataccatcacagtagagattatgtttcaacatgtgaattttatggggatacaaacattcagcctatagcaatttgtaagaagaaaaattcttcatggtcttcttgtcagactgaggtcactgtggaacttgccagttccagcgaagttgtcctctaggaagtcttttctctagtaaagcctgatggatatatttcaaaggccaagcctaaagtttctgtcatatttgccatacctgtgttaaagacttctagaatgtcagaatcaccaaggctcttagaggactccccctacaaccctgacgattcttgtgtgtatacacatgcacatatgcacatgtacacatactctcacacacttactctcaaacaccttgcaatgatggtgaaagacagagaagcagagagaggtttatttcctaccaaggccacacagcaagtcagtgacaaagctggaacttgaatctagtcccctgattccttgtgtggtattgttttcagtaaggtaccacatattccttcaaccttctgcctctcacagcccaattgctgttctttgtgatatttcagcgacttgctttttgtatgtagtaaagagtttatatttaaataagacagtgagactaccttggggaggtcatccaaatcccagtcaggtggtgggtgagtgctggggagtctccccaagaaagcaatgagacatggatgctccatggcttgatgatggttaggattggtggcccaatttcacaggttccctggtataggttctttgtgcattccacctgcccaagaagttgtctaggcaaggagagacattctgccagattgccgaggactgctgtgaacagaccgtgcaaatcaagaaaaagatgccatattttgctgtctctgccaccccccttgtctcccagatgtttgaacaaacagagtggctgtcaaaagcatctgcatgataatttcagcttcatttgtcaaatgaaaaagaggagtcataggggaaaccttcagagcttaatctcccttgaagaggaatttggagggtagcatgcaggcaattagtgtctgctcaatagatcagagtgtctggctagagagcaggaagccctgcattatatcaaggcctgacccttctcttagcttattccgtgaacattcttggtctctttgcccaactctggttattatccctgccctctaccattctatagggactagagttcctgaagtaactttccttttaccccaccccccagggctcctgaaaatcaaatggatgagtaaaagtgtcagtcatctctctactaatcaatacattagagcagtatgcgggagcagcagggagaataatctgttcccagggactgcagtttctgggaaatttctatttctaatttccatgatgctgaggtttggttgagctgtcactttgccaccttgcacactcatttaatccacttgaaaacaagggaaaggtaacatatcctggatagcttctttttaatctttttttttttctggagatttgtagcaggaacctaacattgtagctcatatttgggagcttgattgtgtgtggttgtaatttcctctttgtgggatccctctcctcccagcctggttgtgtaatacccaaggacctgttccactttgctatttgatgactgaatccaaagaagttggaggaaacaagaaaacccaacatgatgaaggcagcaaaagcatctacttaaaagctaaagtggcttgatgaggcatactcctgggacaagaagatcaaatgtagggctagatggatttgttactcctctgccttcctgtcagtaggcagcattgaaaataaactagttaaaaagtatggcattccccttgtcctttccctggatctgctcagattacagccccacatcaattggcctataattagaatggggtgaaatcaggcagaatggggtgaattagaattagaatggggtgaggcctcttcgctcgggctctgaccccaaggaaggaaggtagataagctggcaagaaagctttgggtagtttttggtggccactgttcattccacacctattgatttagttgtcaaacagtatttattgagtatttaaatatcaagtactctgtgtcagaccttattctaggttctgcaaagacatcagtgaacatgacaaagtttccactctcattgatttatattccagtagggaaaagaggcaacaaacaaacatatatcatcaggtagatgggcctctgaagaaaaataaagtaggataacaggttagggagtaatgtggatactacctgaggaagtaacagttaagaacagacctgaaggagaggaaggagcaaaccatgtggttttcttggggcacagaattccagacagaggggaaaacaaacacgaagaccctgaaatataggagtgtgtgctaaaggaacaacacggaagccagtgttgttactctacccagagtagagtaagtgagtgagagagtgggagcaaatgaagttagggaggtgactggaggtcagatcctgtcttcataagactgactgttagtttgagtgagatgggagccactggagggtttttgagcaaatacgtgaaattatgagacttatgttttgaacatttcccctcatatgccaggccctatgctgggcaatgaggatattgagatcaatgagatgtggccttgaacatctagtgcggacaaacatattccagcagagggaacagtgtgagcaaaatcctggagggagtgaacagatccaaaggcccacggttggggatttttggaaggagttgtacttttgggggcaagacaaagagatgtgttatataagtggagcagaggaagcaagggtgagatctctaaacaatgagagggctgtctcctttccatgaactcatttgacgctctcaaacagccatgtgaagtgggtcaaacaggaactgttttaatattccccctctacaaatgaggaaacagatggcgagagtttaagctagtttctaactcaagagtgagttggtagcagcattggactcagagcccaggtcttttgagattctcaccttagaaatcttccatggcatctggttgttcccctgggttggtgacagtaggaggagattgggtgggggccatcattctaatgtggtttggtggataagagcataggctttggagggcttctgacctaggttctgcccctttgggcaaattacttccaatttctttgaccctggttttggggtaataacaaaacatcacttactgggttgctatattactaggagacaggataggtatggaaactggggcacacagtaatagtcaagaaaataagtatcacttatgttgagcttatagtgtgatgtgtaccttctaggcactttatatgttttaatttaaataatcctcacaacacccaaatgaagttggtactgttattatccccatgttaatgatgaggcaactgagttatagagagactacgtgtgttgctcaaggttagtcagcttggtgagcatagaggagtattattttaattttttttctaattggtggagttacatgttgcaagtaattaaaatataattgatgctgggcaccgtggctaacatctgtaattccagcactttgggaggctgaggtcggtggatcgcttgaggtcaggagtttgagaccagcctggccaacatagcaaaaaatcatctctactaaaaatataaaaattagctgggcatggtgtcacacacatgcctgtaatgccagctacttgggaggctgagacacaagtatcgcttgaggccaggaggcagagtttgcagtgagccgagatcgtgccactatactgcagcctgggcaacagagggagactctgtctcaaaaaagaaaaaaaaaaatgtagaattgagatgcccctggctggtggagtggatggaccagataatactgggtagccctcctggtcgtatcatccacatttagtaaattgtatatttaaaagtcattctgaccatcttcttatggcattggctctcttttatggctttattggacttcatacatattcaaagtggactgtagcacatcttcctagcctgcatcagggtgggaacctctctcagcttcccatccctccagcaggaaatcgctgtactgctccctaacctggtggctttctttcccagtatcaggcctccagaggttctgtgctagtatgtcagcccctctagaaggagtgtttacctagttcctggataatattgaggctaagtcgggagcctaaagttgaagcagtatttctaagctttttttcggcagtggggtggggggttctattattagaaaataattctactgagttccccctttccttcccatcctttagactggggaaaaaaatggtatgctcgaatacaccatttctagatgccccactctctggcctactaccctgcctgatttgtgtttgcctctgattatttctgggaggtataaaggtctccatctctaaccttgccttgaagcttttgggtgaaaggctgagatcttagcatcaaggtatcagccctatcatgaagatcatcctcatactacatctgggaaaactgacacctagagagagaggaaggaacgggttctccaatgcctttttggcctaaagacagtataatatagtacaaggagtgagcatattctatggagccccagaggttggagttgggtcatggacctgtagctaactagttgggcaactttggcttatcacttgatctttttgtacctctaactgtaaaatgggagcaagaatatctacttcccagggctatcgcgagtctcagataagatagattgaaaatatctggcgcactgtctgactcatataggtgctcaggaaatattaattcttctgtgtcttgggacactactctttgtccctatcttcacataggccctggaatactcacccctgtgcccacaacttcggtgttggtttgccttgtgtttcatgagttttgagcatacctgcattcgtctcctccatgaagacataagctccttgaggacaggggccaggtctaccttgacatctgacacacacctgcaacatacttctgacctatcagagttgccataaagaaggagtaggacttggaaactctgtagaattgaattagctaggacttaggtgtcttggtgcctatttgtgtcagactctttgtagcaaggaggataagtagttctaggctttctggataacagaccaaggaatcatgtggcagttaagtttcttattcaatcagtagattttagtgaactgagaggagaaggaaaaacaattataagaggggagtgggttctttttctctccctctgttatcatcttccttcttgtcctcccgtttccttctactcatgtgggaggcagtgagattaaggcctgttcttcaagtattagaaagagactgagggaccagagcagggattgagagactgggacagaaaaagagatttatagagaagagagatggagaaatatatatatgtgtgtgtgtgtgtgtgtgtgtgtgtgtgtgtgtatgtatatatatatgtgtgtatgtgtgtgtgtgtgtatatatatatatataaagaaaatctctctctctctctttctccacacacatatatatgtgtgtatgtagagagagagagagagagagagaggcagacacagagagagacagacagacagagaacttataggaccagagggtaactggtgtagaaaagctgtagcagtcccgggtggcagggcacatttggccttggggtgaataagaaaatgggtcttcctagctcacagagctgtaaagctttttgaggagtcccaggagtccctctctccctctgtctctaccaggccctttctggcctcttcctatcccagtctatgcccagccttgggtgcctccaggcaggtgatggtgccatccttctgcctggctgcctctcatcatcacatgtccttcccagggcgaggacatcctagacaggagctcggagctgatctacactggggagatggcctggatctaccagccctacggccgcaaccagcagcgggtcttcttcctgtttgaccaccagatggtcctctgcaagaaggtaaccctgcccccttcttccctgagggagatgggtacctaacagggtaccggaccctcctcttcatcatccccaggctcccaacaaagtgggcaaatactgatggggggaaaacagacaggagattggcagcaattctgtatcaggaacactaatgtggcatgaatgtcacaggcagggttggcttgtgggcagtgaaaaactctgaagtcggtgcattttgtcttggtattttttttaccctttgccctaatgaccctggggtgctccttctcactttcttctacccagagctgctggtctgcaccatttgtaaaaaatattgaaatatgtctatcttagttggtaaatagtagtttccctgagcactttccctcatttccactctaatggctctggccatgtggcccctctctgccctgggaaccaacgaggagcctcctacttttgccctgacaggtaggtacctttgtgatataggaattttttccatgcctctacctatttcctatacaaggtgcactggttccccacaacccccaaccgtgctcttctccactcttccttctttgtaatccattagaggagaggtcttactcttgtcactgactctggataactctgtgtatgttggtttctaggactcttctcctttgtgaggctgggaagggtagcatatgttctaagcgtcactcctccttatgggatactcttacccctacttcctcactcacagtagagagttcagaccagttttggctccaggggctaactgggaagaattggggaccaaggaaagtaaaaatggaagaagaaaccagaatgcttagagtgactttacaaattcaccatgctaccctttgctcttttgccatcatctagtccctttgtcctctccttcacccagtagtgaatgcctctgaagaggagtgctgagtcacaaaacaccagagtaaatagtgttacatttttctgggctggaacatgaaccacacagttttaagccccctgtcctctgtgtgtgtatgtgtgtgccatatcttgtattgaatctttatccatttgctttgacagtggattgaggggaaaaacactgagcttaggttcagactgcctcagtgtttggtgataagctctgaatgtccactctagaaccaatagccagtcagttaatggggataataacttacctcagtatggagctaaccctcaaacagagaacttttatgaatctgaaactcagccaaacactaatgcttctttttagctcccccaactcttctcaggactttcataaaatcaggaggtaggatttttgagggttaatttaggtggccatggaaattctcagcatatcagccatgtcaccaacactaatgtgcctgttcttcccactaaggtgtttacactcagaacaagtagccatagaggcagtaaacaaataggaacctggcttattttatagttctgcaccccctaggccctgttaattttggcatctgttagccaaggctgggattactttaactaaattgtgaaactaggctctagaaagcagtggctataagagatagaccaggatccagaacataaaacagtgagtcagaagccaggaataaaggggaagaaacaagataaacaatgggtttaacttagaactcaacgggcagtggaagaccaagatggagtaatgagccatgtctaagccagatagtgggagccaatgattaggaagaaactagaagtcaagccagggctggggattcaaaccagctaagctggcagggtaggggaagcatataacagggatggtgaaaacaagagaaacctcgaagcagtcatagcttcccacagaagggagctttcttgttttcacaagaaccataggctttcttcccaagacacagccagcctagagtctggagtataaaggctaccaactccatatacctgggtgttcttgacactggcttcccagaacacgagcagttatagcctaattgttcaaaggccattaaaactacctgatgtttgttttgaagatttccatttgttatctacaataagactttccattcaacaagtagggataaacttttgaaaaatgatcatgggaccaaaagaaggtatgcagagagacaaggtattttgtctgctgggttgtttagggaccttttgccattactacaaaagactctcttcttgagatagagctgggaggaatggactaggctctctggaggtgaaaattcctttgacaaagagaatccatggaggaaaggaagggaatgtctggattgggccaaggtgagtgaggctgtcaccttgttcacctcaggcacacaatttaattggatgtccgaaagttcagtaatcctttttaccaggaagaaaggaggtgaggatgctaaataatgaaatatggccacattaagctttctgatgatctcatatttaaaaaggaggaaacaaagacccctaggaagtggctaaataatatataatattttacatatgatataatatttaacaggggtgacaaaagagtttcatgaatcctagaatgagtcaaaattagtttttaaaaatgcttaattttaattacttttaaagctatgttcaaatgaagaaaaaagaagtgatagtctgacaaccccctgtttgaggcagatggtttactgataacaggggaatataaattccttctctatcaaggaaaagaagtcataaacttgtttcaaagggaattgaagcccaaaggatctgaggttgtaagagagtactttactgctctgaattctttcatgctatagatattgagcccctcttctgtgccaaccagctctactttcataaggattctagtctaacagaacttaagtatgatgttatttaaaaatatatacatcccagagcactgaaataattctatgatgtcccaagtggaattgctctaggtcatcttgacagaattatgggttccaggagatctgtgagaagactacacataggaaaatgtaccagttttcaaagcagaaaataatatgttctagaaagtagaaatcaacaataaagtattaatgaactagcatttattgagtgcttctatgattctgttctaagaactttacacttattaactcaatttaatcctcacaacaaacctatgaggtaggtactattattatattatttccatgttaaggatatgtaaagtgagacctagataagttatataattttcccaaggtgaaatagctaatgagtgatagagccaggaattacattcagatacgctggctccagattccacattggtaatatttatgtcattattaccattgagcttgtcaaaattctgtacttgattattaaacagcctgtgaacatttagaaagagatacagtggccacaggggtcatctttggctttctgagaacaagtcatatcctataaaactcagtttctattttgccagtaacttaattagttaataggaggattgcacaggacagagagtgtcctcctgcatttcagattttcccatggtttccttgcagacagaagtcatatggagtgatagataaaacataaagtttgtaatcagacaattctgggctcaaatcctgatttcaacactcgctaactatatgatttcaagcaagtgactttttccttcttgtacctccattatatcagttgtgaatggtgagaataactattctacaggattgtcatgaagattaaatggaatcaatgcatataaaatgcctgatagagtgcctggtactcattaatctcatcttacccaacctccaacaaagaaatagacagccttataaagtagtgaggtccccatcactagatgtacccaaatatgggctagattattatgtgccaaagatagtatagtaaacattgaaacactgatctctctccatgagcatgtggcctcaccactaagttctcatccaactgttaagattcccttaattcccagtcaattatgcaacaatgtgcctgttttgtacattgggaattgggattgactaatccactcagaacagcttaaacaacttatgcagcttgtagcttgtttcagagagagagagagagagagagagagaaaaggagagcaagagagtacgtgggcatgtgtgaaggtacctttaaaatggcaattatagtgtgtgggaaagtcaccagtggcttctaattatgtgaccccttctttaatttttgctgtcaccactcttttaacttttcttccaaaaaatccagataagactctgttctttttcttcgtattatctatactgtcagtctctgctcctctgtgtttcattgaatttttattttagtttttgatgtgttttattattttcttcgtgatataattatttgggaaattattttgatgctttgaggggatttttttctctttgactatttactgtggaaaggagcagatccgcttttcctgcaccctctgtcctattgtgccagtctggccatgttctgttgtcccttgtgtcataactgttctttattcctgttgctttcaccatattcaaggggatcagaactaaacaacgtgtaatgatgttgggcagaagacttctgttcagggaagtttctgcatttggacaatttcttcttgcactgaagggtcagacttggaggatgagctatttgggacagcttataaatccaataatagcaacagagatggggctggagcagaaagaagaaggggatttgaaaccagaactcctgagtacttaactttactctgtctcttaactaacttttctaaccattggccagttctttaactttgtccttattttcctcagtgtcaaatcaggctgatgatagaagtcatctcaagaggctttgggagagaaccacctgaggtagtggggaacagtggagtatggggttaagagcatgggtgctagggccagactagaaggcaatctcctttcgcccatgagctatatgaccttgggcaaactttctgtgcttataattatgcccttgtttgcaaaatgagaatgacagtgtatctacaaggaagggaagttgtgagggttaaatgagacaatgcagatgtagtacctggcacatagtaggtacttagtgaatgttggctattaatactattactatatatgcagtgttactaataattcattcagtacttttttatttagaggcaatatagcacattgtaaacaaaagcagagattttagagctggacagcctgaacccaaagccaagctctgccatttagtagcttttattcctggaaaaatttctgttttttcttccaatttttattttagctttagggggtgcatattcaaatttgttacgtaggtaaattgcatgttgccgggttttggtacacaaatgatttcatcacgcaggtaatgaacatagtaccaataggtggttttttattcccaccctcctcccaccttccaccctcaagtaaaccccagtgtctgttgtttccttctttgtgtccctgtgtactcaatatttagctccctcttgtaagcgagaacatgcggtatttggttttctgttcctgtgttaatttgcttaggataatggcctccagttccatccatgttgttgcaaaaggcatgatttcatttattttgatggctttgtggcattttatggtgtatatgtaccacattttctttatccagtctatcattgatcatcatttaggctgactccgtgtatttgctactgtgaaaagtgctgcagtgaacatacgcgtgcatgtgtctttgtggtagaacgatttatattcctttgggtacatacccgataatgggattgctgggtcaaaaggtagttcttttttaagttatttaagaaatatccaaactgctttctatcatggctgtactaatttacattcccaccagcagtgtataagcattctattcctgagaaagcttcttagctgctctatgtctatagttcctcatcagatggggttataacagtacctacattggaggattatttaggttaataaatgcagagcatttaggacagtacatggtacataatatatgctatttaaggggtcactgttgctattattgttgttcttattattttgatgtaattattaagcatgcattctaggatgctggaatatagtagtgagcgaaataaatccagtccaaaccccatgtaccttccctaggatctggagagaaaaggctagagaagagtaactagggtcccctctataaaggggcagggaggaccttatttacaaacaagtgaagcaggctacaatcctgaacagttacattccccagattgcagcatctgtcatttgtagagaatatcctgcaatgtcttactaaggaggaactagctcccttaatgtctcccaattcagacgagcacaaggaaaaaggaggaaggctggcattttattggaaatgataaacttcattaggcaggaaagttgtgatgatccaaatagcatctgttttgagcacctgctcaccgtgtccctgtgaaggcactcagactaccattaacaagtggcatatgggcagcctggttccaacaagaccacaggcaaccagggttcaagaggactttgtccccttgccatgtgcagaggacaaccagaggaaactctggggctttgtcagctgctcttctctggacaatccctaagtgaagcaagaccaaagaagatagagtgctgggcacagcctttaatgggcaggcaaactaaaagctgtgagcagcatggtggctaagtgccaagtgtgtggtatgtcagggccttcacaattggtgtcagaatttggagaaggggagccacatcagcttgagcagtcagagaaagtttatttcaggaataagaatgtgtaagtttgacctcgaaggctaagattggaataggaagcatagttgggccagagagcagctattagtgtgaccccaaatatatatctgttattttggtgacaaataccaccctgtcctgaaaggatgtatagaatttccagggacagtggggcagctatgtaaattgaaaaaatattcagagttacccttgctttgacttatttttactcacaatatttaaattatttggaaagtttaaatgagctaaaggaggtagtgagatgtttttcctttaagtttatcaaaagagggttttaaggactatgaaacactggcccaggagcaagaaagctcagggctgtatttggtggacaagtctggcctcatgtcctggaaatgacatgtttatattagagctttatagctattttacagagtaaggataactgtcttcatttcttagttgaggaaattggggctcagagaggttaactggcttgtccgtaaccatacagctggtaggttaggcagcaaggcatcaaactcagggcttcagactctacatcatgctctttcttttgttccatgctgcttactgcttatagtcttagctactctttctgattggagttcctcaactagtaggtcattcttaattattcctatcacatctttacatttggcttatgacaaatctagcgcctgaaaactcacatttaaccctctgggggaccagggagaacaggcaaagggataattttagtaacacatctctctagccctgtttccccaccacagaagcagaaattctctctagcttcttgtcatccttacatatctaaagaaacaataggagattcaattgatgcttttaatgtagctccaagatcatgcatattctttctatttttgggaactagcaaatgtgttgaaagctctcaatgactatgacacaccaactcggaatgggggcggagcggaaggaggctgcggactgaagttagcaacaaggaagttgaggctgcctgttttaggcaatgtggtccggtgagaatgtgtggttcagatctggctttccaggtttgtatgtattatattatgtatggtaaggcacaattcaaacctttctgagatcgagataaattacattcatacattctgcctagcttatcctgcttttgtacttagattagcctgatagggcccactttttatacatgtgtctcaaaaagtgttcctgagaattgtggaactcagtgtatgggaatcactctatccttttggccaggattgagcttgtgcacactgaacatggtaaaaggaacccaggttctgaaataggcttggggcaacattggccctctctgtatagctgaactcttcctctcctgtgaacttgatcctggggacaaccaatagatcagaatccatctatattcttttcttatttatatgaacaatcattatgggaggaaaaaagtaacatgattgttattttttcaaaagcaattcaacgacatctgtattttccagcctgggcctttgaggttgacagagctatgctgggaaaccttgctatgctgggaatcctgcaaggtagcctttcccagcccaactgaaaatctcagtataccgcacaatgtgaagagttaggattgggaatgtgagtgggcaaaagaagatccttcatagggagcacacagctgagaagtgagtcaagttaggcaattcagtagaatggaaatggtttaattgaactgtaaaatgctaataaaaattaatgagcatttctgactctgtccagctgactgaaagagcagataaagcagagaggagggagagctggcccgaagatatctgtcaggacaggactcataggggccttcctcaacctgactcagccataccacatctcccagcagtggatgtgttctcagaggaggctgagggcagcgccaagaggaggaggggctgaaaggccactccaagatatttataagatctgacattccataggcctatatgtcatttcttccatccctctattttcctttttaacttatgaaatatttgacattcaaaaagatataaaaataatataatgagtacccacgtgtttactatccgcattaagaaataattcattacaaatagttttccttcccaccctctcttctgcttctttttcttccccttcctctcttgcccctccccgttttctgctctgtactgtctggaacgtggcatatatcattgtcacttatttctttataattttctacatacatatgtatctttaaacattatgtggcatttttttgtatgtttttcaaggtaacagatacagatgaggtaaaactatatagaaaggaaaccatggaaatgatgaacataggatttaggatggaggatgccttggagttgtaactttgggattggtggcagattcaccagtactttatattattaaaataagtaagtaaatgaataaatagagaaataaaaatgccatgcatggaccaattatgagtgtctcatggactagggttaggattaatccaattttgtgtctatgagagcaaaacaacaataacaaataggcgacatactgtttgtatccatctacaacttctgtttttctccataagatttgtgacattcatctgtgttgatatgtgaacttctttatttaattttacctccatttctcttggcagactgggccttttctaaaaatccccagagtgctaagtgttagaccccccctaggtaatcctttgccagcagtctgtggcctcctagctactcttactactcagtccccctctgatgttcaggtctcactggcctgcacagatatttgaacacactccaggcaaccagccagctcatttcatacctctagtgggcttgctgatgttttcgaaaaggagaagcccttgctagccgtgtttatgtggcttactgtttcctacctcccatcagcagacttgcacacacgtccaaggattgattctggtgtctgaaatgatctttcgaggtgagacagaggctttttctttgggcatctagttaaccaacctgtcagtgtcagactactagtataacctggccaaatttagaacaaaccaacccccattggtacttcaaaacggtgacagtgttagcattctgctgtgcccctgtgccaactcttctagtactcgccgtgcacataccttcaagaaacctcttccttcccatctaggacctaatccggagagacatcctgtactacaaaggccgcattgacatggataaatatgaggtagttgacattgaggatggcagagatgatgacttcaatgtcagcatgaagaatgcctttaagcttcacaacaaggagactgaggagatacatctgttctttgccaagaagctggaggaaaaaatacgctggctcagggctttcagagaagagaggaaaatggtacaggaagatgaaaaaattggtaagtgacctgagagtagaaagaagaacatggctatgaagaacataggaggtttgaattggtttccattttcttggagtcagagggaagatttctgttgcaaactgacttaagctactttggtggttccttattattaggttctttttggtaagtaccaatagcttccattagtcagtggtaggtttgaactataggttgtcctcccctactagctaagaatatcacactgaaagccagcctcaggcttgattctcccaaacatacatttattagcaaataaacaaaaatcagttatacaacctgttctgtaatcttcataaagcctgagctctctgtcattaggtatatagtttgtactcctgattaggatacttcagatgttaactaaatccccctagactgtagattcaaataatatgcacatacacttcacactttctgtgtggaagtatttaaagtaaattatagaaaatataacaggacttaaaaccatgaccattttcatgatttcaaatcacactgaaacatacttttttgccttacaataagttgtttctcttttccagtggggatatagatagtagagatatttttcatgttgcttcccaactgtgggatttagacgccattggctatagctttgtgacttataaagtactgtctggtctcttgctcatggtcctgcctttctgtcataaaaaataccaagcaaccagacttgttaattccctgagaagacatacagtttctgtctttgccctattgcttatgggagtgaaattgtactttagaaggcctgaaagctcaagtttatggaaattgtctctagaaaaatgggcctactcattgaatcctggtgcaaaagggttctcttatccttccatgtgggcgattgaaattatccagaggtaagaaaggatggtcagaaagacaaatctaactccagtcttctcctcagaacttgggtagagtgcaaattaataactcactttgagtctcattggaatcagactgctttcagtatgtggacactccattgggacatgatgtggagtggcatataaatgttgctggctacttctctcaatagcaagcagcagcagccactgaccttgcctaggctgttagagttattaaaggaatggtcttagtgttcagaccctgaatcaattagaaggcccctgccattcccattggctctaacacaatgtctcccacacaatgccctaataaacctgtgactttatctgcttctaatagaaaagcttctagaaattactttctgaacaggcatatgttcatctttaaaaatgttgaggttttttttttttggtttgataataacagtaaatcacttccattgtaggaaatttagggaaaaagcaacagaaaagtacaagaaaaaaaaaaaacacatgaacatactcagtaataactttcataaacattttgatatatatttccagccttttttatgtgtctaattagaaaaatcaaggtgactgaatcttttttctttctctccccatacctgcctctctatagtggatagatataattttgtatcctcattttcactcatcattatatcattagcatttctatcagatcacttcatatttttaatcattattttatgagggtcatatagttttatcatagcttttttaaacttttactttttaattataaaattaatgcatgaccattataaccatttaaacaaatatggaaatatataaagaaaacttagcattccttccccttctctgtcacttccatactgaatgaaataaccagtgttaacagtgcagtatgcatctttccatacttatctcatgtccatataaacatatacaaacataatacttttatatttacaaaaattatattatatatattaccttgtaggttgcttttttaaacttaatttatcataagtaactccccagataaataatatagaatctaactataaccccttgtatcagttagggttcaaccaaagaggcataacctgtaggagatatatcataccactgctgaaaattgcattacaaggaattggcttatgtgattgtgaatgttgactaagtggctcagaattccatagagcaggcagtcagaaatggaggatcacaggcaggctcaaacccatggacataggccaaagctgtcatctacaggcagtcaggaagagaagctcatgagaaggatgaagtggcacagacatgggctaaagctgtggtgcacaggtagaatttctgccctttctgtgtgagacctaggctctacttttaaggtcttgcaacagattcagtcaggtccatccagattatctaggatattgtcccttatataaagtcaactgattagggcctgtattagcccatgttcacagtgctataaatacctgagactgggtaatttatgaagaaaagaggtttaattgactcacagttctgcaggcttaacaggaagcatcactgggaggcctcaggaaatttagaatcatagtagaaggcaaaggggaagcaagcatcttcttcacatagtggcaggagagagagagagcaagagggaagtgccacatacttttaaaccatcagatctcgtgagaactcacccactatcatgagaacagcatgggagaaattccccccatgatccaatcacctcccactaggcccctcccccaacacatggggattaccattccacatgagatttgggtggggacacagagccaaaccgtatcaggggctttgattatatctgtaaaataccttcatggcaacacctacattagtgaggactacagtctagtcgaatgggcacatcaataaattcatcacacttttcttataaacagctgtataacattccataatattatgtaataaccacagtcatctcttggtatgcacgggatattggttccaggactcccgtgcatatcaaaatccatggatgctcaaatcccttatataaaatgatatagtatttacatataacctatgtacatcctccatatactttcaatcatttctagattatttataatacctaacacaatgtaaatgctatgtaaataattgttatactgtattgtttagggaataaaaacaaggcaaaaatccatatgtgttcagtaaagaagcaaccagccgcttttttctgcatatttttgatccacagttgattgaatccagatgtggaacccatggttacagagggctgactgttcgttttttgctagacattcattttatatttagctttatttcccactacagatattgctgcaataaatatccatgtacgtatctgattgttacttactgatgcttttattcctgtaggatctgtaccctaaagtggaatgactgaatgttaggatgtgaacagttttaatacatacttgcatattaaattctgaaagatttgtagaatctatactcctagcataattttatgagtacccacttccgcatagcctcaccagcactggatagtatctatttgtttcagtttgccatttctcaactagtaaattgaaaaaaagtgttggaaccttttttttttcatatgcttaatggctattttcatttcttttgtgaattgcctcataccctttactcattcttttaacataaatttggaaggactctatattgttgatgtgacactttgtcagtcacgaatttcacgttttcaccagtctgttttttgtcttttgagtttgtttatattgcctacttctataaatatttaaatttttactttgaaaaatgtatctattattccttttttggcccctagtttcatcttgcttaagatctcttgccatccaaactataaaatttcctgattaaaaatatatttttggtttatttttagaacagtaatccatccggaatttacatttttatatgatgtgagaaaggggacctcatttttttcttcaaggtggatagtcagttgcatctgcatcatttattaaataaatcatttattttccacacagtttaaatgccatttttcatatatagtaactctgcatatatacttagatgtgtttttaaactttctattctgttccactcttctgtttgtcatttcttgtatcaagactatgctgtttcaattacagtagattttgagaaagatttaatgcctggtacaatcaattcttattcactcttatcattgcttcttagcagttcttagatgtttattctttgatatgaatatcaaatttatttattctaggtttaaaaacactgccgtaaaaactggcatagaaagcccatttggattctgattggcattatattaaattttttaatatgtaacggcttggcattgttattaagttttcacatttaagacaaggctctgctctcctttcatcaaaatcttgttctgtatgcttcaggaaaatggtagagttttctttagattctgtacatttctgcctctttgtacattacttttgataatttctatttttctgggaaattgttcatttcctctggatttttaatttaatgctatatatctacacataatattttctaattatcatatcttccataattgtagttatctctcttcttttgggttcataatatttcatatatttttattttctcactttaatcttttaatcaggcttatcagggagtattgatcttttttatgtatatataatcattatacatatttttaaggtacatgtgatattttgatacctgtatacaatgtgtaatgatcaaatcagggtaattgcgatattcatcacctcaaatgctcatcttttctttgtgttgggaacattccaaatattttttttagctattttgagatatacaataaattattattaactctaatttccctactgtcctatcacaaactaaatcttattccttctaactgtgtttttgtacctattaaccagcccctctccattgacctgagcctttctttctgagccactgataatcaccattctactctctatctttatgaaatccacctttcagctcccatgtatgagggaaaataatcttatttcacttaacataatatcctccagttccatccatgtttctgcagatgacaggatttcatttttttatggctgaataatataacatcgtgtatatatgccacatttcctttatacattaatccactgatgggcatttaggttgatttcatattttggttattgtgaataatgctgtgataaacatgagagcatagatatttcctcggtatattgatatcctttcttttggatacatacccagcagtggcattgctggattatatagtagttctatttttaatttttttaggaacttttctactgtttttctataatggctgtactaatttacatttggtcgtttcaaagaacgtgtttttggtttgtttatcccttctgcagtttatttctgtttcttcttaattttcacttttatttccttctttttcctactttcaggatttaaggaatattttagatcctttccactctttcattgactgaatacttactttgtttattttgatttttacaaaatcagaaaatcattttagacatgggagggtgtatgtgtcgaggaatttgtccatttcttctagattttctagtttatttgcgtagaggtgtttatagtattctctgatggtagtttgtatttctgtgggatcagtggtgatatcccctttatcattttttattgtgtctatttgattcttctctcttttcttctttattagtcttgctagtggtctatcaattttgttgttcttttcaaaaaaccagctcctggattcattgattttttgaagggttttttgtgtctctatttccttcagttctgctctgatcttagttatttcttgcattctgctaccttttgaatgtatttgctcttgcttctctagttcttttaattgtgatgttagggtgtcaatttaagatctttcctgctttctcttgtgggcatttagtgctataaatttccctctacacactgctttgaatgtgtcccagagattctggtatgttgtgtctttgttctcattggtttcaaagaacatctttatttctgccttcatttcgttatgtacccagtagtcattcaggagcaggttgttcagtttccatgtagttgagcggttttgagtgagtttcttaatcctgagttctagtttgatttcactgtggtctgagagacagtttgttataatttctgttcttttacatttgctgaggagtgctttactatgtggtcaattttggaataggtgtggtgctgagaagaatgtatattctgttgatttggggtggagagttctgtagatgtctattaggtctgcttggtgcagagctgagttcaattcctggatatccttgttaactttttgtctcgttgatctgtctaatgttgacagtggggtgttaaagtctcccattattattgtgtgggagtctaagtctctttgtagatctctaaggacttgttttatgaatctgggtactcctgtattgggtgcatatatatttaggagagttagctcttcttgttgaattgatgcccttaccattatgtaatggccttctttgtctcttttgatctttgttggtttaaagtctgttttaaccaagactaggattgcaacccctgcctttttttgttttccatttgcttggtagatcttcctccatccctttattttgagcctatgtgtgtctctgcatgtgagatgggtttcctgaatacagcacactgatgggtcttgactctttatccaatgtgccagtctgtgtcttttagttggagcatttagccaatttacatttaaggttagtattgttatgtgtgaatctgatcctgtcattatgatcttagctggttattttgctcgttagttgatgcagtttcttcctagcctcgatggtctttacaatttggcgtgcttttgcagtggctggtacaggttgttcctttctgtgtttagtgcttccttcaggagctcttttagggcaggcctgctggtgacaaaatctctcagcatttgcttgtctgtaaaggattttatttctccttcacttatgaagcttagtttggctggatatgaaattctgggttgaaaattattttctttaagaatgttcaatattgacccccactctcttctggcttgtagagtttctgccgagagatccgctgttagtctgatgggcttccttttgtgggtgacccgacctttctctctggttgcccttaacattttttccttcatttcaactttggtgaatctgacaattatgtgtcttggagttgctcttttcgaggaatatctttgtggtgttctctgtatttcctgaatttgaatgttgacctgccttgctagattggggaagttctcctggatactatcctgcagagtgttttccaacttggttccgttctccctgtcactttcaggtacaccaatcagacatagatttggtcttttcacatagtcccatatttcttggaggctttgttcgtttacaggctctaaaattgaggcaataattaatagcctactaaccaaaaaaagtccaggaccagacggattcacagccaaattctaccagaggtacaaggaggagctggtaccattccttctgaaactattccaatcaatagaaaaagagggaatcctccctaactcattttatgaggcaagcatcatcctgataccaaagcctggcagagacaccacaaaaaaagagaattttagaccaatatccctgatgaacattgatgcaaaaatcctcaataaaatactggcaaaccgaatccagcagcacatcaaaaagcttatccaccatgatcaagtgggcttcatccctgggttgcaaggctggttcaacatatgcaaatcaataaatgtaatccagcatataaacagaaccaatgacaaaaaccacatgattatctcaatagatgcagaaaaggcctttgacaaaattcaacaacccttcatgctaaaaactctcaataaattacatactgatgggacgtatttcaaaataataagagctgtctatgacaaacccacagccgatatcataccgaatgggcaaaaactggaagcattccctttgaaaactggcacaagacagggatgccctctgtcaccattcctattcaacatagtgttggaagttctggccagggcaatcaggcaggggaaggaaataaagggtattcaattaggaaaagaggaagtcaaattgtccctgtttgcagatgacatgattatatatctagaaaaccccatcgtctcaggccaaaatctccttaaactgataagcaacttcagcaaagtctcaggatacaaaatcaatgtgcaaaaatcacaagcattcttatacaccaataatagacaaacagagagccaaatcatgagtgaactcccattcacaattgcttcaaagagaataaaatacctaggaatccaacttacaagggacgtgaaggaactcttcaaggacaactacaaaccactgctcaatgaaataaaagaggatacaaacaagtggaagaacattccatgctcatgggtaggaagaatcaatattgtgaaaatggccatactgcccaaggtaatttatagattcaatgccatccccatcaagctaccaatgactttcttcacataattggaaaaaactactttaaagttcatatggaaccaaaaaagagcccgcattgccaagtcaatcctaagccaaaagaacaaagctggagctatcacgctacctgacttcaaactatactacaaggctacagtaaccaaaacagcatgatagtggtaccaaaacagagatataaaccaatggaacagaacagagccctcagaaataatgatgcatatctacaaccatctgatctttgacaaacctgagaaaaacaagcaatggggaaacaattccctatttaataaatggtgctgggaaaactggctagccatatggagaaagctgaaactggatcccttccttacaccttatacaaaaattaattcaagatggattaaagacttaaatgttagacctaaaaccataaaaaccccagaagaaaacctaggcagtatcattcgggacatacgcatgggcaaggacttcatgtctaaaacactaaaagcaatggcaacaaaagccaaaattgacaaatgagatctaatgaaactaaagagcttctgcacagcaaaagaaactaccatcagagtgaacaggcaacctacagaatgggagaaaatttttgcaatctactcatctgacaaaggcctaatatccagaatctacaatgaactcaaacaaatttacaagaaaaaaacaaacaaccccatcaacaagtgggtgaaggatatgaacagacacttctcaaaagaagacatttatgcagccaaaagacacatgaaaaaatgctcatcatcactggccatcagagaaatgcagatcaaaacgacaatgaggtaccatctcactccagttggaatggcgatcattaaaaagtcaggaaacaacaggtggtggagaggatgtggagaaataggaacacttttacactgttggtgggactgtaaactagttcaaccattgtggaagtcagtgtggtgattcctcagggatctagaactagaaatcccatttgacccagccatcccattactgggtatatacccaaagggttataaatcatgctactataaagacacatgcacacgtatgtttattgcggcactattcacaatagcaaagacttggaaccaacccaaatgtccaacaatgatagactggattaagaaaatgtggcacatatgcaccatggaatactatgcagccataagaaacgatgagttcatgtcctttgtaggaacatggatgaagctggaaaccatcattctcagcaaactatctcaaggacaaaaaaccaaacgccgcacgttctcgctcataggtaggaattgaacaatgagaacacatggacacaggaaggggaacatcacacactggggcctgttgtggggttgggggaatggagagggaaagcattaggagatatacctaatgttaaatgacgagttaatgggtgcagcacaccaacatggcacatgtatacatatgtaacaaacctgtacattgtgcacatgtgccctaaaacttaaagtatattaaaaaaagtgaaaaaaaaatcattttagagtatattttcctttgaataaagtctcaactgtatctcagaggttttaatataaaatttcctttttatttatttttagatattttataacttcagttatggtttccttttgatccagggtttattcagaagactattacactgggtacagtggctcattcctgtaatcctagcattttgggaggctgaggtgggaggatcgtttgagcccaggaattcaacaccagcctggtaaacacagggagacctcgtgtctacaaaaaataacaattaaaaaacaattagccaggtgtggtggcatgagcctgtggccccagatactcaggaggctaaggttggaggattgcttaagcttgagagatcaaggctgcagtgagccatgatcatgatcatgccactacactccagcctgagtgacaaagcaaaaccttgcctccaaaaaaaaaaaaaataataataataatagaaggcgattccttccaatatttcagattaggattctagtaatattatgatgtctgttttttgttaagtgagctgtcctttctgttgtgaagcttgtcagattttttttttatcctgaagtttgggaattatactagtcaatatgtagatgtgcatctatgtatgctcatcctgcctgggacttagcaagaccttttattctttccacagtaagtatatcctttttttccccttaaccgagtgttttgttacttatttgttactattttccatttgattttttcctccttcttaaacttttataatctatatatacatttgctgtttgaattatcttttgcctcattatgtccttttctttataattttgcttttggttacaaaatattttttccctatgtcatgctttatttaacgattctccattaacagactcttagcccatgttcataattctttttttggctctctattctgtgttgtgcattttgtagctaagtttttgttcaagtttgtgacaaatttccttagtgaaattcctagaaattactgggttaaagggaatgattttttttttttttgtatttcaagattttttatatgtcttagcaaatctttcttacagaaaagtttactcatttatacactcagtaagggtgtgtgtttctcatttaaaaaatcatatatttttcttttttaggctttgaaatttctgaaaaccagaagaggcaggctgcaatgactgtgagaaaagtccctaagcaaaaaggtaaagctgccccactcagtctctgtgaaagactatggaatcataagctatatgcttacatattcttaggcccatttctgtgctgaggtttacttgggggtggtggaggagtatccaggtccctaggtgtccttgatgacaggtagcaaatggttttaaatgcttaaggctaaggagtgaatagtatagggtattggtatccaaagatagctcattgagtatagcaaaaaatataacctctgttcctcttttttttttttttacttaaaaataagggaaactttactaacaatttatagatcaatggacaacatgatctttatttaataagtatagtttgggcatgatggctcacgcctgtaatcccagcactttgggaggccgaggcaggcggatcacaaggtcaggagattgagaccagcctggccaacttggtgaaaccccgcctctactaaaaatacaaaaatcagctgagtgcctgtagtcccagctactggggagattgaggcaggagaatcgcttgaacctgggaggcggaggttgcagtgagccgagattgtgccactgcactccagtctggcaacagagtgagactacatctcaaaaaaaaaaaaaaaaagtataaagatattgctcagctttctgtcaccggtctggaggcatgtgccaaatcaggagacccaaatcacaataaagaatctcaaactaagccaagacaaaagattcagatattctctttctcttaactacaagccaaagtacttaagaaaaaataccttgcaaatcaatttaaatctgaagttaagctttagtttctcttttctcatgaaccagaacaaaactatcatgctcagccaaacaaagggaaggaactaccttctgcttattggaatacctattcagtgtcagtcactttatatgttatttcatttcatctttatggtaatcctgagaagctggacactattaactctatttctcagatgaggtagctgagggtctttgagtgaagtaactgaacttaatttgacttgactcagagtccactgctttctcctctccatctcagggtcctgatgaagccccatgcttggaaagaagagtttggttttctgtcttgcctcaattactgacagctgcttctattactgatagccatgttcactgtccccaggtgtgggcaatcttaatgagaccttactttccccaggcctttccttctgctttctcagtgggctttgtggttctgaatgagtcaccatccaaaatgatcagattcaagtctcctgaaatttccagcagccatgtaaagcactattttttttccattgaagcttcttttgattgaggctgaatgcctgtgaacatctgatttccagttaagcagtgcacctagctccgctgactagacatgcctccccttcaactgcttattacttcttgctcttgggaggcccttattgtctcttttcctcatcatgcgaatgtgattccccttatatagggaatgaggccagccttaattagccaccaaaaagttgggagttaatttaaggtggggaattaactcctaaccttttgattgctataataacatgtgagagatggtgttagaaagcaatctggagttaatgtcagtaaggatatgacctgtattaacagaacttggtaagattttgctccagttcctcagacagaaatgtgagcagaaaagagcccagccaactgaagttttcaggctgcaaaagggatactgtcctaacagcttgtctcctggacgctctcaactcctgaactttctcactctgatttcctctacttcccccactgtattcttcagcgttctctagagggacagaactaataggagacatatatatatatatgagtttatatgagtttattaaggagtattaactcacacaatcgccaggtcccacaataggccatctgcaagctgaggagcaaggaagtcagtccgagtctcaaagctgaagaatttggagtctgatgtttgagggcaggaagcatccagcatggaagaaaggtgtaggcttggaggctaagccagtctagtgtttctaggttcttctgcctgctttttattctggccatgctggcagctgtttaaatggtgcccatccagattgagcatgggtctgcctctcccagtccactgactcaaatgttaatctctagcaacaccctcacagacacacccagcaacaatactttgcatccttcaatccagtcaagttgacactattaaccatcacatccaccatactgacctttatggtactcctttatccaagcctgggttcctcaagcatatctgagactgaattgtcttttcactgagaacacttcaaacaaaggaatatctataaagcaaccaggagttggttaaccagaagatagccctgctaactcatgccaagcattttggtcaaggtccttccccaccctatgtatctccaggccattccttttagggcctttcttgtctcccagtgtctaaatactgattcacttgaacagttttctttctttaacagcaattctaaagtcttcaaagaaattcatttagtttctgtctttctttctttttttttttttttttccctgagatggagtttcactctcatcgtgcaggctggagtgcaatggtgtgatcttagctcactgcaacctctgcctcctggtttcaagcgattctcctgcctcaccctcccgagtagctgggattacaggcacctgccaccacacccgactaatgtttgtatttttagtagagacggggtttcaccatgttggccaggctgatcttgaactcctgacctcaggtgatcccctcgcctcgtcctcccaaagttctgggattacagatgtgagccactgcgcccagcttcatttagtttcaaacctcccaggattactacaaatctcctcccttatttctatttttggtcttcaagactcctagtccagggctgtagtaactgatatgttttgagactcaagagtgccatacatgtggaagtggttctcaaatgtaggaattcagtagttacaatatgtacatgggaagagcaagaagggattatttaagataaccatgaaagctggcttccttgagcttttcaatgacccatcacaggaagtgaggggcattgttaagaggtctccaatgcggatgtcattagataggtaactactctaatgtccctttccaacaccatctgtaacactgggacattatcaactcagtctactgctctgggagagggggaacctggctgaaataacagtagagaataccagatctagctccaagaaaggccttttcacttgacctttgtctttcacgctgctttcattttaagtattgatatataacttcttgaaagttttatgctaattcctggtacataaacctaattaactagatcagtatagagctccccatggctatgagcacagactccatctccagaggccttggggccagcacaaaatcaaatgagtgccctagaatagcaaaaatgatctcgaaaaagaataaaatgtgagtaatcaatctacccagtttcaacactcattatatagttacagtaaccaagacagcgtaattttggcagaagggtggacatatcagatcaatgccacagaacccagaaataaatgtacacaaatatgcccaattgatttttaaatttattttgtattgatatgtaataattgtaaatctttactgagtacatgtgatattttgatatgcatacaatgtgtaatgatcaaattagggtaattaggatatctatcaccttaaacgtgtatcatttttttgtgttgggaacatttcaagtcttctgttttatgtattttgaaatatgcaataaattattgttaactactgttaccctgctgtgctactgaacactagaacttattccatctatcaaactgtatttttgaatccattaaccaacctctcttcatttccctaacaccatccttccaagcctctagtaaccatcattgtactctctacctccatggaatccacttttttagctcctacatttgagtgagatcatttgatatttgtctttctgtgcctggcttatttcacttaacattatgagctccagttccatccatgttgctgaaaatgataggatttcattctttttgtggctgaataatattccactgtgtatgtatactacattctcttcatccattcatctattgacagatactttggttgattccatatcttggttattgtgaatagtgctgtgataaacataggagtgcaaatatctcttcaacgtactgatttcctttattttagatatatacccagaagagattgtgattataaaagtgtaacaacagggatccttgtgatgatggaaatgttctatatcttgactgtatcctgttataatgtcaatatcctggctgtgatattgtactattgtactattgttttgcaaaatgttaccattgggaaaactgggtaaagagtacacaggatctctattatttcttaaaactgcatgtgaatctgtaatgatttcaaataaatgcttttaaaaaaaatcaaattagtaacaaaattccctctctaatatctgcgtattgtctgttggcattcagtaccctcatacttctgacacttaccaccttgcaaaactagctcttagaaaagattctgatctttctcactgaagtgccagtggctgatgatggcttaaatgatactacttccaggcaaagggacttagtcatcaagcaaaggcaaaaaaagtaactgtaatgttggaatttcagaccctgagtagcagatgaggaaggtatttgggagcagcagagaagccttcctgacatgtctgaattatatgctgtatgtcttgtcctattctgctctgaatgtagatcaggattaaactttcactttaggcctccaggttcctggaatcctccattaatgtggattttgctttgatggttgcaaacctacctacaaatgttgagaaggtttttaatattagtatcatttaagctattccgtttgaaaagacacacacatattccgtcttccttgctccccatgaattataccttctggtagtaagtttactttctccttcacctactaatgtcaattctctattaagtgcaggttcatcactctcaacccaggacagaacactaaatcacttgcaccttatgcttttagaaaatttctcctagaaacctgtcctgaagtcaatagttcttaaccaggctcttttaaaacttccaggggggactggagaaggcgaaatagagtttgttgggttctttgcaggaccaacccctgcataagggattctggtgtcttggaaagagctctgaactgagtagtcaaagaatgtaggttctaacccttgctttgtcgctaacttaccatgtgaccttgggtataacatttcttttcagatatcagtgttctcacctgtaaaacagattatagcaataccccaaatttctttgatacctgactagatgtggaagtgtgtagggttgcaatagtagccatggtattccaaaatctgtttgaaagaggaattctccccttggatgatttgtaaaaccagttcacactctctaaaccagtctgccttgagttgtctgcccagagtggtcactgggtaatttgagaagccctttgttacataacttataccctttccctttgatctctcatctactctaggtgtcaactctgcccgctcagttcctccttcctacccaccaccgcaggacccgttaaaccacggccagtacctggtccccgacggcatcgctcagtcgcaggtctttgagttcaccgaacccaagcgcagccagtcaccattctggcaaaacttcagcaggttaacccccttcaaaaaatgatacctacagggaggcagataattttaaaataaagtaaataaaattatatttatagatggaccttttttcggagaagcactgttgaaatttatacacacacacacacacagagacccttgagtacacatacacacacacacacacagacacacacacacacacacacacacacacacacacagagagataaggaacaaaagtgttttctgttgttttggggaagtgaaatatgtggttggtaggaagaggtaccaatgacttccaaacatgtgattccgtcttaaaagttttccatttttaccctgtcccccttccctttgctttcagaagttgacatttctattcattgcttttcttgttaagataatctctttactcccctgtgagtgattcactgccttgtcattattacgatagatgtgtttgtattgttttttttctgatgatactgatgttgatgaatttttaattttatttgatgtggtagagttgggaggtttcagggttttttcccctcttttactttccattgaggaagggaatgagctcctttctcctctccttcagccaatcattatcaaatgttccttcagccctgcagttgccccaaataaccttttttcagcatcctctgtcctcagtcatgccagtctggacatgctctgttgtgccctgtgacaaaactgctcagtattcctattgcttttactgtgttttaggtactgtgaagggatcaaaaaaccaaacagaagcaagggagtatcagactatgatgatgctggagtggacttctgttcagggaacattttgcattcaggctgtttcttctatcactggggtttcccatgttgcagcacttctgggtcgttgcaattttgcatctaggagttagtttgatcgagttattctcttttttcaagtcacttttgttataggtctccccctaggcctgtctctcccttagcccaaaagatctgaactggaagcagaggttgagattctgcctcccaggagagggatttacctgccccctagtaccagataggtttagggcagtgatctctacagcaatcagttcagtgtcctggttgtccctgctcccatttacagatgtttgggcagcattgatagaagtatggaggggttcaagacagagcccacctgatcaagatcatcagctaccttcaaattattgacctggacagggtccaagtctgatagtaaccttttacaagaaagaacagggatgggaatggaaagagatagccttgatccacagtattgtacctgcattttctaccaccctaaaattgtgtgagacttctcccattgttaacagattgcatggacaatcttccctggcttctttctttccctctctctttcttctttctcctgccatcctagcacaggaggatttttggtattgatatagttaaagctgttctggcactcaaagaaggccgtgtttccaacatcctctcatcccaggacatttggggcaagtgagttaggggcccaggggcaattttccctctgaataacgtgtctgaggcagggatgctaccctcaggctcgcttttggccagctttttgcttgggaaaatctaacttctttcacaaggaggcaggcttcctatggatgttggagtacctgtttttcctccacacatagcccttttcatggatagaccttgaacaacaaaaagggtataagggaataaggatgaactctgctgtgaagagcaagccactgtagtgaggaatgtggagactgggagtctgtcctaaaccccatgggagaagacttcatcatgacaggacttcagcttaccaagcagcagccatagctgtgtggaggcttcagcatagctagcatgtttactgctctatgcctcctgatccagaccaggcattgcccagcctgggaatcttttctttgtgggaatcaaattacaagctatttaagtttatattccatcacaaccaagtcagacttgtattataagtcaaggatgagcctgatctggggagagggccggggctcgggactggccaccactgttcagcacatgacctaactacgtaagcctctttggcaagggtcctggtgcccagcacccaggctaaaatatcctgtctggcagagtgttttggtagctatgcaggcctcccttcagtgtacctctttttccaacttctcactcctccttactaggcttggccttgacatgcttcttcgagggttggcagcacaccgggaggggatgcttggacaagtttctgggcctacatttcttgactaggccctctcatttcctccctccttggggcttctgcccagggctccaggatcagggatattacttctcaacccgcacttctcctctactgaacccactggcatcacctgatgccactaatttgtgaacaacaagaaatcatttccccattggttggagtattccctcagcctatagcatcaaagcagaccagtggccaacagccccaaggggagcccaattaaatacctgggttcagtatcctaacctgttatgtcctgacagcaatggtaaccccagtaattctgtaatgttgtaatttccgcatggccctgagctcccttttcctcaactcagtgaggccaggatttgctctccaaaaggctttgctagtgtgttcaatgggacctgctgtggggagtcctaagacagacatctaattattctctctttttccccccctctctatgtgtatatttctaatggatctataagaacagcaacaagagagttctaacaattctagtgtgaagccaaatagtgatcttttagtgctttggggatggggtgggctggggtggatggatgggcaacagtgactttgattacccttgctgctctgcatttgccagtttattcttttgtttcttttatctgactgactctgtcaaacaagtgtcaaagttgtgtgttaaaaaatgtttaacaaaaaaaatgttgtaatgacacaaagccttatgaaaatatttatggagttcaataaaagaag

SEQ ID NO: 4639 - DNA, 150570 bp, human
atctaactccagcgcagcgggaggcaggcagaggtagcagctgccttctcctgggcgggcggaggctattcgcccccatcctctccctgcaccccacccccacagttctcaagccttggtgggggacaaaagcagcccattaggacccccccacactcgcacctctccctgccaagacctctaggagcagcagggcggagagacagagcctgccggttggcatggaacaaactgactgaaggcgaggtccggggcggaggggattgggttgtagggctgtggaggaggggcggcggagggggcgctggggctctcgcttgcttcagcccagcccttctagtcagcccgcgacaactcgcgccagctacggggcctcagagaagccggacttcgcaagcaccatgcagtggataaggggcggatcgggaatggtgagtgcatgtaaccttggcttcccttgcttgagcctctcagtcccccagccccacctccagttcctccaacgagccacaaggcagtgagcaccctggcctctgcccaccgccctagccgccgtccttgagacaccagtgagcttgctgtggccattttaggagtccctgctagcctgcctgcccaggaaacccccctaccatccccctccacttttctatctccctctgagattaaggtggaataggggtgggggccagattatgtgcccaggaacatcccaggggtcacttgggaggccagagagggaagggggatggcagagggcttctctggaagcagtgaagctcgcaggaggctgacaagctggcacggggttgtggggggaggggacggtcacaaagcctggaattgtggagggggccttatgggagagctgcatgactcccccctgcccccaactagattttctgcaactcctttccctggtcagccccagagcatgagggccagagagccactctctctctctcaggaagctgcctgagggagccctaaagcccttccttgtccgggctggggtcaccctgtccacacttggggctttgtcaaggagagacagctgcagaaacccacattctggaaatgggcttgggccacagtcagttaacagagctcttctctccctcccaaggagtgtgtgcttgtgtgtgtgtttagtataatcctccaacagttcattttatgccatggtgttcccttctccacctggagaccttggaatgacttccttttgcagagaggaagtggtggctgcattttgatgcctctctgacttagccaggagcagcttaagcctggttagggcctctggggagtgggaggcccccatgactttgtcctcagctgggaggcataagcaaaagggccttagaaggcagttaggttgggtcagcaggcactgatggcaatagcccacacttctacgctgccacccataacccgcagatgaaggaaagtagcctgaagtggttgggcaaaaactgatatttaactccatttttgctttcattgtggaggggaagagggaatctggtgtgggctaggactatattcagaggggctgtcctcttcccttcctcagagttttgttagatctctgtttcagtggttcttaagggcatccggttcatatgcctatgtgctggggcttcaaaagacccttcttcccagacctccctacttccctgaggtcccattaaagctgcatcaaatgtttgtagaaccagaaaagattagagcaggtaaagaccttagagtccttgctgtccagccaggaaagctgggatccagagagtgggagagacttgcccaggaccacaaactccttggaggcaaagctgagtctagcacttgagtctcctgactgccacagtccttccccactgctccaccaatcatttgctcaaatggtgctgagaggggaagaaaggaacatagtcatgatcttgggaaaggactttcttcaggatgatctagtgccattaaatttacctgaaagccgggcgcggccgcccacgcctgtaatcccagcactttgggaggccgaggcgggtggatcatctgaggtcgggagctcaagaacagcctgaccaacgtggagaaaccccgtctctactaaaaagacaaaattagctggacgtagtggcacatgcctgaggctgaggcaggagaatcactcgaacccaggagggggaggttgcggtgagccgagattgtgccgttgcagtccagcctgagcaacaagagcgaaactccatctcaaaaaaaaaaaaaaaaaattacccgaaaaaaatccatgccagtcctggcatttctggcaactgggaactgggtcagggtgagacttacttcctctcccaaatatattgaagtataggggcccagagccactcattgacaacaggttaaattaatgaagaaatttgaagttttgccaacagtgtatgagagagaaaagggtggcagacatcttgtggagactgtgtaattaaggattggttgatggggaaaaatctcataatattcttagaggactgagacaatgaatattatatgatgaaagcatttatttagctgtttaccagaattcaagagatgggagtagtaaactctattcttgcctgagaggcagggaacctctaagttttggccttgccactaacagaaatcctttgggcctcagatttcttacctattaaatgcggatgttaataagcaccaaaattccttctaggccttagattctcagattcctagaagtatgtgttggataaaatttaactagtggctcattacgaacaaatagggattgtgtatctagccaccattttataacgtggctagctgaaagatctttgctccttgttctttcgtttgcaaggtgcccgaagtacaaactgagctttttataacagtgagatttctttttagtacatttgactgtagtaacttatttcaagtgttacatgtaaatcgtgggccttgaacataaaacattgttcaagattttacagaataaaatctgtctcatagatacaggatgctaaactgtgagttcacactggacggtaaattgttatttattcttggcttctttctgcaatgccagtttgtgctgggttagccagtatgcctaaattggaaagaacactgttctcagagtaacaaatcagaggtttaggacccggcttttatgtttctcagtcctgaaactattaccaattgtcgaacctactttattctcagtattctcttacataaaatggggataaagtgcctttttataggtactatcgggtcattaatttattcaacacaaatgtaggggatctgctatgaaatgacactgatctaagttcaggggagatcacaatgaaaaaaaattcctcactttcatggagcttatattctaggggttgtgaagttcattaaaccataacagaaatgaatatacactatgtcaggaggtggtaatcactaggaaaaaaaataaaacctgttaagagcatagagacacatgggaagttggatggtatattagatccatcaaagcctcactagttaaggggcatttgagcaaagatgtgaaggaagtgcaggaacaagctctgtgtatatgtttaggagaagaggattttaggcataaagaacatccagaaagaacacaactggtttgtttaaagaacagcaaggaggccaatgtccttgggataaagaattagtacatggaagaaggatagatgaaatcagagagaaaacagccacttttatagggcattattctgagtgagattgggagccattgaaaggttttgaacagatgagggacatgatctgacttaaattttaacaggaggctaaattgtagtgggacaaggacgagaactgtgaggaggcccaggttagacgtgatggttgcttggatcagggtgataatggtggagatgatctatatgaaatgactgacatcattgtttatagatgatacgtgtctttctcctttctgatcacctgctcggaccctcagatcgctaagagtggggctagaaagaacatagagtgggtctatacatggaggggcatttcatatctaagtcaatgttcgagtgatctgcttttggacttctgaccatggtagggctaattgagacttggttctatgtggattaccaataaattaataccctgctttctggaattctggagaagaagattaagtgtattattagcacttcagtgttgtggtacacctactgtttatctgtaatatctagaatggatcatttttaatagtcttatatatgaaaaaattattttcagtaataatcagtactatttattattttcttgatttattcttttattttcaattaccgaggaaaacaatacattttaatggtaaagatattcaaattcaaaatttaactcatgtataaactacaatgtgcactcactaaatagaagtattacacctttcaattttcattgtttcactgttttagattttaagcacacataaaactacaattggtcacacagaatgacagaattgaagtgacccacattctgttttttttgtctttataatcactatgttattattgtttactttcaacctactgtgtaaatgctggaacatatagtaccagagggattgtggacacaaaactgacctaatggtatcttgaatgattttgaacctttacaaactgaaatgagctgaacgaacacttgtagttacaactgtgtgcgtcaggggccaacgatgcaactgggagctctctgagtcaacttccatgtagaataaagtgtcgattaaaggataaataaaaaggtgctaatttcaagcttcatatatattattaaaagtaaccacaattgttttaaactttgaccaaccaaagttgttttgttttgtttttgttgttgttgttgtttgttttttgtattaaggaaggagtgttttatttctaacattgtttaaaattgctggtgcaaggtgatataaaacgctttgacttttagtcttaaaaaaaattatctatagctagtgtactcttgttgcttgcactcagggttgtctgctcccattgccacacctttggtgtgccaccactctggataagaatatggaattgtggaccaattccatgccaaataccatatgacctgtgtaagagtcatatatgactcggtggccatctctccagatggaatgaccaactgcaaggtttaacagctgattttactttattcagctatgaataacagaagtatatctatactgacttaaaacacacaggttttattttttcacataaaaaaaaatcaggagacaggcatacctgggccagtatggcagcttcaggaagtctttagagacttttctcctctatcatccatagcacttggcttccattattcatagtccaagatgagtgctaaagctcaagaaaatctattaacatccataattttggaaggcaaaagagaaggaaaagttcttcacccctcctttttaagaagtcttcctagaagtcctatttaatacttctacttatgtctcattgaagaactgtgtcacatggctgctgctagctgcaagggaagctaggaaatgcagttatataaactaggtggcaagtgtacacctaaaaattgggagtagggtttctaatacagaggaagaagggaaaaacgatgtttttgggagacaacctgcagtcattgtcatgattagttgaactatatgcctgcgattgtagaaacacagaatctaagggcttgtagtcagctttggactgtgggccaaagcctgatagatgttgctaatagtaaaaatgctgctatcaatcttgtgaaggttcaataaacacctgacatatcctagtcctcctatgcttccttctagtgacagtctttttgtgaaactagatggatggttatatggttttgctgtgtccccaccccagtctcatcttgaattttagttcccataatccccatgtgtcatgggagggacctgggggaaggtaatcaaatcatggggtcagttaccctcatgttgttctcatgatagtaagtgagttctcaaaagatctgatggttttataaagggcagttcccctgcacaggctctcttgtctgccaccatgtaagatgtgcctgtgctcctccttcaccttctgccgtgatcgtgaggcctccccacccatgtggaactgtgagtccattaaacctatttttctttataaattacctagtatccggtatttcttcatagcagtatgaaaatggactaatacagtaaattggtaccagtagagtaggatactgctattaagataccccaaaatatggaagcaactttggaaccgggtaacgggcagaggttggaacagtttggagggctcagaagaagacaggaagatgtgggaaagtttggagcttcttagagaatggtttagggcctaggtttaggacctggcttttacgtttctcagtcctgaaactattaccaattggcaaatctactttattctcagtattatcttacataaaatggggataaagtgcctttttataggtactttcaggttattaatttattcaacacaaatgtagaggatctactatgaattgacactgatcaaccactgaatggttttgaccaaaaagtccaggctgaggtggtctcagatagagatgagaaacttattgcgaactggagcaaaggtgattctttctatgttttagcaaagaggctggcaacattttgcccctgccctagagatctgtggaactttgaacttgagagagatgatttaggatatctggtggaagaaatttcaaagcagcaaagcattcaagagatgacttgggtgcccttaaaagcattctgttttattaattcacacagatatggcttggaattagaacttatgttgaaaagggaagcagagcatacaagtttggaaaatttgcaaccctggccatgcaatagaaaagcaaaacccattttctgggggagaaattgaagctggctgcagaaatttgaataagtaacaaggagccaaatgttaattgccaagacaatgaggaaaatgtcttcagggcatgtcagaggtcttcccagcagcccctcccatcaagtgcctggaggtctaggaggaaaaaatggtttcatgggccagcccagggccttgctactttgtaaggttttgggacttggtgacctgcatctcagctgtggctaaaaggggccaacgtagagctcaagccattgcttcagagggtacaagccccaagccgtggcaggttatacatgatgttgggcctgcgggtacacagaagtcaagaattgaggccaaaccttcccaagaaagtctgcctagatttcagaggatgtatggaaatgcctggatgtccaggaaggagttcaatgcagcagtggagccctcatggagaacttctgctcaggcagtgtggaagggaaatgtggggttggagctcccacacagagtccccactggggcactgcctagtggagttgtgagaagagggccactgtcctccggacaccagaatgatagattcaatagcttgcactgtgtgcctggaaaagccatgggcactcaatgccagccatgaaggcagcctggagggggactgtaccctgcaaagccagaggggcagagttgcccaagcctgtgggagtccacctcttgtttcacagtgacctgatgtgagacatggcgtcaaagaagattattttggagctttaagatttggctgctccactggattctggacttgcatgggacctgtaactcctttcttttggccaatttatcccatttggaataggcttatttacccaatgtctttgtatctaggcatctttatgtctataatttcattgtatctaagaagtaactaacttgctttttattttccaggctcataggcagaagggacttgccttgtctcagatgagactttggacttggacttttgagttaatgctggagtgaattaagactttgagggactgttggaagggcatgattgtgttctgaaatgtgaggacatgagatttgggaggggccggtggtggaatgctatggtttggctgtgtccccacccaaatctcatctttaattgtagttcccataatccccatgtgtcatggaagggacctggggaggtaattgagtcatgcgggcagttaccctcatgctattcttgtgatagtgcctgagttctcacaagatctgatggtttcattaggggcttttcctcctcttttctctacacttctccttgctgcctccatgtgaataatgatgtgtttgcttccccttctgccgtgattgtaagtttcctgaggcctccccagccaatgctgaactgtgagtcaattacacctctttcctttataaattgcccagtctcagatatgtctttattagcagttcgagaatgggctaatacatgacatgcttcctggagatagggggtgcaaaatagagcagtgtttctggaggatttagcgggaggagatgactagtacagtagtacagtctcagccctgatgagtttcagatgcttggacaatcttacattgtagatatctaataggcagttggtgatcagatattgagctcagagggattgggaggtattgatgacagttgaagttctgagggtagatgaactacctagcatttaaaagtgccgtacagcttgggaaagtgagaggtaggagcagaacttgaatctccttcttttttaattctcctaacctggaacagtccactttgttatctactttctagaatttacatgtcagcactattgtttcaggctttactctctgcacagtgctcatgttgcttctggactgcctgagctataatgtccaagttggatgaccttggggataatctagctcaactccttagatcaggggtcaacaaactatagcctgctggccaaatctagccaacaagctaagaatgatttttacatttttaaattgttaggaaaatatcaaatgaagaatagtgtttggtggtacaagtatatgaaattataatgaaattcaaatttcagcatccaaaaataaaccttcattggaacacagccatgcccactcatttgcttattgtgtatcgctgcctttgtgatacaaaagcagagttgaatagttgtgacagagaccatatggcccccaaagcttaaaaaattcagtatttggccctttacagaaaaggtttgcagactcctggctctgaaccctagggttaccatggcagtgccttggtgagggggagaaaggagcagaaaggagtgtggatctctcacctctggtctagagcacctggggcctttgctttatacattggattgttgcttaagattttggaaaaaggggtttttctcatcctgcattccctctatcccccacacaaaatgtactgggctgaggtgtgggagagtcaaaggaagatgtggcttatgtcttcaagcagcttagtattgagtaggggggaaataaagacaggctggactaaatgctttaggaatgtatatagaagataatgtaaggaaataggggagcaagaacgtggtgggtgaggggttcagggtattgtgtagggcttccaagagacagtatttaaatgtacttttgattttattttttatttttatcttctaatttttatttcaggttcaaggagtatgtgtgccagtttgttatatgggcaaattgtgtgtcatggggtttgatgtatagattatttcttcacctaggtaataagcatattactcaataggtattttttcagtcctcaccctcctcacatccttcaccctcaagtaggcctcagtgtctgttgctccattctttgtgtccatgtgtactcaatgtttatctcacacttgtaagtgagaacatgcagtacttggttttctgtttctgtgttaattcgcttaggataatgacctccagctccatccatgttgccgcaaaggacatgttctcgcgtttttatggctgtgtagtattccatggtgtatatgtaccatattttctttatccaatccactgtgacgggcatctaggttgattttatgtcttcgctattgtgaatagtgctgtgacgaacatacatgtgcatatatctttatggtagaatgatttatattcctttggctatatacccagtaatgggattgctaggtgaaatggtatctctgttttaagttctttgagaaatctccaaactgctttccacagtggcttaactagtttacattcccactaacagtgtataagtgttgccttttctctgcaacctcatcagccatttgttattttttgacttcttaataataggcattctgactggtgtgagatggtatctcattgtggttttgatttgcatttctctagtgattaattatgttgaatattttttcatatgcttcttggccacatgtatgtcttcttttgagaaatgactattcatgtcctttgctcattttttaatgaggttgtattttttttgtgtgtgtgcttattgatttgtataagttccttgtagattctggatattagaactttgttggatacatagttttcaaacattttctcccattctgtaagttgtctgtttactctgtttcttttgctgtgcagaagctctttagtttgattagttgcatatgttaacttttgtttttgttgcaattgctgttggtgtctttgtcatgaaatcttttccagggcctatgtccagaatagtgttttctatgttatcttctagggtttttatataaactgcatttttacagcctttcacatagcacagttgcataggatggggagtaggcatggtaggtgaagcatgagttgttccaagcagagggtacaacataagataaagaatcaaggcattaaaggaataataagttctggaaatagcacattagtgttctggtgtggctggagcctgtaattctggcaatgtgtactggggctagaacaagagctcagaagctttgcttggtagaaaggatacatgatgaaacaaagtagtggaggattcctttggcaacacaggacactggcagagtgggttggaaaaggagaggggttgcatttgacaaccagaggcaaattacacagatattatgataggcaatctcaaatactctgactgaaatgaatgtctgttgtagaagtttcatgggaaaaacgtatgattaaaagtcagatggacctgggtttgagtcctgcctccaccagcagctgtcacaatgtgtccttggccagaatcctaaacctctctgaacttcagatccttatcaattaaatgagggtaataccttgtattagtaaaggttctttagagaagtaaaaccaatagaatggatgggtgagtggataagtagatagatagatagatagatagatagatagatagatagatagatagatattataatggatttgctcatgattatggaggctgataagtcctaagatctgcattctgcaagctcaagtcccaggagagttaatgtgtaggtgtagccctagtatgaaggcctgagaaccagaagaactgatggtgtgaatgccagtctgaaagccatcagacttgagacacaagaaaaattgatgtttcagtccaaagtcttaaggctagaaaaaaacaatgtcccagctcaagcagtcaggcaggaggaattcccctttacttggcctttttgttctattcatatcttcaactgattggatggaggctcatccacattgtggagggcaatcttctttactttgtctactgattcaaatgctaattgcatctggaaaagtcctcacagacacacccagagtaatgtttgatcaaatatctgggcaccctgtggctcagtcaagttgatacattaaaattaactatcacatagcccttgcttgtcttcccagtctgctgtgagaatcagatgattgagtaggtatagatgggaaagtgttgtgtgaactgcgctactctgtatctgtgtggggagtaattattattcctgacaggacagaggagacacacacttgggtgggcagagtatgatctttcccacttccctgaatttataccttagaagatcataccttctccttctatgagtgctaagaaatccaataggaattttattcacaaggaacaatccctcctgccccaacccaaggcttcctggattctgtgctagagaaaagactgagaaaacaccaaacagtcctatgatataatgtgaggagcttcttcttaagatatcattgcttttaaagttttcatatgatgctgattttgttttttgtgtttgtgtgtatgtgtgttagaatgtggttagttctgtaagtggttaagctgctagatgatggaaactagacagtggaggagagaaatgcatttagctatctctaagagatcctattgccatgaggacatatactgtcaaagggtcatcctagcacaccagagaagtgacatttcagctgagtcagttgtgtagagacttggggaaagatcctgacacatttggattacaattaaaaaaaggaagagacagtgaggcttacgggaagttgaggggaggcagcaggaatagcatatgcaaagggcttcaggttgaaacaacttggtacacttgagagacagaaagaaggctagtgttactgacacagtgagagagggggacaagtggcatgataagagggtagagagtaaggcagggaccagctcacagagaaccttgtaagccctaggaaagtatgcattggctatactcaaagttagtgtggttcagtggtcaatagcacagactctgaaaccatactccctgggttcaaattctgactgtgtcacttcttagctatgtgaccttgagaatgttacctaatctttctgtgcctcagtaatgccctctgaaaagtgaggaaaataatgacactattcatactgttattgtgaggattaagtgagttaacatgctcacagtgtgcatggcagtactaggcacatggcaagcattatttattttaaacacaataggaagtgttcgaaagagtggaatgatagggtctgctttgtgatacaagaaaaggacttttgcaggccctgtagagaatggataggagatggtaagcccaattgagtggctgctgcaaaaatccatgcagctattggagttggatagaggaaggaagaccgacatccatttttgaaataaaatcaatgggacttgctggtgaattaattcagagacatataagacagagaggtaacaaggaagatgacccctaggtttctggctctgccacagaccagctgtgtaattttgagtaagtgacttcacctgtttaagcttcagtttccatatttattagtgagggttctccagagaaacagaaccaataagatatgtacatacatagagaaagagagatttattttaaggaattggctcacacagttttggtggtgcaagtccaaaatctgcagggtaggtaggcaggctggagacccagggaagagttgcagtcagagtccaaaggcagtctgctgtcagaattccttcttgctcagggaaggtcagactttaattgcattaagatcttcaagtcgggcatcgtgactcatgactgtaatcccagcagtcggggaggctgaggcaggtggatcacttgaggtcaggaattaaagaccagcctggccaacatggtgaaaccctgtatctactaaaaatacaaaaattagccagtcgcggtggctcatgcctgtaattccagctactcgggaggctgaggcatgagaatcacttgaacctaggaggcagaggttgcagtgggttgagatcataccactgcactccagcctggatgatggaatgagactctgtctcaaaaaaaaaaagttcttcaactgactggatgaagcccacctacattatgcagggtattctgccttactcaaagtccaccaatttaaacgtaaatctcgtctattaaaataccttgacagaaatatgcagaataatcaaccaattatctgagcacggtggctcagccaagttgatacataaaattgaccatcatgcctttcctatgaaattggaaaaatgataatatccagtcattggtactattgttttgagcatgaaataatatgaatttaagtgaataatattcatttaaagcacttggtacagtgtctttcatatagcaagggcccaattaatgatagcctttactatttcaatgtaataataatccttcacattcatttggtatttcatattttcaaagtaccttcacaagatatacaaatggtcaacaaacatatgaaaaaatgctcagtgtgactaatgaccagggaaatgcaagctaaaaccacaatgagatacaaccttactcagccagaatagctattattaaaaagtctacaaacaatagatgttggcgtttatgtggtgaaaagggaacacttatatactgctggtagaaatgtactgtattagtttgttttcacgctgctgataaagatatacctgagactgggcaatttgcaaaagaaagaggtttaattggacttacagtttcacatgcctggggaagcctcacaattatggcagaaggcaaggaggagcaagttacattgtatgtggatggcagcaggcaaagagaatgtaccaccagaggaaatgccaggtacttataaaaccatcagatcttgtgagaactcactcactattatgagagtagtaggaggaaaccactcccatgatttaattatctccacctggccccaccgttgaacaagtagggattattacaattttaggtgagatttgggtggggacacagagctaaaccatattattccgcccttggtccctcccaaattttatgtttttacattttaaaaccaattttgcctttccaacagtcccccaaagccttaatttattttagcattaacccaaaagtttacattttaaaatttgaggcaaagcaggttccttccacctatgagcctgcaaaattaaaagcaagctagttactttctagatacagtgggggtacaggtattgggtaaacacagccattttaaatgggagaaattggccaaaacaaaggggctccaggccccatgcaagtttcaaatacagcggagcaattaaattttaaatctttaaaatgatttcctttgactttatactttacattccagttacgctgatgtaagaggtgggcagttaaattttaaagctttaaaatgatttcctttgactttatattttacattcaggttacattgatggaagaggtgggtttttatggttttgggcagctccacccctgtggctttgcagggaacagcctccctcctggctgccttcacgggttggcattgagtgtttgcagcttttttaggcacaagatgcaagctgttagtggatttaccattttggggtttggaggacagtggccctcttctcacagctccactaggtggtgcccagtagggactcagtgtgggggctcgaccccacattttcctttcacactgccctagcagaggttttttatgcatctccccctcccacagcaaacttttgcctgggcatccaggcatttttatacattttttgaaatttaggtggagttttctaaaccttaatctttgacttttgtgcatctgcaggcttaacactacatgggagctgccaaggctcgggccttgcaccctctgaagcaacagcctgagctgtaccttggccccttttatttatggctggagtggctgggacacagggcaccaagtccctagattgaatacagcagagggaccctgggcccggcccaagaaacaattttttcctcctaaacctctatgtctatgatgggagggcttgccatgaagacctttgacatgccctggagacactttccccattgtcttggggattaacatttaacttcttgttacttacgcaaatttctgcagcctgcttcagtttttccttagaaaatgggatttttttttttcattgcattgttaggctgcaaatttttcaaacttttatgctttgcttttattataaaactgaatgtctttagtagcacccaagtcacatcttgaatgctttgctgcttagaatttttttttcacctgataccctaaatttttttttttaagtttagtttcacaaatttctagggcaggggcaaaatgccgccagtttctttgctaaaacataacaagagttacctttgcttcagttaccaacaagatccttatgtttatctgagaccaccacagctggactttattgttcatattgctattagcattttgggcaaagccgtgtaacaagtttttaggaagtttttaactttcccacattttcctgtcttcttctgagcccttcaaactgtttcaacctctgcctgttacccagttccaaagtttctttcacatttttgggatttttttttagtagcaccccactcccggtaccaatttactgtatttgtttgttttcacactgctgatacatacatacctgaaactgggcaatttacaaaagaaagagttttaattggacttacagtttcacatggctggggaggtcttacaagtatggtggaaggcaaggaggagcaagttacattttaagtggatggtggcaggcaaagaaaaaatgtaccagcaggggaaatgccaaatgtttataaaaccatcagctgtcatgagaactcactcactattacaagaaccatatgggggagactgccccatgatttaattacctccacctgtcccctcccttaacatgtgggaattattacaattaaaggtaaaatttgcctggtgacacagagtcaaacaatattgtatacattagtacaacctctatggaaaacagtatagagatttctcaaagaaccaaaagtagatcttccatttgatccagctatctcactactgggtatctgcccagagggaaagaagtcattatatcaaaaagacacccacacacatatgtttatcacagcacaattcacaattgcaaagatatggaattaacctatgtgcccaacaattgatgagtggatgaagaaaatatggtatataaacaccgtggaatactactcagccataaaaagggactaagtaatgttttttgaagtaacttggatggagctagaggctcttattacaagtgaagtaactcaggaatggaaaatcaaatactgtatgttctcacttataagtgggaaccaagctatgggtacacaaaggcatacaaagtggtataattgatattggagactcagaaggggaagggttggaggacaaaaaataaaaaactacatattgggtacaatgtacaatacttgggtggctggtgcactaaaatctgacttcaccactatacaattcatccatgtaaccaaaaaccacttgttctccaaaagctactgaaataaagaaaaagtgccttgacatgcatgaattcatgtaatcctcacaacaacactctccctactttaaaggtggggaaactaaggctggaagagggggaatatcttctccatgcaactatctccaaacagagccagaatgaaaaccaggtgtgtaacaccatagtagttatttggtcattactcttctcacttgccaggagtgaacgctgcccagcctccttcattctagaggtgaggggtaccaggaataaggttataaatacagtatgtcttaagaaagatagcttacctttcccaagccagcgtttattttgtgccaggcactgttctaaatgtttttgcatgtgtatctaatacaatcttctcaacaatcttatgaggtcggcacaattcttctttttttaactaaagaactttattaacctttgtctcaaactttattcccaggcttcttcatcttaattagctgcaaagggtgaattgtttataagcaaaaactgaaaacagctgcagtgtccaaggggcttgggcttaaaaatattacagaactagattttatcagatccataaacaaaaattttttaaaagcagtcataatataaaatagcagctcccagtaacttcttcaagttttatcttcttcagaagttgactcaattcagtttgcctcattcttggaagcctcatcaaaattttctacaagatctggaacttcatcatcgtcatcctctccagtagcaagtggtgctttccatccacgtattgtttaggcagagcttcagccagtctccttaaactagccaaactgcaccaagctggtttaagatgctgcatggcatttctgtcagctgctttgtcacagcatggcctgtaatggtgaaagtgttcactgctagagatgcctaaactttagggttgttaaagtggatcactgttccttggtttgtaaacatattcacctcttcaataccagagacagtgtttacctctaacttctttaaggagaactgaagtttttaatcatctgctgtggctgttttatgaaccacctccttctttctgtgagcagttcctttcctgcagtttggtgggttttcctggcccatgattgtttctttcatcttgtcggagtggatgaggggccgcgtgggggactagggttggtgatcaggggtcttggatggctcagctgaggttaggcacgcacatgcagagacacaagatgggagatagaggggcacagttctttagtgaggaaaatgcaggtagggcatggaggagagggacactcagttcatacgctgagaagactcaaatgacttttgccctttcttctttcaccattgtacattccagagaggatgaaaactcagagaagtcctttgagtgtttgtgaggtgcatacattggggtatgtaaaggcagtgatgcctgacagaatgcattttgtagacataacaggcactctgttaccgtgaacctcaggcaacctgtagccatcaagcctggagctggccctaagagaggacagaggcattggtagcaaacatttcttttggcccaggtaagatgccactgaaccagccaagcagtagggtgaggggaacaggctgaaacaaaacacttcagaagtcattcctagaaaaattacctaactcctctggatatcagtttattcacacacaaatggggcctttctccctccctccatttcctcctctcagtgtgcatacacacacattcattcagtcattcagtactattgagcatctgttatgtagcaggcactgttttaggcactagatgtgtgtacaaaacagacaaaacagatggtttacaaaacagaccaaaattctgtcttcagggaacatatattctagaaggaagttatatgctaagtaaatgactaaatatgtaatatggtagttttacattctaaggagaaaaaatacagcggggaagagggataagaaatatgtatgtgggtggttaaaattttaggttcctatttcctgctgcatttccctcacaaggttgtcatgaggttgatatgtgataaaaagcccagtatttaggaagctgtgaagttccgtttacatgtaaggtgcagttattcttgggcgataattttttctagttccttatttgctcttcccttctccattaacagtatagtaaagcttcaagaattctggccgggaggatgggaaactcaggttctaggcttcactctagcatgacaatttttaaaaatcccaaatgtgtagaactgtacagattctaaaacacttttcccggaactgggtcttctggctgttaatcctttgttctttccactcttccatgaagcagtaagagcagtggcaactcatttgcttcctcagaaacagtctttcccttctggaaaatgggaatgatgaaccaccccacccccaccactacccctttccagtctccttgggcttttgtgaggtacaaatcagataatgcttatgaaacaactttctatgtcataaaataagattgtaagggctggttgctaaggttgctaagatctagagagttggtgctcctgcttaagcgagggtttttttttttaattttttttatccttgttaactgggtgtatgtgtggagtggtgagagtgagcctttggaactggtgctacttcctttcctttctgagaagcagctgaggggagcaggggcagcactgagccccagcatctcctagaaataggaacagttacatggaaacacttggcatctcatgatagactggcaaccactgatgtgcagctcattttgtccactctgcttttgggaggtgggaactgggactcatttcctgaaacttaatacacaaatgactcatggcctttaaagacttccacttgcccctgtgatacaatctcatttggaatgctgggggtgggaagggggagccttgaataggtgagatcttcatttagtacctcacctttttctactatgacaattcttttgtgttgttttatttttcttcaacttttaaattccagggtacacgtgcaggatgtgcagctttgttacataggtaaacatgtgccatggtggtttgttgcacagatcaacccatcacccaggtattaagcccagcatccattagctattctccctgatcctctccctcccccagccccaccaacaagccccagtgtgtgttgttcccccaccatgtgttctcatcattcagctcccacttataagggaaaacatgcagtgtttggttttctgcttctgcattagtttgctgaggataatggcttccagctccatccatgtccctgcaaaggacatgatctcattccttcttaattctgcatagtatctcatggtgtatatgtactacattttctttatccggcctatcattgatgggcatttgggttgattccatgtctttgtgattgtgagtagtgctgcagtgaacatacacgtgcatatatctttataagagaatgatttatattcctttgggtatatacccagtaatgggattgctgcattaagtggtatttctgcttctgtatctttgaggaattgccacagtgtcttccacacttgttgatctaatttacattcccaccaacagtgtaaaagcattcctttttctccacatccttgctagcatctgttgtttcttgactttttaataattgccagtcagaatggcgatgagatggtatgtcattgtggttttgatttgcatttctgtaatgatcagtattgttgagcttttttcatatgtttgttggtcacatgaatgtcttcttttgagaagtgtctgttcatgtcctttgcccactttttaatgaggttgttagttttttccttgtaaatttgtttaagttccttgtagattctggatattagacctttgtcagatggattcattgcaacaatgttcctccattctgtaagttgaactatgacaatttttgacatactaactgaatttttcattccatagagtactttcaaatccatgatctcatcatctctttgacaggtattatgtcttctatttatagatgaggaaactgaggctcagagaggttatgatttgcctaaagctaggcacatataatcacaccctcaaataatagtatttattgtcatttactgagcattactatgtgctggacattgttctaagtactttacagcttttcactcattaaatcctcatgaaaacctacccctgttttgtaaatgaggaaactaggtgactgagagtcaggggtttgctcgaaatgaggggcagcatgagtatcatgacattataccattctccctgatttaaagatgagtaaagtgaggctcgatgacattaaataagttgttcaagttctcacaactagcaactggaagaactaaggttggatctcagtaggctggttctagagcctgtattcttagccattaggctatatactacttctaactcttaggatcttcctagcttgataaactgaagcacggggtggagggagggggtggggaaagagagagagagagagagaacttattaagatcacataatggatttaacattttaaaatttaatatattaatacataatatatttatatgctaaaaaatcaaactataaaaatgtgtacagtctgtctctctatctacccatcagagatcacaaacttaatggctttctatgtatccttccagagtttctttatgcagatataagcaaatccaaatatatttttcccctcttctttacctaaaagatcacacatcataatactaaatttgaccctttaacaacatggggattaggggccccaaatcccaccctccatgcagttgaaaatcaacgtgtaacttttcactccctaaaaacttaactactaatagcctactgttgactggaagccttatctataacaaacacagttgattgacacatattttgtatatgttttatatactgtattattacaataaagtagctagagaaaataaaatgttattaataaaatcctaagaaagtgaaaatatatttactattcattatgtggaagtagatcaccacaaagatcttcattctcagtgttttcacattgagtgggcttaagaggagaaggaagaggaggggttggtcttgatgtctcagggatagcagaggcagacgaagttaaggaggtagaatgggaggcaggagaggcaggtatacttggtattaacttttattgaaaaaagtcccggtataagtggacctgtgcagttcaaacctgtgttgttcaagggtcaacagtattctgcatcttgctttttccacattgcatatcttcaaaatctctccctatcagtccacagagagcttcagcagtcttagctaggccctcatgaatttctataagcccccatctatttatgtgtcctgcactcttctcttctttaccaatatttggggatgtccagccctttcttaacatcttcacttagagtctcattgctagactatcttggccttctacagaaaatacagctcctcaaagtgaattccttagtctccctccgacatataatctagcctcttacaaactccccagctatacttacctcctttcttgttttgcaatttcaacatattaccatatcctggctacctacctgcccacctacctgcttatctatgtgattcttgttgagtacctcttataagcaaagctccatgcttaatttgatgatgagtgattgtgtcccgaatgtccaatggcttgcagttcaaataaagcttgtaaacaaatacacctggacatggaggtcagaggggcttagctgactgaatgagttatgaggctcaggagtggaattatccaggagattaggctctacaactaaacactgggttctgatactgagagaaatgttcactccccaccacagtcttgaactgatgcatgattgactttagctaccccagaaagatcctgagcttgacagaaaaccattgtacttcctctaaaggggcttttagacctttgctgctcttttccaaccagttctctctctaccctgagtagagccagatggtctggcctactagcttgcttgaaatagaactgaaagaggcctaaaataaatgtgaaataggcccaaaatagattcatgtgaaggaacagaaggaaactgctgtttcctgggtatttactcaggtatttattcagtcattagccacaggagggtggtataggcagtttttcttgagggaaaagtttctgggtggtggtttagggtggcaactatgtcatcggagaacagaaaactaaagagatcttgaaattctcaaactgtaatctttatagtaccttttggaggagtacttactaatgaaggcccttggggtgggagaagggtgaagattggtattctcaggctgtagcagagaatactttccataacaagacttcctttacattttacattgcgagtcctcagggctatgccttgctcttcattcactcattcattcattaatttagttattcagtcattaaaaatatatttattgagtgctaagcactattttaggtgctgaggatacagatatgaacaaagcaatgtgctttcatggagcttacattttataaaggagacaataaatcaataaacaataaaaatatgtaatattttaggcagatgtaagtccagcctctgcttcttggtagctgtgtgacctcaaacaagtctcttgtctccccaaaagctcaaacggctgacttatttttagtggtagatttttaaaagcattggtagttttaaatcttcaacagccttgccaaaggtgtggcaggcatacccttggtctcaggcggtaacctgcacaaatgaccatgggtgatttgtggctttggaaagccaggactgaggagctaatcactccatgagagggtctgggataataatgccctcaaattcacactagttctcaggtctgaaaggcagttcaatagattatgataatgatagttaacacttacaaactgctttggaagagtggctttggaaagagatctcaattcaaatcctgctactgcttcctcaaacttgtatggttatgggcaaatgatgtaaacactctcaggtatagttactcttttaaaataatgataacaatttcttcttctcaaacttctagggataattaagtaaaataatatgttaaaaggcctagcaccatgtgggcccaaagtaggtgagtaggtgtttccttctcctcctccccctcacctttcatgtactatagagaggatacctacacagggaggttgggaggagatgatctctttttcccttttgaacataaaattatttatttgttcgtaatcatcaacaactttattcatcacctgattgtgcttgggatacttactgtatgacattgaaattatgtgcatcactgattagctctcccactaaactgtaaaatccctgagatccactctgtatcccttagctgtcagaataagggcttattgaattgaactgattttggaggagtagtgatttctgtgctgaataattgaactaaacaggagtttttgtccttagggggcagcctgtcttaaatagagatgatacccatgaacatgcaagagcatctagtcgtatcagtagctaagacaataaacagacaggattcagtatctgtagactgtagcaagcatgagggactatgaggaagctagggtaggggttggatgggaagtgagcagcagtggagatcgggacaaaaaaaaatggaactttgcctgggagtgcttcctggcagaagtgggtctttgggagctatgcaaaacatgagaagcaaaggacaaccaggaatttttttttttccctgacagaaggaaaaggtttgagaactagggatcttgggtttgggaggtaggccactgaggcccagatgaagacactgaaacagtttatccctgtgacctaggagacatcatgtcagatgttattgaaagatgggacatgtgtcacttattggcatttatatagaatagtgtttaatagcagactctagagctagacaatttgagtttacatctgcgctccatatcttactagccatgtgaccttaggcaagttatttaacttcattctgcctcagtttcctcatctataaaataaggacaataatagtacctaccgtacctacctcatagagttgttgtgaggattaaaagagtttatgtatgtacagggcttcaaacagtgcctgacacagagtaagcagtttgtaagtgttaactatcattatcataatctattgaactgcctttcagatctgagaactagtgtgaatttgagggcattattatcccagaccctctcatggagtgattagctcctcagccctggctgtggtagaagtagtgacaacatctggctcaaagagatggaagaactttctaccatctgagattgtcccaaagatgaaggggctgtcttgggagggaggaactgccccatcattataggtgttggagctgagaccggataaccaattagtggggatgttgcagaagggatggcaggatggaactggagttgtgctagaccaagagattatctaattccttgagacttgtcagcaagaaggaatagatctcgggaggggtattgctactccaaatgtagaggactccattaaaaaaaattgtgagcaaagttgattggtcacataactcagaaagctacccacacatggacagggctggtatcaaataccgtgttccagggtctgaaatctctcaaaagtacttttgagacttaagatacaagggctttggttcccactctgccagcaattagctgtataatctttgacaagttgcttcccttctctgtgaacctggaatataagggcttagatttttctctgtggttccatcaggtcctgccttctgtggttggaagatatgagtctttgagtggagaccagtggatgaaggagacattcatgcatccaataggtgtttgttatgaagcacctgctaagtgtcagacactgcgctgggcacaaagggagaaagcagtgaacaagacagtcgtggtctctgccctcctagcttcacagtccagtaaaggatacaaacaagaaaaaaatacaatacagtttaataaatgtttcaagagggctaaacgtaggatcctatgggagaggactatcattcagaatattgttgaggaagagaacattagagaaagccttctggaggtggtggcacctcagctgagctttgaaatggggagctggaaaaataaagcagcagtttatataggccctgaggcaagagaacctcatgagttatgagaactactgtaggttctatgtagctagagaacagagaatgagagggcactggtaagagctgaggatacagaggccgaaggacatcagattggcaggacattttatgccacactacagaatttgccttaaatgcgccgaggagctattgaaggcctttgaacagaggcattatataagtcaggtttcagctgcaaaaataaaccactgtagttcttttcagcagaaggagttttaatatagaaaataaagtgcttacaaaattggtgggagggctggaggggcaagctttaggctatgcctccaagaacagtgtcagggtagctgctctctctgacaagcaggaagatgaggcgtcaggggctctaggagcatgctgccttgtctgcaatttaggaatgaggaagctgccacagctctaaccatctgttggctagagtatcactatgcctaccagatcctcagtgacaaaaaaaaaaaaaaaaagtcccattctctggctctcagaatgcacaaagccaatggctagacactggaacctacggtaacacacacaaaaaaaccccaacactttcaccattgtgctttccaacagaagcaacagagacatgacttctggctcaccaaccacctccttctaaatactgtgcatgtgcatatgattggcatcactatgtcatatccagaacgctggctgcaaaggaatcttggaaatgccagtttattgttgttgtagtttttttggtttttagcttttcagcaatataggaaggcaggctagaaggagtggatccttaaaaaccaatccagagtatctacccaagattgacaagagcaaaactgcttttgaggaaagaatttgggcagaagagtagaggcttaattggggagggagagcagcataagataactggtaatgaattgtgatggatcagagatgatgaggaactgattaaaagtagtgacagcaggaagagagaaagggacaaatgagagagattaaggaggaagaggatcaacagaactaaaagacttgttggccaccagtgaggtgagggagagaaaaaacttgtagatattttcttggtttctggcaagctcagtgtgtgactgccattcccaggagacaaaggactcaggggaagaaggaaaccagcaagagtgggaggagatgacttcaatttgggactttttaagtttgatatgcttgtgagatactaaggaggagatatccagaaagcagtagaactttcattctggggtccaggagagctaccttggagtcatcagcagctctctgcttacgtgcaagcaaggtcctatgtctgttttgtttcccagtggtggtgtaattttgtagaaaggaggtgcatcaatgtgcaatgtagatggtagttcaagccttggaagtagatgagcccattcagtgcaaatgcagaatgagaagaaaaggggactgcaatcagaagaactcagaaatcatggcattaatgactggatgaagaagaacccatgcaggaagtgaagacagcataaacatacaggtcatgtggatggtgttcccaaggaaaaggagcatttcaggattgaggaaggcatcagtggagtcaaatgggagaaaagttacgaaaggtaaagattgaaagttggccatgagatttagtaacaagttggttgttttttttcctattcacaagaggtttcagttttctataggacaatgagggtaaagccaggatgcagtgggttgaggggtcaaaagataatgaggaaatagagacaggataagactgaactttcaaagactaggagaaagactgtagttgtttatattatggtactgtcctgatcaccagtatctgtctcaacataatctagaagagtagttttcaaaccgttttgactattacttgctataagaaacacatttcacattacaggccagtacatttatatttatatataactgaaacaaaagcatcatgaaacagtatttacgctaactatatgaacattttctataaatggaatcttacaaaagcctttttctcacgtctttcacttagcatgttttcaaagctcatctatgttgtagcatgtatcagtagttcattcctttttatggttaaataatacttcattgtatgtatataccacattttgtttacccattcatcagttgttggacatttgaattgtttccatcttctggctattgtgaataatgctgttataagcattcatgtataagtttttgtgttggcatgttttcatttttcttaggtatatacctatctgttcagtcatataatcctataatataagagcaaaaaggctctgagagatctcctgtataagggaatccttggtttgaaggcccagggaaccactgaaattgtttttttctgaggtgagtgttctgaggtttaactgaattctcagataagtctaagtcctcattgacaggagggagacagaagacagacccctgagaggaaaagggaattgcccaaaagtcatacagcaagtttgaggtagggctgagagtaaatttgaaaccttctggtctccactccatggcttttccctccttagctctagataccaggtcacagagcagggcaatgattagaagcagattgcaagttctgtagaggattttccatggcgaatgtttaaccctatgctggcttcccttcatagtacccagaatgctggaaaattgcaagctaactgtcctagtctgaagaatctataatcaagaaaggaaatctgaccaggtaagggcagtggtatcagggaaagccaaatagaattggattttggaaattctgtcgtgtgtccctgtgattctgtccacaacactggtttgttggctttttatagctaattgtgggttgcctgtaaattcttaggcagtggccaaaagcacctttgcttcctccttggcccaggctccaaacaaagtggctgctaggcacatgcattctccacagctacctatccgtttttcccccattccttctttctcctcaccatccttttttctgcctttccccacaattctctttcttcattatcttccctctcttctccttcctcctcgtcttttcttctttttctccctcttcacgtgatctcctccccttgcatcctattgggtcccttccctccctctttcccagtccttttcctccccatctccttatataccccctctatccgcccccaagaagctccccacccccaaaccagaactggtggctggtgactctcgccggtctggggagagcgagcttgcttgggagccttgaggctctgattggcggtcgcggctagcacgccagcgcaagtcccgcccctgggcagcgaacgtgctactgcggcatctgttattggtcggcgggtatgtcagtggctctggccgcgcctcacgcaagcgcccgcagtcgctcggtgaataaaaaggcagcctatgggctgagcgggggatggggagagaagagggatagggccagcaaggcagggatcgaacgagtgtctggcagccgggagcccagcgaagagagcgagcaagcttaggaaaacgagcgaagtaaagggagtaggggagactgagactgaccggtagccaggcaggcggacggacgcacgcccggacagactgagcaggcgccggagaaccactcacaggttccccccgcctttccctttgaaagctaggattttgcctttcccgtggcgcccgagagagaatgctggactctgccgacttcagcgcaagctaagatttctcagctagggacaaacgatcagcccaatcctgagaaggggggaaccaagcaccccgtccccatccccctcccctcccccgactaaactcgggcgccaaacccagcccttctctaaccaccctacttcctcctctcctttctagcatggtggctgtatggacagtctgacagaacagagactgacatctcccaatctgccggccccccacctggaacactacagtgttctgcattgcaccatgaccctggatgtgcaaactgtagtcgtttttgccgtgattgtagtcctcctgcttgtcaatgtcatactcatgtttttcctgggaacgcgctgaatggagtccagccacctgagctgtcgcgaactctcgctttgatttcatcccgagagccaccgagaaaaaaaaaaaatcacagacagagacagggaaagagagagaaagaacaagctttcttactcaggggggaaaacgttttgagcttcaacatggcctcgctgtgatatgtatgacgttggtatattatctctccctaaatcttttgtcgtgtcttgtcttttaagaatgcctgcgcgtatagttgcctattgcttgagtgaaattgttgatgaagaaatgctttctatttaagtgtgcatgcgtgtgtgcatttttaatctatgtggcgttcatggagcaagctctgcgtccttaaacagtggctttgctgtctgtggtgtcttaactcatttccttgaagactacctttaaactccatcagggaattttagtcaaaatttctctcttgccatcaggagtgcatttgggtttgtttgaggggaaaagggtttgtggaagagcatgatgaatatttgacatcataggaaagacagtctttgcagtggatatttagagggaaaataatcgatgcaaggaatggatttagggaaaatgcttctttagtgtctaaggagaagcaagaatttgggaagtgacacgggtgtgttgtgctggcagttggtgactgtgtcctttgaatctcaatttgctctccagggttcacaattttcaattttgaaagaagccacatttaaaacacttcttgaaccttaaagctttaagatatttaaaatgtcaatttccttggaatcatgaaatagtatgtgaaagcattctctgattttttgaactggcaagagaggactttgacaggagctatttgggctccctttcccaaagattgtacccctggatttgagtttggggattttgtttgtctcatcaaaaaaaaaaaaaaaccccacaagaaagaaaaaacagctctttatccaccttgggaataatagtatttggatatggctcctttgggataatctcgtttgcaatgatgttcttgaactacattttaaatgtaacttgataaggctgatgagaaagtggtgatgctattgtttgctcccgtttgttactttaagatcagaggtctctgtaattgaaacattcccataacaaactgaaagtctgtaatgtgctaaattaagagttatcaaattttggtgctaaatttgaccaccaaaacccaaaaacgtctagaaggaaagggatgagagcatggaaaacatgagctggaagcaacattccagtttgagatatgactgcttgtctgtatcagatggtggtggtggtttctgttgttattgctattgctattatttttatatttctgtttcctctgagaaagctcttggcagagccaggaaaaaaaatgtctcatgccagtctgtataatacttgtttttttgcgttttgattttctttctcccctgttaatgtaggcaggctttccccattccattgcttacctggcttgaaataatgccatttatggctcatgtattatagcagtgaatcaggacacatacacatctacacacatgctccccctccacccatgtgggtggctgttcatgtctgatgtgcaaatctgctggcattatgctgtcaagttccatgtccggttgttcagtctctttggaaatgattatgaaaggagaggggctgtgaagggggcctttgaaattgtcttggccacaggacccagagagtattatttaatggcgtcagagggtgttttgggcctcaaagcatgctatccttgacttggtgtgggtgagaagctgaggtttttgtgagattagtaccatggtgtaaacatgatctgggaggtttgctggcattggttcttattaattactctttggtccgtttgtggagaccccctggatggaactgagaacctatttctttgcaaagataatttagtgagtttttttccccccttagcttcattgtattatttaaagtaagcttatatcttttctgggcactttgttttgatacagtgttggagagtggggaatggctctatgctgggcagctgcagacctgtttttttgttttgttttgttttgttttttgttttttccattcagcagctgtttgaccttggacaatttttttcctcctcggtgggtttgggattcccagtaacattggcattttttgatggctccactaggtgacttccaagttcttgcattttatgattttatgacccctagacacttgaagttgtggggggtgggggggatgagctggaaagacaagtgaaaaggaaaagaaaatgttaatcaaagggtgatgggaggaggggaaggatatctggtactacagcctggataacaagtttaagcgaaggggttttttttgcctagttatttgggaaggaaactgggacagcaataagggaatgctttttgactttttttcccccaaggggagaaggggtctctgagactagtctttgatctaggtttatgacttaaatagtgtcacgaaatgccttctcctctgtgagcctgacagacctttggcagaaagcctctgggaatgtatgtgtgtgtgtagggtgtgtggcagtatgttcatgggggtgtgtgggggggagcacactcctgagtgtggatgcggggtgtggtggtaggaatgaagaaagacagtattgagttccacagttctgaatagcctccttgtgctaggacctataaggatttcacaaatgctgggatggatgggtatcacccatgccattcctcttttcaccacctaaaacccctcaggctaaggaggtgtcttgaatgagcccttccattagtaatttagctgttgaaatgggttagcgcttttaaaattgtctccaggcaaataaagggatgttgctagccagatggcaggccaccatctagcaaccagaagggaatttgagagtagagaacaaaaggtagcagtgtgactttttacttgtgtgaatcctaaaggtttggcatttctgcttcagacttgtgaggatatttttctctagcaaaaagagaaaagagtgggagaaaatgagaaatgcagcccagagaagcggaaccctatgcattttgacttgtcttcttttttccttcctcctctgccttctctcttaatctttctccttcttcctttcttcccacccctgacaccacctcctcctcccacctccccactgtaaatgggtgagaagtaaaaaagagaagaggacttttcctctctgatttgtcccaacttttcccaataaagctcctccattcccttccctcctctctggcccctttgagtagaggataagcttttgccatgtaggaggggcaaaatcccagcttagggattttcgctcctggatccccatcaaagaattaaagaaaatgccctctactggtatcctagcaacccctgtatcactgagcacccactgagctccagagcccaccctttaaaggcccaggcaccaataactctagaaaaaggggactagagcctagtgggacttggagagatgcttttggggagggaacaaagaaagaacagaatcccaatttcctgcaaatgcctcggaaacatgtccacagcagacatgtagagcctagcctcgtccagctatgagattatttattagaaaactcctggtttcaaattcctttctagtcagtcccatctccttaagattaactgtgccattttactgcctagctttagtgccagaagctctgccggtcctgaaaaaacaatttttttcaccctaacttttggctgcatcagggagggggtgaagtgatatcttggtgggaacaaactgaacagcattcttcttccattgagacagcctccatctgtcagaacctgcagtgtgcttgtgcagtgtgccccaattttgtctgtggcttggggaatcctgatcagcctagctttatagaatttgggaatttttctttctgtggttttggtgtagtagtttctgacgggggaggctggacaagttgaaagagcaagtttgataatggagctggtaaacagggcttggaccctggctcagagactctcacccaccggtgtgtgtgtgattcagctactagggagctgaaagatcccaaaaaggctgtaggtgaggtgctcttctgcccttgaggtaaggcccagattgagagcaaccagagggcacagtctggtggtttgaaggatggtaacaaagcatgtcttcctctttagcctttgtctgccatctcagtttctggtcccttgacctgcagagtgcttgctctgggcagggatataagaattgagccttttctcccaaaataactgcctcctcagaagacctcctacaaggcatctggatcttgctccagtggctttgccccaagaaatgggatggaggaggggaatcttggactctctagctcttatttccagctctgcaacttgttctaggccaactgagtctctggctttccaagaatccttgatgaaggtttagcttctccagtatctgctcagagtgtctccttctgtcttaggtggatctagctccatagagtatttagtttattgtactttgctctagcacgaaagtacaaagaggaaaaactagaaggggaagaacatagaggggagagaaggctcaggaagcagtccagtaatgacaatactaataactccttatcagtgcacgggcctatagcgtttatgaaggaatttcacatcctttctaacttgagcatcacatcagccttgtgaagtgggtagagatgattgtaattcccagtgttacagatgaggaaagtaaaggtcagcaagattgttgggatgggagtgggtctgcctttcaaatagagaggagagtcagagttggtcattcctaactagtgtgatgttgaatgtagggagggagggcctgacgtggtggctcacgcctgtaatcccagcactttgggaggctgaggccggtggatcacctgaggtcaggatttcgagaccagcctggccaacatggtgaaaccctgtctctactaaaaatacaaaaattagccgggcgtggtggcacacgcctgtagtccagctacttgggaggctgaggcaggagagtcacttgaacccaggaggcggaggatgcagtgagccgagatcatgccactgcactccagcctgggtgacagagcgagagtccgtcccaaaaaaaaagaaagaaaaggaaacaaaagaaagaaaggagatttgggagtcatccctgaagtcatactagcttcctcagctactcacatttttaataactttcatttgtatagcacttttgctcagaattttcattctataaaatgcctttttgtcttgaatatgcatcaaagagttctgtttagttttatgaaaactcactatttgggatcttcaaggtgagaggccagtgtgaattgctgaagcctaaaatacagaatgttttcaaggaactgtagttttaatacaattgttcttctctttgaagcacacttatttttctatatttctttaaaaatctgctgcctagaactgttcatgctactctaggtgccacctgactgagatcaagtgcaaaagaactttgttttgtctgtgaaatgtctaataatgcagccttctactgattctcaaccctcactgaacattcagatcacttgggaagcttttttttaaatacccatgccaggtcccctatctgaaagattctgatttaattttcatgggctagatcccagggagctttatttatttatttttttaatttaaagttccctaaggtgattcaaatgtgcagccagggttaagagttagccttttgagcatgtaggtccaaaccatttactgtctagtccagtcctctactctcttgtgaagttggccacttcagggttttttgaaccaaacttgctacattttatcttgacatgttggtccattattctagctttctgtggattttaaaattttttcttcatgctgtgctacaaattagcagtcccttctagcactgcatcagttaaattctatttgtttggttggactattgttctagcctttgggaggtttttattttttttcttcatgtcacacaacaggttagcagcctcttctagtgttgcattatttgaacaccaaataaatggcattcgagtcgttgattcaaagaaatgtttactatgatatgattaatgctagctcttctgtcacctcaccagagcccctcttggagttgggacttgttaatttttgtatgtatctggtcaaccagtgcagactgcacctggttgtgccagcatttatcctaccagggtgttaatgtgaataacatagcacgatagatttgttgtatgctttgtgggcatcaagatatgctaggttcatagcaagcatctgccaaactgatagccccatcagaaaaagcagtataagttacttggcctcttactcatggtaaatctggttgcaggctccagagcttcttgttttctttctgtgcctacaatgcaaatgtttctaaactgggttcagaacttggctgagggtcagtactacaactgtagtttctgtgtattactttctcctctttgaaaaagcaggacataatggatttagctttaaaacagaatatattttgtgctcaaagagttccggaaattctttgtgtatgtttctcttgttgttttgcttaattgtttccattaacccagtggttctcagcactggctgcacatcggaatcacctggaatattaagagtaacaacaattcctagaatctttgggagagatctgattgagttgatcatagtggtttcctggcatcaatatttttctaagagttccctgaggtgatgggaatgttcagccaggggtgagaatgactgctatggaatgcttcataggaaatgttagctcagcctgtctgacttatcacacatgtgactaggcaagcttcacagatggtgaaattttattctaggactgtgggagcctcgataagtcccaggggcttgtgctcactctaaaaaggaggaatcaaccctagggaatgagtagtctggagacctaattgtatttaaaataatcagctgtgagatggtttgaacacttcaggaataaaaaaaaagtcagttcctacacatttgctgtaatgatggggaagattctgctcatttgctagtgacctcaggcaaattacttctctcctctgaaatttggttttcttcatcagcaaaataaggataggtggatttgatgacttcaaagatttcttctagctccaacaatatgtgcttattttgtgattaatattaatgatcaacacgagtacagatattatttaaatctagcaggtaatccagagatccattttagcaggtttagaatacacagagtggttttaaggatagcagttttgccttcttaattatacttggcttaggtttcttttagaacaagtgaacttaggttgtattctttgagcacacactggccgccaagcaggaaaggagactgtatgaacacgcattggctgccaaacagggaaggaagtggtacagtgaattgagtagctagggtatgccagtttgggattctgtttattaaagagatatgtcatggataattgagaattgcctctcatagatataataccagtctcataggtctgaaaaagatggattgctttgacagctcagagccccttcctgcagtattttaagtagccattcacttggttaataatactacttctattaataagaatttcaacaaataaggtttcctatgtatttcatgggcttcttcctcaaacctaaaagtagttaagaaagtgaggctcataaagattaagcagcttactcagtgtcaaacaggtagtggtagtgactagtggtagtggtagttctagtggcctagaacctaggcgtcttgataccacatcctgcagtgcttctggtatagcctgcatagtggactctgtggtcaggatgcagtcatgactctgagaattaaaggggttttactgacatagagcagtattcaggaggaagctttgaagaaaggagcaaaaggggcaatgtggaggaagaaaaaaggtttagagagggatgtgttcaggccagtttttctcttgcccttatcactcttatgtgctagttccaggcccctgatgggaattggccattgatctttgagcaccaaggttgagtgttggtagcagagaagaaggaaagttgtacatgcatggcagaaggatagcatagggaaggcagacttgcagtaggagaaaaaacaagaaaaggccttaggagccctaggattaagccctggctctgtacctaccttgctgccagatcttgatcaaggcccttcccacctaggcgtcagcttccacgtcactaaaatgagagtggtttcagtagaagaactatgttctcaaatggaatgttagccagaagcttctatataaaacaggaaaaagcacagatggtctggttgaaatgggcatgggacaggtatggaggacagagtctaaagttccagggaaccatcttgcgtatgcagattttggtcattaggggaactggaattagaagagtggagatggctctgccaagcccagccatagtgcttggggagatagagcatccttggatagagttgtgtgatgggggtgggtatttcatttaagtggccaggatttacagagaatcacttaggggcagatattaaagtgcctagtacaacacactgcccccattcctttttttacaagtgagaaaactaaggcacaggaggggaaagggatgggtccaaggttgcagtgatagttctggaattctgattctttagatagggctcttgcctgctgtaacttgctacctcccctataggtttctggctctatgctcccttggctggatcagagacctgaatgctctttcaggtttggttggagaaagcaagctgacgagaggctgggagaacaagagctttatataacctcctggagagggagcaggcctgttagtagtccttggagttccagggagtaggatggggatgaggggaacacagagtctcctgaaggccacattagctctcctgaggcagagcagtagatgcagccctgtgagtggccatctaccctcagggcccagaggaggccagcactgcacatccatagccagctctgggaatggctttggcagctgatttctccgcctgcctgccttcattagagaaaggaaagccatgtacctccgtgcccagctggctgcaggaaggatgtactaagagcccaccccccaccccctcagagtgtggtgcctaaaggcagtagctacttttagctgaacctcccacagcctctcctccacccactctctccctcctccctctgtgaattgtgcaggatggcaagaaggctggggagtaggtgccttggcattgggatagaggcagaggaggagctaggcatctctaggaggggctctgataagccctgcatggcaggagggcttagaacaaaagcaaaatgatgagattgctttgtgcttaggacccaaagggagttgagggatttattaatttcctttggagcatgcaaccagctgaagttcatgtcttgtaaatttagactgaactgcatgggaagacttacactctacttggattaagaggaaagcaactggggctagtgggtactcacttgattcttaactactcctcttgaacagtcttacacttttcagtggattttgtacatcgtctcacttgattttctctgtggccctgtgaagtgggtagggcagagattatctccatttcacaggtgagaaaaagaatgttcaaagacttattgtcacatagctgcttctagcctggccttctgggcttcagctctggaagttacagtgccacttaaagtcactgcagacagctatattttctagaaaaataggtgctggagctgtcctgattctaatctcctcattgtggaagctggggaactaggtccagagaagaaaaggacttgccccaggaaatgtagtacatctgtagtagtgctggaattagaacattgccatgcaaggatgtgaattcctggacctgcaagatgtgcaagccactgtggtctttcaagggttgtttgggaaacctgtgtggtgtgatggaaagcaaagtgtcacagaactaggagtttgttatttttcagttcaggcagaactgtgggtgactgccccagtggaggcctgacactcagtaagccctctataaagatttggttgaatggaagatgtacacatgagtaaaaaggaggtgcaaatgtgaagtcagttgctgtgtgaccttgaacaaatcccattgtctctgtccctcatttctgtctgtcatttttggaggactctttttacttctctcccttggaagaagaaaggccctgtgacccggcccatgtcttgggtgcttggtggaaagctgttttgttttctgatttttgttgttgttgttgtttttaaataagctttcttttatttatcccaagctccatttcccatgcagtcacacactcgctgctatgaagagcagactaactttgtctctcctcatctcctgcaaagttaaaagaggaacttggaagaaagccaaaattaattgtgtttttatttagcaccttcttaagtccatcaagccataaaccacttaggcacatggcaattaaaaaacaattcttggcccctagatccttggctaggatttgtgatggattactgggttttcatgatatgatcaaaaactgttttagaaattgcaggttcttgcccaatgagctgtgtagaacaaatcaacactcttcacttatactcgcattattttgtttggaaacatctcactgatctgggggcaggacaagaagataaagactactgtatagccttctgctcctgacacatgttcttttctccattacactattaggtggccaaagccaagattattttcccaattttatggctaaggaaattgaagctcagagaattgctttgattgactcaggtcagtactgcatcttaaagtcagtggtgagctaggaagaacatagtatatagcgttaggtattatcaactcaccagtaccaagtgtctctaggcaagccatttaagattccctctgtagtttgcttctgtctaagtattttgttgttgttgtttgtttattttttgagatggagtcttgctctgtctcccaggctggagtgcagtggtacaatctcagctcactgcaacctccgcctcccaggttcaagcaattctcctgcacgccaccatgcccagctaatttttgtatttctagtagagacggggttttgccatggtggccaggctagtcttgaattcctgacctcaagtgatccacccacctcagcctcccaaaatgctgggattacaggagtgagccaccacacctggctctaagcatttttacaaaagttaatcaagatagaagaaagaagtaggcatatgctactggataattggataggttggcattgaaccattaattggtattttggtgcatctactggatctacaataaattcatctggatatcacattgtccagggatacatgagaggcctttcaaaatgaagaaaagtggccccagattctgtagtctttggtgacctacttagtttggacgctttctctctgtgggtttatctggccatgttcttaaagactgggccttgatcctaaaagcaggctctttaccattaccagtttctatggtcatcccaaaggatggggaagaatgatttggataaactacatgtcattttgcctgggctttggtggagattgtatgccattccttttactccagttggttcaggccactgggaaaatgagtgtggaatgacaagaatagggagacaaccaatagcttgctgagggttagagggggcctagctgggatgagacatctgcaggtgctaatccacgtgcacatatctacacactgattctttgtggtgttggggggagcaagcagagtttgtccatagtacttcagctgagaagtgactgggtaacagtgagaggaacccaagcattgagctcgttccttcagtgtacttctggggaaactgaggtctaaggagaggcaggaacttgcccagagtctcagaatttgtccgtgatctttgcctattctctctagtcagccaatggctaatttaccttacatttgtgaggctctttagatgaatgaggggtggctaagcctcttgggaaaagcacctgtgattaccacattcaggaagtgacagagatgaaatctgaacccaggtcttttgtcctgcttaagagcagattgacccagacttgaaggaaggctgttagaaacaaattgatggggaagaaaattggttcagctttgctgtctatccatgctctatgcccgtaccttcacatacacatacatgatagatcatatgtgatgcacacttacacatactcagacacatgggatgtatttgggacacacatgggacacacagctggaacatattttcacattaacacacttggaacacacattcagttaaacatgggaggaatattcacacttgcacattctcagcacaggcaggatacacacacaggaacacacatgagggatacttgtacgcatctgcatgtgtgaatgcacatggatgcatataaggcacaattgtgcacccacatacatatggggcatgctgagatgcactctcagatatactgttacccaggacatgcactcctatacctgagatacacactcctaaagactacttgggcaaacaacactccacacttgagtgttgagtcacacttgaacacacctatgggacatatccacatgctccacacagccatgtgggacatattttgatgcagaacacgtccttcccttagggccagccagctgtcactttttcctaagtgggcatgacagggaactggtcccagctggtgggcctccataagtttgctctggctctcctttaaccttgaaattagacttgagagggcagtatgctcagtaataaaatggatgttcaagatggcatgttttgtagcaggctctgtaaggtaaacagggttcagagcagagccctcagatgtgagttaacaggcagatgcagaagaatggaaaacacaaattgggattgatcaatgcagaaagcttgagcctgctccttcatcccccagttcacttacaaaccattgtggagtgatatggttatgaagcaatgtcaaagaaggcctaaagtcactggatattaaagtttatctttcttgggaatgaaataacagtctggactagagcaaagatatctaaattgtgggtgttagggtgtgaggggaagtggtaggatgcataagcgggagatccctttgggcagtggcccatcctctcctgggttagtggtggtctgagaccagcctcatccttaatgaccacaacctagcccctaggcacagcagcttgggtcatctggccccactaatgaatacctgctatttttagagttcctcaagctggaaaccaggtcatggtgtcctggggaagcctttgtggtccttggtacctaaggctgaagctggaaagacagggccctagattgggtctgagtgaagggtgggaagcagggggacacgtagctggggaataccaggctttcctgggagcagcatcctcagagcctcagttgggttactattaactataacagcctcatgcccatttctcagctttggctttgaggtcaagaaacatgagtttcagttgctactctgcctcttacagtgtgtctcagtcacgttcccctctgctgtctgagtcttacttgctttatttataaaacatccagtattgcccttagatgatggaaaggctcagctaggctaagagttgagaaaatgttttgaagatacacttttctccatgcataaagctgcatcatcattgtccctaagctggattcaattcctgccaacaattggacctgactcctattggagtagctgtagacagcaaaggccaaaaaaaaggagccaagagaagacaccctcatggagtcaggttggtcaaagtcatgctgagattacccccacatatacagatgcttttcaatgccaggtcagtcattctgggaaagaaaacagatttgcagcatttaggtggtcatgtagctttggctcctcaggaatctcctaggtaatgagagaaggggaggcatcaggagcagggatttcttcctaaactaggaaatgcaagaccaggtcacctgtacctgccacctgccagaggaggcagcctagagtgccagctctggctctaagagaatcctctttgtgtttgtgctcatggccattttatctggtttgctgagagggagaaggtcagaaactagactatgtagttcaagtttccccctgctgcagacattgtgggcaaagttctcctgaccctcagttttctggtctgtggaatgggcttaactgtagtctctcataagagttttaagtgcaagacttcattgtgacataggatgtgaaaagtgtcttgtaaaatgttgaacatgtgttcctgctgtttggattgttaagatttcatccaggttgtaattacacatagtttggaggtaattgagaaacttcactttatttctctacccctttcccataccgttcttttaaggcattattatatccattttacaaatggggatactgaggctcagagaaaagagaaacaagtctgaggtggcaggattaggtggtggtagattcaggactagaagccatgctttcagattcccaacccaatgtactctggccctgggctgccaccaatgaattccagtgctaaaggaatctgccagaggttacttaagtaaatatatataaagagttagatttttctctgacaagcagtacagggggttctctggggcacagctttacccagcactctccctgcttgcccaagagagacacgctgattgtcccttcatccctcctacagcagctcatgtcctgctgtctcctgcatgttggaagcagtgaagaattggagatgttaggctgttgtgagaagcaatccttctgccggtttaagccacttcaagacaataggaggattcttggaggcacaaaatccaccttggtcacccgcacctcctcacagttttttgggtacccctgacctgcctaaggggttggctgaaagggatctaaggaaatatatttgagggccttgatctctggaggattgtgctaatagttgagggataagattatggaaataatccaagaaccaaaactgggagtgtctctggagaccatttgggctgaatttcacctggcctcaatgaggacattaaaacccagctgggcttaccttttctcccttagtgtggttttcctttgtacaccacagattctcgtgttcagtcagatttcctggagtctttctagcttgcttgtttttgctattctgagcccagaagagggaaggggtgacacattgagtggagtggtgagaggaaagagatggaggaatctgatgagctcaggccttgaggggcaggcattggaggaaaagggcttttgtgtctctcttcatttgtattgctgctgatgcattattttcctatcttccactgattggctgtgggagcctaatccaatctgttgttatcttcacttttgctgctcaaacctccaaaatgactacagtattcattttgagggatgtcttctgtgggattggataagcagtggggcagggaagtggggtggggggaatgcggtgcttcaggaaaaatggggagaggaactttcttttcttcaaatttgagagcccagagaagtgaataggaaaaggttagctggcacagccctgccaagaagtagccatgcagtttcctaatctcttttgaccatagataccttatttttaaaattttatttttggataggaaatatattcacatgtttcaaaattcaaaaggtccaagagagtgcacagtgaaaagtctcccttccactccctgccctctgcagaggccaccaatgagtccttccagaaaaatgttatgtggatgtataaacaaatatgaatatattcctctttctcttttttatggtaatatacaacacatattgttctgtaccttgctatgctttggagattctttgatacttcattgaatttcaccttttggggatgtgaagatgtgctgtggaaagtagaggttaagagcactgattctagagggaaactgtctgggttcaggtttggattctggctctatgaacttcaacagttacttcattgtttttctgaactttggtttccttatctttaaactagggatcaaatgagttattatatgtaaaaacttagatttgtctctgacacatagtaaacattcaataaatgttagccattttttattattaggaaaaaaaccccactggaccagcgccagtagatctaggttttctcctggcctctgtgctcctgggatagctgggtaacttcctttgttcacaaattagtttccttacctttaaaatggaacaactcatccccactctgcttatccccaggatttctgggtgggtccagtgagctcatgaatatgaaggcaacttagcaattgtgatgttctgagcagatggaagaagtgcaacttaatattttcatagacactactttgggtggcttgaacccagtggtctgaactgggtggaaaaggcagtgtttttccttctgccagtggaacccaaaagccatccctgtactggtgttgtattttgagtgggagatagcccatggcaaaattttgaaatactcaggttttgtcttctgaccttttttattccaccccatccctctcctgacttccttgtttcattttttttggggggccaccccacccctgtcaaaacctgcttttagaagcaaagcagcagcatatgtcaaagatgacctcaactttccatttgaaataatttaatacagctggctcagagaggcgctggatctgcccaagttcatacagcaagtccagaatcaagctacacctagagctcattcttcccatcccagtttttattactgacatttgcattttagtgtgaatttgaatttgagattccttagcaaaaatcatctggtcgtgggggagattctggaagtatctttactaatccttcatactgaagtgttcttatcttttaatcttcagggtcagacctgtttgggaccctgagcagggagggaaagtcaggttctggttttagtactgaagggatgatgtctatagagcagtgggagagaagagcaccagaaaatgttgaaagcggtaacctccaaggtgagacttagggagaaaatattagttctttatatattaaattgttaatctcattgttatttaatttctattttgtggagtttttttttataaaacacatactacattaatatttaaatattgggataggtgtttcttgttttgttttttgtaaaataaattttattgtgtatatttgaggtttacaacatgatattgtaatatagatagatagtaaaatggttactgtagtgaagcatatctgtcatttcacagaattacttttttgtgacaagaatagctaaatgtttgtatttttgtttttaacattagaggtacatgatccaaaaactattggctaccattcttctaagactataggcttggtttctaatcttggcagctctgctgctaactaacttgatgccttaggaagcttttctcattggagcctcatttttcttacctgtaagaaagggaggactgagctaggtgtgctaactagttacttggaaatctccaatcctgaccacctctgagtataagaatccactgcctttggggctcttgagctgagacagttaaaaggagttcaagccctgacaccttactagatgctttatccctctatcagctgccttggtttccttcccttctctacccccaccactttcacctagcccagactggtagatgcttccttacataagtttagcgaacctacttgacattgttttgttacaagcacaaccacttttcctgtagacacagacctggtgccatcccttctgagctttgagggtgtgtctgattttgcttctattttgtcctctctggcagcctaggtttagtcgttgtatccctctggctaagtctttggtttcaaggtctgaggggaagccagctcagccagtttgagtcccttggggcctgacccaatggctgctcactgaatccctctgccacttcctcatccaggactgggctagacttttttaggagaacatagtccattcctgagcataaaaggcttctgacatggactagaggcattgctaggtgccttggccttggctggatgtcttttctctcacagtgagccaataggtagagggaaatcattgcaccactggaaactatcttccactttttgatgggctgtttaaatgcagatgtcctctctgggctgtaaaaactccctgggagatacttacattctctttggaaacgtatgccaaggtctagagtttttgcaagcctgtgtccttgctgggcatgctcagtagacgtaaaggtggtttcagttaattgaaatatattcatttttcctgcttcatctctagatataggagcaggtcacagtgctcctaactaaatgttgtttctgttcttgtcactgtaaaccagatggtcacatttaacgacgttaggacccttagttccaacctatctcctcccctgctcctcccgctaccttcagctctcctttctctacaagattttaacacgacatctgacaaatggataaaaaatgaatttccctttttctctctgccttgcccacccaccctctgcctgtggtgttgagtatagaaccatgcatgtgggagtcatggaggacagattcttcttgtagttctagccccctcctcctaccttctggaaacaaaggaaccccacccctgcccagaaaactccaaggcctggcttcaagtcgtagtccaggaaaagttaaagctcccaggactggtcctaaggcgactacatgaagaaattcaggaacccagatgcagaccttaagatgagtttaggtcgcctaagggatctgtggctcttagagcatccctgcatattccctaggtttgtcctggtcagctcccatatctcagggtagtaaggcaacaaaagtctccagtgggtagctggagctcggcattcacaccaagtccaagaagacgagcatggctcccagggcagggacattttgggtataagacccacgctggctcaacagatgggtgaaggtcagggtaacctcaagcttgagatggcatgttctgactcaggaactcatggagagggcattgctgagtccattattattatttttactaaccatctgtctcttagaatattggaggttgccttggggagatttaatacagctctaggaaatttcttccagattatagcatagagagatgctgctaggacttgctgttagaactagtggtagcttcagtgcctgaaggttgggacgggaatgagggtggaacagagcagaagcaaatagtctctcaaggcaggctgggagaaatcctctccgacaggccaccgtaattcctcagcctttctggaatctgacacaagaaggataagcctagagttggagttccagagattctggtttcttttgagtggcccagtgcagtaagaggaaattcctgcaatataaactctctggtcccagaaagattaagacagttggtttcagtgtggcacgtgattcagaatcactctggttgcttgttattaataaatatggtacggtggttctgagcaggggtctgtggacctcacattaagaaacagtgttgtaatgcgtcagaagtgccaaaatatcccagaataacttgacaattactcctgtttccaagatattttgtagatacaagctaatgtttatcagattgggagctgttgtagtatataggaccttctctagccaacatcatctaggttggccattcagaaacatgtcttctctctgatctgtgcaatccttggcccatttggctgcattttctttaaaggggatcattctctaaacaagaccaagttcttaacattgtgaactttgaggcagcagctgggtctcacttcagaaactcctgggcccatttggctgagctactggcttgggtttcttaccatctattgctaaggtccagacaagcaagcaacaacccttttctcatctgttgggtcaccattagagcagagatcaccttttaacttcctttggaagaagtgcaggaagaagctgttctttgttattagcctcagtgagaaaatattctggatggcatcatgccctaaggggcttctctgggttttccaagctaaaatgtcctaaaaggtcctggaaagtgtgaatcggcttatgaccactgttcatattgggctctagatcaggtggtctgtcttgctcaaggctgaccccatctaggcctaccttttgtgtctgccaggtgtggctgaacagtagatctttcattttattaaagtgaaaactggatagtataatgggatattgaaggaaactgatgtgtaatgactcacaaatcacacacccaaattaggaaaaagatgattttgtgtcatgaaaaaatatatgtacatacttccattcagcatatttagagtcattatcacttgagtgcattaattattctgccaagaaatgaaattatttacttgtgggcaatagcaacacccacattgaaactggaaacaatcaagtgcaaaatgttaaaacctgaggaaaagaaaaagcaactcttgggatgtttttgatattcacagtgggatttttcttacctagcatctatctctgcctctttccctggtgatcactgggcaccagtgcagatctttagcaaaaactggcctgccatagaagccacctagcaataaatcctggcaacaatggactggcatatagggcagctgggtacatattatgtaaacaatttccttggccccataaattgttctgccacctgacagagatgcttactctattgctgtgttctgcctcagagtttgcttgcttttagaactcaagtcagaactttaagtggagtatacacattgttcattatggattaagcttatgttttagacctatcattcagaagtatatactctggttatttgaagaataacactctggtcagcaacttgaatagctcttccaaatttttgttttctgcttatcctaggtagataaggttactgaaagaggcagagagagagagaggatgcagcctggagtcatcagagaagggattacggagtaggtcggccacaatcacacagctaggaagaagcagcctggccccagtgtcgctacgtgtaaccattggctaaggatatggccaaatcagaggcacagaagtaggattgatcattattttattggaggcagtagcaggccatccagtgaaatgttgagcaggcagtaggaaatgtgggactggaggtgagtgacagctgatgtcatgagaaggatgcaagagactcattttgacaagagtggtggaaagcccctgccttgttagaggtaaaggttggatccagagatgaggctagattaaggagagctttgagatagtggggagttactgaagcttcttgagcttgaggagtgatactagcaaaaatgctttaagattcgcatcattaaggcatagcttgaggaagggacagacctgtaagggccaaggaagccggttgggagacagtttgagctgatgaggaccaggataagacagtgggaatgaagagaatgcgttgtatctgagagggagagacatgaagaagaaagaaatagcagggccagaagattttccttaaatgggaaaaattgagaaggagggagaatgggggaatatgatgaattttgcattttattggaggtggtagcaggccatccagtgaaatgtggagcaggcagtaggaaatatgggactggaggtgagcgagaactgatgtcatgagaaggatgattcatctgaagaactaagtggagagaacaaaaagcaaaggtccctattgacttttgaatgcggcagtcaagggtttaagtgggaagcccacttctcaattttcccaggtagtctgactgtgttgccagcaatgcttgagtgagttatcttcaggaaaaagttctcatttttttgagcagaaagcagtaaaagcatcctatcaagcacaaagaagggtgaggagaattaagctgcaataatgacatccccgtcctttgcagagtaagtgttagcctcagtagaataccagagctggaagggacttgagaggtcatctgtatggttccagtctgtcacttgacatgtaaaaaaactgagacgggctgggtgcggtggctcacgcctgtagtcccagcactttgggaggccaaggcaggcggatcacctgaggtcaggagttcaagaccagcctggccaacatggtgaaaccctgtctctacgaaaaatacaaaaaattagccaggtgtggtggaagatgcctgtaatcccagctgctttagaggctgaggcaggagaatcacttgaacccgggaggtggaggttgcagtgaaccgagattgcaccactgcgctccagcctgggcaacagagcaagactctatctaaaaaaaaaaaaaaaaaaaaaaaaaactgagacagggaaagggacctgtccaagatcatttggtgagttactggcagattttcttccaatagccaatctgagtctttactgtacaccatggtacctcatagctattgttggggcagcctggttcacaccttcccaaaaatagggaggatgattatccttcaacactttgggcaagatagccagagcgttttcaaggctgtattaaaaggaatctagctttttcaggagagagcataaaatctcagcttgttttagatatgcttaagggagcaagggaaaataatttgctcttgcccaagtttagctgttcaggagaagggggccttctgagaggatacgggcagacaccaacctgagaaaacctcataggcaaacccctgtcatgtccctccttttcctcctacggagcttcttggaaggcaggtccagctcatctaccttcatggcaattggcatatttgctattccatacatgtgaggttcacattttttaacccattctcccttctgctgcttcttattaaaacactaatatttctgacagccaccaaggctaattaaatgtctattttgggggtggtgctgttgaactagaggggaagaacaagaagttgtagataagtggcatggctctaaaagactgggtgacagccataatcccaagttttttcctgtgttaacacagcctgacattgggcatgctgcttacatgaccccaaatacccttttgcagacatttaccaacaactgaggaaggccttgtagataggaagggagtgctggaggcagggagcacaacatatggtgtggcatggggaaatctgtgaagaatgaggcatcagaagaggcaagggtagggcctacactaggacagtccattagggcagtggttctccagatgtgattcccagaccagcagcatcagtatcacctggggatctatttgaaatgcaggttctcaagctgcacttcagacctacctaatcaatactcaaggcctatgtggcccagcaacctgtgttttaacaagacctctgaggaactgagaatcactgctgtaggtcattcacagggtgagctggtccccctccctgccatttgactggttccatgggggactggcaaatagcaaagctgtagagtaaggccaactggagatttaaatctgctccaccacctactaactgggtaactgtgggttacttgttttatctcacaagtcatcttcagtaaaaatggagatgttaatgcttacattggagaattatagaggttgaaatcacaaaagaaagccctttatccagtttgcagcatatgttttctacaagtataagcttctcttgcttcgtccttccctttataactcttttactttccttctgtctttcccatttcttcttctgttcccactgaaagggtccactggccaccccaagctcactgcaaacacacatgccttttttggtcacagagaccagccttagatctcagactcccagtgcctccagggtatagcaatcatatttctaggttaaaaatcaaggcacatgacagctgataaacagatatatctactttggggagcaattagatagaatatttgatattaggattgtcttcggaaatctggatacaaagaaataatatcctattctgtctttaagcataatgcaggactcttaaccctccccatcctcttattcatgtccaaaagttttgttgatgtgggagtgggaaacactatgtgtcccactcacttgtaagtctgagcaagagcttccctatatttagtgcttcctctgaaatgtcctggggattgggaattattttgttagaagccacagtagtgctgtcctaaggctcagagctctttgagtaccttgctagaatgatgctgctccatcttctggctttatgataggcttgcaagatgaaggatggtaacagttggattttggcagggagggaatataaaccagtttgggaatagagaatataatctctgctatagctactcccaaatggccttttcttggttttcttttttatagctctgtaccatttgataatgttgatgagctcttgctgcttgaaactcttgtctttgacttttgagagatcatgctcctttgtatcctaatgatgtgctaacagcttcttttagttttatttatgtagctctttttctgttccttacctcacattccatctttaagcataaatcttgatttcccaaggcttctggccttagcacttttttccagggcaaactctgattttcacaatttcttctgggccattgattcccaaccctgtatatataccctaatctctcttgagcttcccacccacctgcatgtcctgctggccccccatatttaacaccttaaagagaaaatttgtcatcacttcttttgcaaagccaagccaatatttcctcctaatttgtcctatgctttaattgacgtttgcacccaaaaattaactttgacctttttcttttcctcagactagattcaaggtccttcaaacatgacttcactcacctttttagccatcactccctccactcccctttcccaaccctaacctctccaaactccactacttgttcaccatcacatttcccagtcttcttctctgagacttggcttaatctcatttctctgcttcaaatgcccctccctttcctcctgtatctggtaccatcctacccatcctttaagggctatcttcattgccacacaaaacctttctatagcccaatacccatgtgtaatcaacctcctttctctgaagtcttgtactaggccagcacatgccaggcactgtatatccaccatctgagttcaccctctctataaccctgcctgtgaggcaaacattattacccccattttgcagatgaaaaaactgagacccaaggttgtatagttagaaactctttggcttttgtgaaattatactcctagatgtcataattacatgctgacaattacatttaagtttgtgtttctgactcctcttctattcctcacctcctattgtcattgctactttctaaagtagtaaagcccagaatcgaaggtaggtatgcgtgcccataaaaccacctttgcgtcctgctggaaagatatgcattgttggtacctggaaaccctttgttcttcaggtaaggactgcagctgagtcacagtgagcagatccctgcacacagtaggagctcaatgaatgaatgttggatggaagatggatgagcagagcaaagtgcattttaacaaaaattgtagcaagttaaaagttaattctgtacacaaatggaagatttggaaccaatttccaggttaagtttagtttacattttcaaaacaactcagaagatgagggaggaacatccctttgctccggcttgtgtttgtgaggagagaacacagaagccccacacagctgttaacgccttctggattagcgttcctctcacctccatgcacatacctgtcagctctcagttcagtgttttataccctacaaagcagatggtagagtagaattatccccattttataggtgaagaaactgggacccagaggcagaatagtttataagttaagagcagagtctctagagccagactgtgcctctactggaataatggcttcagtagttattggctgtgtgaactgcaaattatttaacttctttgagcttcagctacctcatctgtaagatatgaatagtaatagtttttccttaaagggctgctgtgaggcttgaatgaattaatgtatataacgtgtttagaatagtgcctgacataatagcgctctttattagctaacatcatcataattatcattacacctttagctagtagtataacaaggtcttaaattcagattattttttctacctgtattccctctctgtggtgttatgttagaaaaaacactagtccagaaggctgaccatttgatgactgtaggcaagttacttttgttaaacctcatctataaaatgagggcatgaaggtgatgatctttaaaattctgtccaattctgacagtcattgattctaagtaggccctgacaacaggcttgcaagttggttagttgtttttgtgaccactaggtcctagattggctttgtccagggtatagctgagccttgtgacctgagggcccaggtatatcagctggactaaatgggggacaaaagtcagcgatctgcttctgggaaaagccaggcatggagttcctgaaaagaagactgcaaagtaaaaaagtatagacagtggaatcagccagatctgggcctgggagacctcaaagagcaccacagatagtgtcctgagcagaaggttggtaattgatactgagatactctttgacccttgataaaaagctatggatatagctttaaactacaggtcttaatggtgctctgggttggggctgtatgtgcttactgagttctaacaatgcccacttgggacccatcttttccaggagaggggagacttctctataaaaatttactttagtaagccagtgaccagcttttctttttcttcactgaggccaaaacaaggagaaattgacttttagtacaattggaagaaagcaagttcaacataaaaatgaatgtcctcagcatcaggggcacctatgattaaaggtggctgtgtacatctcctgtagggttctttaagaataggagccaactggcttatgatatcatagatggagttcagtatagataatgagtagacattggtagtacagtttgataattgtaagagcacacaaagttagaagacccagcttcataatgtattacttgtgttattggctgaaggactaggtcacctttctgagcctcagtttcctcatctttaaaatataggtaaatggccaggtgcagttgctcacacctgtaatcctagcactttgggaggctgaggtgggcagatcacttgaggtcaggagtttgagaccaccctggccaacatggaaaaacccccatctctactaaaaatacaaaaattagctgggcatggtggcgtgcgcctgtagtcccagctacttgggaggccgagacaccagaatcgcttgaacccaggaggtggaggttgcagtgagccaagactgcgccactgcactccaacctgggcaacagagagagattccgtcccaaaaaataaaaatgaatgaatgaatgaatgaatggtaatagtgaggcccagttgattccgtaaggatcaagtgatgtagtagatgtgaaaacacttagcaaagcgtaaagcatgaggtatttgaaaggtggtgttgtgaaaggtcctgctggaaatttattttttatctatcctgaagagctcaccctatgccttaccttctgtggaaggcacaaagatgaatcctgagccatgacagatgcatctggcaggacctgaacaaaacatgttaacttaagtcaaagatcagcatgtgtgtatgtgtgtgtgtgttcatatatatgtgttcgtatgtgttgtgcatttattttgagaacctagggttattctgtggctagcatgttggagggtagatatatgagacaggatgtatattctatagactatttctattgtcttaaagttgttttagttttggtcttatggagccattattgccttgagcaaagtaggctgatggaaaagctgacttctagaggacttgttcagaaattcaatgcttgggagagagtgcttgagtctctttgcctgataggccatgtgttctctattctggaatctgttaccccaaatgctgagaagactgatggcccatacaagctggaacagttgagggaaaaagaacaaataacacagtgagcaggatggtaaagagaggcagactacctccccacccccaccccatccctatcaccgtgcttagatgagtttcatgaatgtctgtttgctggtatggcagtggaatagatgtctgcctgctcttgtgtggagcccagtcctgctagccgtgaagtctagtgagcagggttagcgtgcattccatgcacaggtcctgccttgccagctgatctccagctcatcacttgcttgttcagttttgccatccatcaaatgcagaattcaacccagacctctccccctactgtatctcacaggatggttgtacaaatcactgagagaatgtgtgctaaagttgagtttcttgggtacaaggcatcacagaaagccatattctttcctacccatgacctctctggatggcatcatgtgtgagtgagaggaggaggctgcaggactggggtccattatgcgtgaggaatgttatggtctgttaccccaggaggagggtcacggtggggttaaataatgtaccaccaactctcaattggtcagttccaaggaggaggaggaaagggggaggagcacagggaattgaaagcaaataagcttgagtctcattttagccattgctgtcagcctctccacccattcctgacctagagctgccttgaagcaccaaggagagatggactggagctttctttgttctgcacaggagaagttcatgattagggataaaaagcatgaggcatatgtagtacatattcatattctgggtcattccatgcactggctaacagagagttgacagtattgtttgtcttgcggtctaatggaacttttgttccagtgccatccccctcacccctatctctcaccacttgagtatatgagtttctctgtaagtagtagagctctgtgggtgggggaaggggcaagcaaggtagctgtgtggactgaacacattctcattttgtctcctaagctgatcactggagattccatcgttagtgctgaggcagtatgggatcacgtcaccatggccaaccgggagttggcatttaaagctggcgacgtcatcaaagtcttggatgcttccaacaaggattggtggtggggccagatcgacgatgaggagggatggtttcctgccagctttgtgagggtgagtgtcagtcttcactctcctctcctatttccttggctgcctgtacctggcttccccttcaccagcctctgttctcctgtttatttctctcctggtggcttttctcatatttttttcctttttttaaaattgtctcatacagagaacctgggcttcctttaatctgtgcccttttaatttttagacttttcatttgtctcttgtttaacacccccgccccaccacctcccacctttgtacaaatcacttaccttgtctgggtcttggtttcctcttttggggttggccttggtggtttttgaataagactttttaaccctatattgctgtgaacttttgtctttcttatctctcttttttctgctttctatttctcatcttttttttattctttcttctcgtagtttcttcccatctcctcctcttgctcctctgctcttctctccttcctgtctacttctttgcctctcacacccctgtgtgttgtcactgtgtattcagatgttaatataagagtgtgagctccctgccccccaggcgctagagcttactgatatcaaattttacttttttcaagagaatcaagtggctgggatctaaatgtgctgggggtgggaagcaagtggcatgtaaggtcttgcaagccttctgcctctttgacattgtaccatgaagaacctggcccttaacagagaggctcttgggaggaatttctcagcagtttttgctttttctgggtcactgtaaaggaagtgatcccaatgtgcttatgacctcagggtgctatgggagaataacattggttaggtgtctcagctcttattttttcttggaattgtgagctggaatcagctatttgactattttgagctctgattttcctcatctgcacaatggtcttgacagttctttaatgccagggcatgtcacagtgaatgagataaaacatgcgaaaactgctttgtggcaagacaagtactgaagctacatgagggtgtcttataactatccttacgacagcctatcacgttttgttagtttctcctgtaaaattaggctgaagtcttctagaccccaaacaaaaggtcagaagggctagctagggctcctagaggttgaagggccccaatattagaattatggcaatgtgatataaagaaaggaacagggcatttggagttagaaaactctagatacagttttactaccttctagctctatagcttttggtaagatttttaacttccctgagccctgatttcctcatctgaaaaatagggataacagactttttataaggaattagatcatacatgccaataaggtgtctagcacagtgctagacagatattaggaacttagcaaatggtaacttattttatgattatcatcataattataatcatcaccactacctttttagctccaagaaggtccatgtatcaaggcttcccttgaggttgatagaggcctccttcctcaaggtaaaaaatccagaaagtattgttacctggttgggacagtttaggtgagggcactgcctagaagcagaggaatggacaaaattacctctcattcccttctatcatgagaatcttctaatgaaatatccaatcttttcttctcttcagtcagagtctgcaaatgccatctgtgtcccatctcatctttgctggttaaagaatcagtcccagggatagtcagaaaaagcgtatcaataaccacagaccttcaggactaatgtgaggccctgtacgcatacagctggtatgtcttgtgcttacagacctccctctttaaaagaaggattaaactgtaccaaatgatgatgtcacccaaatccaaatgcatttcattttcaaggaaatgttacttttataataaatagtaaatccaaggatggggggaaatgattgagcaagccaggatggctcagggaagcaaatgacagagccagacttcagaatatcagtgggcagccattaatgcccctaagtccaaggccgggaggagtgttcctacaggaacaaagccccagcagccagagtctagctcaagtggttctcaaccctggctatacaacagaatcacttcagtagcacaaaaaaaaaaaaaaaacaaaaaacaacaagaagaacccaaacaaacaaaaacactaacacccagcctccaggctagtaaaataagatcatttgactaaattggtaactgacatggtgaggtatcttcattccctacctggaagtctcattgctgacatttgaaccctaggatggataatcaagggtggttagtgtggttctgttcaagttagccctacctgttgttacacattaaaacccaacctgcagtctgggaaacccagatgcttgcctcagttctattattagaaatgcaacttgagcagcttcctatgcatcttcaaatatcagttttcttccttgtaaaatggggacaattcagtcttgtaaaaatgctttgttacctgtgatatgctggatacttgtaaagaggaattataataccatttagccactgtacaggaacttaccaggtatatgtgtcttgacctattcacacctgtctcctctgttgttcagaatttcatacttgtatgtgcttatgtgtgtgtatatgtgtgtgtgtgtgttctcaggttctttcctttctgtactggggatatggcttcacaagagcaatgtaggagctgatataccttcccagtagttggtaaggttaaatgaattaaacttgctgaacatcagtcctcatatctagttgtcgacatcgtcagctgttttcctgggctggtttccctgctaggagctaagggtagactgctaggatatgattgtgtctctaagtagcaaatcccacctctgtggtgggcctccttttgtctaatagaccctaacttcaagtcattcaggctcttttcctttgtcactgtgcacaaaatgaaccttttttttctgactttgggccatggcctgaggagagcttgctgcctaattaagggtaggttgtggacaggacacatgacaacctgttactgatgggaggtgaggctcgtgtgacaaggcatgggtttggtcagaaagtaaagagcttgctgaggtgtcatcaggagctggatatatacttttcttgttctttcaaattctttatttctctggtttctggcctgcttggaagtatggagatgaaaggatcacctaagccaatcattaccatcatttcttggctttctacagaccagatgtcatggaaacccaacttttccttttcaaaggaaagcccattgttccagagtgtgacctggcttttatttatgtattatctctttttggctgcaaaaagagatacttgggaaaagcttttcacctctatgaaaccctagattcactgtagatttagaactgaaaataaccatcttagccaagagtggccaacttagatgcttacaggggccaattaagtgagtgaaacaaattgagacaaggggtaagtgggcacctgtgtccaactgggagatccatgccccatctaaagacagcaaaagtgacttggatggttcccatcattagagtgggatatagtggagaggaaagcccagaggggccagatcttctagtatttcaagaaaagccgggaattggatttttatgtaaaactctttatatttaaaaaaatgttaatgaggaattcatatttttaaagaagcacagtgagagtcaaacaaaacacatctgtaggataaattatctcccaaggacccagcttgttgccattggtcaccctacctccacgttgtataaatactgaggcaacatgggcccagaaaatggaaatgacttgctttctcatgtagggaattagtggcaaagccaggacttgaacccaggcctcctgaatcttaagacaattttactagacagtctttgtctaataagtttaatgtcttggcttcctttggtatgttttctgccaaattatttttttcctgtgaataggtcacatgttcctgttttcttgtaggccttgcaattttttgttgaaaacttggcattttcaatattataatgtggtaactctagaaatcagattttcttctctccccagggttttctactgttgattgttgagggctgtggttgtccatttgtttagtgactttttccaactatttttgcaagaccgtattcttgttatatatggtcactgaagtctctgttcttttatctcattggtcagccaataacctgacatttctttaaacatctggatccaagaagaaacaaacaatactactttcctggtttttgtagcttgactctgagctggagtacccacttgagactgtgccaggtcatcaactcttctgtctcagccttctcctcctgtttgtatgtagatcacacatcctccagaaatataagcctatggtcctctgaggtttttttctgagcatgcatctggtcctgggcatgcgtgttatagtgtgacttccctggtatgcatggtggcccttatgaatccttattccccaaagaaacttcctttttagcttcctccttcctgtgctattgcatgtgtttgctatttgtcctgtccacaatcccttgtcccaagtgggcatgagcagtgtatgtctttaaatctttcaacaaaggcagccacagcctggaaagcctctccagccagaggtcaacctctgtgctagtccctcagtgccaaaaaggtcaaaatgcacagctacaatattgtaaagaacaaggtcattatctcctggcaccagcaagccacaccaggaatgtgggccactgtcacctcagccactggggaatggggaatggtaagaggataagcaaaagtgcttcaatgctctcttaccaaatttttgctgcccttttctgcattacacagtcccctgtaagttgctgcaagttttggattagattctagagttccaaaacaatgtgttctgtcattcattgccagtttaaggttgtttcagtggaagaactgattctttgtgtgccctgctccaccacttttagtgatgttgtccccttctgaatcttaatcctgtgctttctggcctatagcataatcaagaaagggcaggcttgggctgctaacaagactgttaacacttgaggacttaccttccattccagactaaaggcaatagtgtttttgcgttcttgagaggagtttcactataccaacccttgtttatccattcaagcttcaaagtgttcataagtctctagtcttaaacatttatatcatttatgtagaaggtcttgcttgtggccctagaggtaacacattataggttgtgagtttaggctgacattaacagggagagtctttctccctggattatggctatttctctcccctgtactagaatttcaaatgacattattataactcatttgcattcacataatccatcttaatggcttctcactatgcacattttttggattacatcatctagtacatcatttggctaattggaggttttttatttttttcttttaatatggagacctcttcagctcagagagaatcttaaatgtagctgttacatcacccagatgattcctccaaattaggtagcacaggtcaccctcatagaaatcccaagttgaaagcaaccttgagagtcatatagcctatccctcagcctccaggcaggaccagagctaaaattaccctgggcttttgagaacctggccagcatctgtaaaccaagcttgaactactctgttatttccagctactagcccttatgctgtagtctgagccaatttcttgaaacatgttgcttttttcaataggaagatggtatttaagagttgacaccagtaggagacattctgaatggttttcttggctctggggctttccaaggccctattgttgacccatagcatggatttgtaacctggttggctgcctgagttgaggctatgatcttgggcctggcacctgtttttctctgtgtaatcaacccccgggtttatttggggattagcttagaccttcctagcatcgtgtatatactgccttggtggtgtgatgacttgaggagaggaggaccatgactgagtacctggagatgaggtctgtttctgtggctctttgtaaagtacaacatttttggaaaatcatcatacttgtatatatatattttcttttttcatcagtatatttatcattatgagtaagagtgaaaccacttatctttacatggctctagtgctattaatatcttctcaccagtatttactaagtcctgaacaaaagtgactgtctagcacttagcaacagccacctcctggagtggtctagacaagtactaagggtatctggcatcttgagaggtctgttgtcctctatattagagggtcactagagaaacaatactcagaagtgggttggtctctttttttagttttcagaagtgaaaactgacagctccatacctcttcaggccaccagttatacctcaggacagatctgaaatagtttgtccttaagttgaactagaatctgtctttctggagcttctactcatgggaagggtgtaaatgtccaagagaactggctctggagataatctttctggattagaatcagagcctttccatttattagcaaagtggccattgtatgcttcagtgatctcatcattaaattgaggatataacaacacctatctcattaagttgtcaggagaactaaacaaaatacaggaagagcactgacaatgggatctgacacataggaaacactcaataataatactggtaatacttgcagcaaactcttaatgtaaatggtagaaataatgtcctcatttttccctgctcctctctcaaaccctcttggaatatactgactctccactctgtctatagcccatcagagatctgaaacctcagaccaggtcagccaagcctctcctgtcctccaggcttctgagctttcaccttttagccattatttggatgaatcagtttcttgttgctgctatgtgtgagtggctagactgaggccatccgggcatgcaaggcccactccattcagccacttgtatgagaacatgggctacatggaggcctggacatgctgacactgccaggctttcaagactaataggaatgatattacaactaatgaccctgctgaacatgtaattggacaatgttctttcttggctgttctgacctctaccaagaggcataataatgttactggggccatacatcagcagttagcttccatttaggaacaaataaatggtggaacattgtgttatatgtaggaacccaagaatggattgaaaaacttctttttaaaatatactggggaaaaaagccataataatagacctgaacattctgcccattggtccaactctttgttttgataagcttattaaggtagtacagttattgacattgctgctcagtagagcttggccctgaatgccatgtgccatgtgtgcgatggactcattcccatatttatataaagtaagcatagcttactgttaagcgtacatttaataaagatgctatatacgggacagggccagcagtagccctgaaaaacagtgcagccagatgaacttgaatttggggcaggtcctagaggttcactttcccttgtgggttgggataggctgagagtgtgtgcgcagtgggtaaggtccctcccaactgaaaatattgggagaaagtccagcccagtaggtagagtgtagcatcagtaggcagcagacagagggtggtttgttgtcatgacaagtgactggtattattggtccaacgtcaggttgtttagtgtgcttcaataagcaggtaaagcatggtgaccaggtatccagaggcagggagtatgcagtgaaaatggtttcttaatttgtagaatgaaggacttaataaaaattcattcacccaacagatgatcatcaaatggctactgagaagatacagaggtactctagaacttcagcccatcctctaagagtctgatagtagatgtgaaaacttatgcataagggaggtgatttgccaaagctctgtcactttagtcaagttctttacctttgccaaatctcacttttctcccctgaaagatggaggggttggaacagatatactccaagaacttttctagcccattctccataatttcttcttctttttttttttttctttgagacaggatcttatgcttttgccctggctggaagtgtagtggtgtgatcatggctcgctgtagccccaaactcttgggcccaggcagtcctgccacctcagcctcctgagtagctgggactacaggcacctgccaccacacccagctaattttttgtattttttgtagatgcaggatttcaccatgttgcccagactggtcttgaactcctagactcaagcaatccacctgcttcagcctcccaaagtgctgggattataggtgtgagccaccaccctggctaatcttgttttagttgaggtaaaataaacataacatcaccttccccatttcaatcattttaaagtatacaattcaatgcatttgcaatgttgtacaaccatcaccactatctcattccagaacttttttatcaccacaaaaagaactccatacccattcacactcattcctcactcctctctcctctcagtctgtagatggtataatgttttgtacaaatgttagcaggtagaaaatacaggatagttagggaagggattaaattcataggaactgaggtcaggaagaggcatatgacttcagtagctataggagactacatcagcctggatacaggctaaaaggagtaaaaaacataagacagatgttgcgggaaaagcctcaatagggaacaggtgtcatctaaggcattggtactatcctggaggatcagaaagtaaatgagaccctgccagacttgcctttaacttgttagtaaatggcatagcccaaacaagatcacattccaactccaaagccagtgtttgccacatcaccatcctgaagtgttttttttttttcttttctaaatgtctgtcaaataattgcaagctttctgtgagatgggtaactcaggtcagcttgatttcagcattctgcttagcgtggctttcatcatgaaatcggtacttccatatctgaatagcttaaatggaagtcttctcttcattttagctcaaatagaaagaaaatcaaaggaaatacagaataaatgaacttctaaaggtcctggcagagcactccttttttggctacttaactaattaacctaaattctatcaacgtctaagcaggataattccatgaaaaccaatgaaaggagaagacttaggggtagagtggagtgtagttcttattagaggcatctagttttcttgactgggaaggaagctatgttatctgtgaagggtttccctacactccaatccacccccattctagcttgagttctcactttaagaagccttgtcatgggcagaaatcatcaatacctccagcctcgactaagtaagtctccattcgttgggaagggtttttgagtctggttgtcaaggaggtggcatttggggtataagaaatttgggacaattgcaaagcaattacaaaagtacttcctaaaactcttccctgactagagaggacaatgtttctcatatgttgcttcattgttctaggggcagatgatgccaacctaggggataataacaagaacagctaatatttgactctgtgctagaaactgttttacatgcacagtttaataaggattaaataaactaccttatttaatcctcacaacagccccatgagatagatagatattatttctatttcagaggtaaggaaactgaggatcagaaaacttaaagttgcttactctgtgttactcagaggtagttgtagagccaggatttgaaatcaggatcccgagtcttcaccctttaccactgtcacagactgtctctcctaattttggcctaagagtccagagactttgcttcaatcctgactgccactttgatgcatccccctgtctggccttggatttctcatctgggaaatggaaataaaaaggtttgcttgcctgccttgcagggctgttttgaagtccaagtaagagagttcgtgggaagacactgttcttgaactaggttttcagagaagccagggacaaaagaagaatgatagaaaagagtagggaaggccttcctgaagaaggagtagggggcaggctttagaaggatacaaggtacagaggtgtgaataaacagaatgtgttggaatgaatgggaagggtagcttgcctgaggtcacacgtctgtgttgaagagcagtgaaactcggtgggtcggtcccattttaatgtgctgatgggaagccatgaatgcaaaaacagtatattcacacaggtcttttctttttctctttttgtctgttatataacaaaaattttcattgctctggttgaagctccttatttctcattgtgttggtgctggagagggagaacaatttgttagcagccttcttattatgatacttcatataattagtgagagttattaaatcttcccttgaggggtagaggagtagtttctgtgtctgactgtacataccgtgctgattgtctttgtgccaggcaggaatgctaagtgcttcctggcatgcacattcaggaatccctaagcacttctgatcctcctgaaagctgagactggggctccaaaactgggtgtgtgtgtgtgtgtgtgtgtgtgtgtgtgtatgtgaagtgggagctctgcttgcaactaaccaggttcctctcagtccctcacattcacctttgtatccacacttcaccattgcttcactgtggtggcagagaaaaggccttttggtgacctttgttattgaagagttcacgttccctccaatctctcctttatctgtgttttgcccttttgtagtgtttgctgagatttttggctggcaactttattcagacagagacagagctcatgattagaatgattagaattatctgaaaaaggaaagggctgccttgggagacagtaatctcatcattcgttgtgttcaagcagataggctgtgcaattgctggcagggtatgttgtcaagggagtttatgtattgattggggagcaaggggtggcatggactagtccaccttccatttcctttataaactgattctatagctctgagagtctattgttcaataagactggcaataacccctcaccttctcaaaggatgtcttgctttttactcctctctggttgattagatttggcctttgaaaatatcaaggtgagatttagacaataccgcttacccattctcttctcagaaatattacactgctggagacaggggccggctggctttctaagacactccttgagcctttattgactttatgaaggaattactggctggatattatggtagttttcttttagaactactgatccatttgcagggaggggctactaaagatgttgaagaggttgtaccaagggctgggtaatcatcactttatcatatggaacaatggtgagtctattggaatatgcatataggtatataaatgcaaggagagaggttgacaaggatttcacacaaaatccataaccatggtttcctcaggagaggtagaatatggttaggatgaggaacaatcaggggaaatttcaccttatctagacagttttagctttttatgtatttattttaatagagatataatttccataccataaaatttaccattttaaagtatacagtttagtgggttttagtatattcacaaagttgtataaccatcaccattgtctaattctggaacatatttttaaaatcatttttaatagataaaactgtatatatttgggggatgtaatgttttgatatatatatatgtatacacatattgtggaatgattaacatatcatcatctcgcatacttatcattttttgtagtgagaacatttaaaactgtactttcttagcaattttccaataataatagtattctattacataactatgccatattttggtttatccattcatcaattaatgaacatttgggttgtttctacttttggttgttatgtataatgctactatgaacatttgtgtacaagaatttgtgtgagcatgtgtttttatttctcttgagtacgcacctacgagtggaattgttgaatcatatggtaactatatgcttaactttttgaggaactgccaaaatattttccacagcagctctaccattttacattcctgccagcagtgcgtgggagttccaatttcttcacatgctcgtcaatacttgttattgaccttttaaattattacagccattctaggacgtgtgaagtggtatctttttatggttttggtttgcatttctcagatggctaatgatattgagcatcttttcatgtatttattggccatttatatgtcttctttggagaaatgtctattcagatattttgcccatttttaagcgagttgttactttattgttaagttacatatattctgaatactacatctttatcagatatatgatatgcagatatttttcccattactgggttgccttttcactttattgatggtatcatttgtagcacaaagtttttaattttgttgaagtccactttatttttgcttggttgcttgtgttctaggtgtcatatctaagaaactattgtctaatgttacagattttcctctatgttttctttaatgacttttataatctgattccattcagatatttcatccattttgatttaatttttgtgtatagtgtaaagtaggagccaaagttcattctcctgcatgtggatatccagttgtaccagcaccatttgttgaaaaaactatattttcccccttgaataatcctggcacctttgacaaatatcaattcagcatgaatgtaggatatatttctggactcctggttttatttcattgatctttatatctattcttgtgccagtcccccattctcttgattactgtaggtttgtagtaagttttgaaatcagaaagtgtgagtcctccaactttattctcctttttcaaaattgttttggttatcctaggtcccttgaaattccatacgagttttagtaccagtttttcaattttctgcagacaccaggtgagattttgataggtattgcgttgaatctgaattaatctgaggagtattgctatattagcaccattaaatcttccaatccatgaataggagaggtttttctatatagttcttctttactttctttcaataatgctttgcagttttcattgtataagactgcacttcttttgttaaatttattcctatgtattctttcttttcctatttaaatgtgatcattttcttaatttaactctcagattgttcattgctagtatatagaaacataattgatttttatatcctgcaacattgctgaacttatttattcattataaaaggtttttttttggtggattccttatgatttcctgtatatcacgttatatgatctgtgactagagatagttttacttctttctgatgcaatgtcttttatttctttttttgtccaattgctctggctagaaccttcagtataaggttgaataaaagtgatgaaagtgaatatccttgtcttgttcttgattgtaggatgaaagccttcagtctttcaccattaaatatgatattaactatggattttttataaatgttcattattatttggagaaaagttcccttctatttctagtttgtttagtattttttttttaatcatgaaagggtgttggattttgcaaatgccttttctgtgcctgttgagatgatcatgtgggattttgtaaccttatttcactcatatggtgtaatttacatggactgattttcatatgtgaagcaaccttccattcctggaatcgcatctggtaaggtgggcaatttgtttttaatatgttgctggatttggtttgctagtattttattgaggatttctatatttttgttatttggaagggtttgtgaaagattgatgttagttattttttaaatgtttggtagaattcaccagtgaagccatctagtcctgaggttttttttttttttttttttttttctcccatgtgggaagttttcaagattgaatgaaattatttattaaatctttttcttgttataggtcttctcagattttctacttcttcttgagtcagtttctgtaggttgtgtctttctaggactttatccatttcatcaggttatgtaatttattggcatacaattggtcataatattccctttaattcttatttctgtaagactggtagtaatatttcttctttcatccatgattttaataattttaatctattttttctattttaactttttgcaaggcaaatgtgttcttgtataatgtataattttaaaaatagaaaaaaaaatggaaggcacaaaataaaaatgcacattaaagatatgggtatattgctaactccctggctgtctctgtgggtatcagtttctttattacgaaattgagaggatggattactgttgctgaagtttttgaaagcctttggactatagtatttctatgtttgagcatgggattaaaggacatagatgagaatatttgtggacggaaaatagaccagtctgggaggaacccaatattcctaaaggaagtagtaggaagtaagagtggaaatacagattggagtcagattatggtaatattttaatgtcagggtgagggatttggacttgctttataatcagtggagagctattaaggattttgggtttatgggattagccagtcaatgtgatagtcaaggaaattggtctaatagtggtatgtgggaagggtaaaagctagaggatcacccagggacttgttcaggtataaaagtatgagagcaatgacagtgaaaatagaaaagggagtaataaagaccagagattgtctccaatttggaaagcactccgtggtttagaaggaggagggaggagtgagttgtcttgctcatcctcatgtccttcacagttagtggttaggcacagaataggtccaaagtatttgttaaattgaactgcattaatcagccttgcttcggagttcagtgaagttcaaaggctggtttccccagcctttaagcactctaagaggacttccaggacagcctttcaacctggcatgttccaggcattgtctatcttcttacttgtcacccaggcatctatatgtgctaattgcagcatcaatgaagaaaaggtacacattagcctgcacggattgttgggcagggttgataatggctctctggtctgatatttcaaccagggcagataagcatatgggctgacctgtgtcagtgcactctgacatacatgcagacaaagaccttcctctgtacagaacagataagctctcaagagcagaggacttagaggttagaccagaaagtcttatcattaggcccgggggatgttttgtgggaacctgggatcaggagaaaaacagttaggccttatatgccacctttttctaggctaagaaacatcttccctcaaatgtcagctctataaagggcagtgatttctgtcttttttatttgctgttgtatccctaatacctggcacattatccacacttggcatagatttaatgaatgaatgaatctgttagtagttctttgggatgaaagcagcatcttaacctaaggaatgggcttctggggttgttgcagtagagtagatgaaggtgtcttctcagaagctccttatgaaggaccctgctacacaggcctttagttataaccagaaggacttctctaccaaattctttataaggaatctgttttcacttggctgcagttgccttcgtcttttctcattgttatttggaacgacagtgtcatggtgtatagcttgaacctaaatgtggttctatttctgcctttacatctgcttcccctttccttcatatcctgtcttcattcccactagaattgttcaaaatattcatcttattccagctatccaaaagtgaacatttggacctgacttttcttaaactcctaagaagaaaagaaatgattcttattccttaaaggcctgcctatgttaccctttccatagcagagtttagcttgctttgtgagaagcagggaaaagctaatggattattaagagggtgaggttttcattggtacaaatagacagcatcatgtatatgagatgtttgtttcagtgccttaaatcactttttttttttgcccaggtctattcttttgaataattatctctcatattgcttactgattgcattaaaggacagctattagcatattgaagacacaaagctgaccttttagaagctggaaagatatttataatggagcacttgcagagggtgataggttttggatagagatacattttgcaaatttggctgtatatacaaaatacataaaaacagagtgagccctatttactttggcctgtgacaattcagtgagatatacgctggtgacatctctaagttcactgagtggtaatcatgccccctcacctcctgtgagaaaaagaaagaaggaagaatatacagagttgggaagtaactaccatccttctagttctatcccaaagcctcttccccccgagtgattacccactaaaaggcttttctgatggcagaaatagggatgcatctaaattgtgtgattttagcttcttgaggcaggaatgtggaaaaaactggggtttaaggagggaaaatatggaaaatatggagaattgattaaacctgttgagacaactggcaagctctttggctaattacccctgacagattttgtcactctgccaagcgggcccacccttcgtttccttcctgcccccatggtttccccacttcctaggactgtggggggtggcgggaagggctatcttcttgggccttcttgattttcagtcaaagtcatctagaatatccagagacatctcactcggccgtcccaaaggttttttttttttttttttttttttagcttcccactgccttcatgatttaggatggacagtctcaactgttagcgaatttatcagtttctgatgattctaataattgtctgcccaccttggcccaagccctttccttttcttttcctgtcttccttagaaccagaggcacaaagattctagcacagtgtttaaaagcataggctctagagacagactggctcctatcccagctcctctgcttcctgtgcgacttgggatagattacttaacttctctgagcctcagtctccttttctgtgaaatggtgataatagtggtacctatctagcagggctgaatacagtatattgcaagctcttagcacagtgaatggtgtatagttggtgccaattaatagctattgctagtatgtggtggggaagtattctcccatccctatcccagtcttgaagaggtagagatctttgcatgtccaaggcactttacagtcaaattttgatgattatttgtatatcccatcacagaaatcaacactaaactttgttttcaagacacccactctagtatttaactttggcctctatacttgcaggtgcataaatgctgtgttttgacagcaatccaaatgtggcactcaagatgtatagcttaacctttttaaaaatccagttgtgctacctagatgtgctccagcatgaatgaatttagtccctccactctatttacagataggtcaccagagacctagagaagattaaacccatgcccagggcaaaaagtcaccctagagccaggtttcgaattctacttgcacaggtctctggttgaaggttctctgaatacctgagaagttcagttcatcctttttctacttgcctggaaacctcccaaagaaggaagctaactcattatttttcttttgcctgcttccacagctctgggtgaaccaggaggatgaggtggaggaggggcccagcgatgtgcagaacggacacctggaccccaattcagactgcctctgtctggggcggccactacagaaccgggaccagatgcgggccaatgtcatcaatgagataatgagcactgagcgtcactacatcaagcacctcaaggatatttgtgaggtaaccatggtggttcatgtggaggcacttccacgaagaaccagcaaccctcctgggccctgcctgtgacagtcccaagatgttggaaagggcacatagcctcccagattctgttcagtgaggtgaaactgcttccttagggtcagtgaggtaaaactgcttccttagggtttctcaatctctgtttttcacatttttctctctgtctagttttaatatttattcatttatattcattgtctctctgtctttaccctttcttagtcttcctccttctctcccctgcatctctacctttatctttttggtatctgatccagttacagccatctcatgtaagggcttaacctcactcattaaagcaaaatgcatctcccgccaagccagtgattcacagacttcaatatgtaccagagtttctgggggagcttgttaagcagccctctcactcttgtcccccaagtcatgaattatcagtctcaggtaaggcatgagcatttttaggtttaatgagcatccctggtgattctgatgctgctggtcctactctctcacttggagaacaccggttgtgagtttaagcagaaaagagcttggagacaggactccacagaagatggaggctggatggacaaacctgggctccttcagtatgtcactttttttccccaagagctgtctctctacattccctaaccccattccttccatctctctgtcctaaatgaagatgagagccttcactctcgtactctcttaagcttagtagctgcaagttggcatttttaaagggcattttactgaacaggaagggaaaaccaatgggaaatgaaggcagcgttttaaaaggattaaacacacacacacacacacacacacacacacacacacacacacacattctctcttatatctttcttcttgactcggaaaactctgcattgaatctttttgtctccttccttccagaggaggggttaggttctattttctgtcccccagcctagggtccactgtggagtcagtagtacagctccaacatttttcaaagttcttatttctctacatcagtactgcccaatggaacttcctgcaatgatgaaaatgttccatgtctgcattctccaatatagtagctataagccaacaatttatggttgttgaagagttaaaatgtggctggtatgactgagaaatggaattttaaattgtatttacatttaattaactttaatttaggtaaccatatatctgtaatgacagccacattgaacagtatagctctggaaacaccaaggccaaggattttgtgcctgaactttctttatctcaactcattttctcacccctttcaggaagattaaaagttatcttttcccactgccccactccctgccctgccatgaggcagatagagtagaaagaacaagaggtctggggacatggaatgctggtttttcacattctaacttggtcattaattaaccctgtgggcttgaagataccccttaactcctctgacattcaattttcttatttttccaatgggcttcattatagcaatctcttaagtttgttgaggaaattaagtaaatagaatattgcaataacctatgctgtatttggaaaaaggtaattttcttttttgcctcctttttaaatttattcacccatccatccatatgtctttttcttcttcctcctcccttcacatcaatggctgatgctaaaaaaattccccctcggaatgtgctacatggcattcagcatcaaaccactgacatttcattcattcggcaaacttttagtggaattctgttctgtgccaggcctggacataacttctagcctcaaagtgtcgtactttagagcagcatctgcatcacctggaaacttgttataaatgcaaaatctttggctccaacccagacttactgaatcagattatgcattttaacaaagttactatttgatgtataatacatattaaagtttgaggagcattgctccaaaatgatacctatattacaatgtcatagtgtttttcataaaattaagtacaatctattcttcgcttggtagctgagggatgctgtcaagatctaagtcaggtcatatcactcctctgctcagaaccttccaatggctcaccatttctacctgagtaaaagtcaaagttattattgtttacaggggcctgtgtggtcaacccatccttgcctctatgactttcacctcctgctcctttctgctatgctttcgttactactccagctatactggcctcttgcttttccttcagcattactaatatattcctcccttagagcctttgcactggtttttccctctgcttaaagcattcccctccccaccccacatttacatggctcccatcctcagctccttcaagtctttgctcaaatatcatcttcttgagacttctctaagcattctattgaaacctgtaaccttgcactgcctctgcccctttcctgctttatttctatctgttacatttatctatctgacatattatatatttaacttatatattttgtttattgtctgtctcctctactggaatgtactttccatgaagggcagggattttcatctattgatttactgatatattcccccagcacagtgcctggtacatagtagatgctcgataaatattgcttaaagtcaaaattaaatataattgctcacatgtatgtactgctttgattggcaaagtacattcacatcatatgtcatttgatcttcaaacaggacaaaagttgttattgttattcctattttctagatcaacagatttaatctctaagaagcaaaattattttcccagagctctcaggtactagcccagtggaagtccttagaagtttctctcaactcccacacatcttggcctcttcctatgggacacagactcaggacagcaatggaagttatttgtctttccagaaagtagggggtgatatgatcctgctttaaggagtttccaatccagccaacccaatcaaaccttttgttgacaatttgctggttccttatttttcaacaattattggtgctgaaggtaagtatttaaatgggagctatctccttttctcaccctataatcacgggcatcaaagggaagtggagaaagctgcatctagctggatcagaagacagtagtttagcccaggattgtgtaatctttaaaccaaaagctgtgaggagcgaatggtttatcagaaagaataccagactcagaattgggagtgctgggttcaggacctaccttggtcactaactgactggggaatctcagatgagtcttttcaccctagggcttgtaccccatctctaaattgcataggttggaggagctctttaagttctgtttggctcttactttttctctagttctgtaagatgtagatatgccctcactagagaaaaactgtgatagcgagccaggctacttctgcattttctgcttcttccttcttggtaccattggaagcatgtcttactcaagcatggatgtgttaacatggcataaaccactctttctgtaggttatgggagagctctaaacacttcctacttttgtacttgttgaaggggaaagggggaaaattatattcaatataaaaaaagtcacactatttattagaggacattctttttccctcctgggagcagaaagtgctttacaaacatttaagttataacacccttattttacaaatgaagaagtaggaaataaaggggtttttaattgaagttattcaatgaggtcagtaagagacataatcttttcaaatgagttctctgcagattacattcttctttctaaacccagacagtggtataaaataccttcagtttagttctagatcaccttgaccaacaattggtgatattgcctcttataaccttagaactcaaagtacaatcaaggaaactgaggcaagagtaagcagagctaacgatgctttataaagctgtcttgtctgctttctcttgaggaagataatctcagccatctgatacctatgaaataccttctgtcttcaaatgcctccagagaagctggcctagctttcctcactcactctgtattagtgatcataccattcactatcaagaaattcttccttaggcatgctgtagcttcaagtcatttccatttggtatattttaagcctgaggttttcaaacgtattagccatttgggttttcccttctgcaaattgcctatctcaatacatcccaatagtctttacatcttggcacatagaaaatgataacacattgtataagatagtaatatttgtacagtatcctaggataaaaatatgagtcagctagtcagcctaaaatgccaagcccaggggtttctgcctgccataggccctacctgtccattctgtctggacattctgtgctgtgttcctatactttgcccattttcatggagtttcttatgtttttttcttgctgatttgtaagagttccttgtatattctagatatgaactccttgtcaactttccatgttgcaggtatcttctttattctcttgtttttgaataacttttttacttcatttgaagaaagggtttcctatctcaaagagaggaagaaggaaataaaagaaaaccaccaatttgaacattctgcttctaacttacctttgatcatcaccagcatgggaagaactaattagcatttagttgacaaataactgagcagcaactatatgccaggtattctgttaaactttgaggatacggctgtgaataacaaccatggtcattatctcctaattttcttaaaaatgtcttcaagatgtttgtcaggtcgcctatcaggcctcaggttccaggcaaaaaaaaaaagacatatgaaacccctagaatgtcagaactgaaaggatccatggacatctttttcgatgtcttcattttagagacagagacactgaggtctaaactttttgtgagggcccttccctaaagaatttcctaaaccccagatgatccaggggctgtttggttcatcctattttctggtagtttctaggatcttttctggagatcttgggtattgtttatatcccatatcaaggcattacttctagatcaatgcactaggtctcaactcgtagatcagccctggtgggtttaagaacaaagtgaaatagatgggcagctttccttgctgttaccataacaatgccagagctaatttatgccagttgtgactgatttgataatacccacatttatcttagctactctctggcctgccttcccacccatgcccactttactcctaggagacagagattaggctctaggaaactgcctcccttgagccatagtaccctgttccctgttaccattcagatggggcgttcaaagcatacctggcagtaagagccacagaccccttttgttccccctgccctgtgacaggccttcaatgggccctgagtgttatctaagacaaacaaattttatgtcttccatcattcttcatgatgttgcttttcaggcccctccctaccctgctcactcccctctggctgtgtgctattttcttggtgttcctctgaaaagagggtggactcaaaatttaattctgctctcctgcagtggtatgactaccttccaattgcctctcccatttttgcctctcaatatatttcttcttttttctaactgaaaatggtattaggctttttgacaatcacatttcactgccaactcattttaaacttacataccttcaaaaatgagtgaatgagagtagacaagtattgattgaccccctaatctaccctctgttcaccactgatgtggaaaatttgatagccatcaggccagccaaaagaaggggataaaaaaagcaagactccagggagctaatcatttctcctggcctttctttttccagaaacttgtgtggtatagaggtcgagggtgaccctttggggttatccagctactcccatattcttatgtctcatcgcttatttttttgataagggcagtttacatctattatttgtaatctttagcaagtgactatcttagatactatggctgcaggagatcttgagaagacattgggtcttccctcctctttccttgataatatttcattccaggcagccttcttatagctgcattttcttttctttacactctctggcaaagacttttatcccatttttgatcatgaagacaattaaaaaacagcattagaggaagtttaaaaataggaacaaaaaccagccagaatccatcaactataacagaattatttgcacttttgcataatcccttcaaatctgtccatatgtgtatatatttacagagttgtaatcacactgatataccattttatgtcctactttttaacattgtatcataaacaattttccatgtttctacatggtcttcctaattatcattttaactgctatgtaatatttcatcaagctaaatgtaccagaatatatttataatctatcattggctttaaaaataagagttgataaaacattctaaggtcctaccatcctgtgggcattcttcctaatatatcccctgccataacatacataatataatagaaagaaaatgatttccttgagagtggcaataaataacatatttagggacttaggaagttggactgaattctttattcattgtcttttcctaagatcactctcttagttttatttctgttatattttatgctgatgttgacttctagtatcattgttgaattctggtgattttatggtgttttgtttcttccctgagacttttcaaataggagcagtggacacaactattaaatattttctgaactggcttctcagcagataaatgagctatctacgctgccctcttctgtctctcattgtggtcactcatcagtacctattgcttacccagaagtaatatgttgaatgtgccactgttactgttttcccccagctgtgctcctcagcctgccttagggaaaaaaaagtgggagaaggggtaaggaagccttcactcccatttaatgttgagatgatatgctcactgctctccctgctccattgtagctaagacacgtccagagatggtagggtgaaagagacagatagacaggcacacaggcacagaccaacccagacatactaggctctgggaattacatattaggtagggaagggcctacaggagtttattgccattccttctggtagtcaatgtaaaactttctagggaggcagaatttggggagcaacctctgtaaaggtagtggagccaaaagggtgttctgggaattttcttcctgatcaaaaattgcatatgaaagaatgcaggaaattttcaacatgtcagtcaatgagggcacaaatcattagttaaacagatgtcaacacaggcatagactattaatttgccaactatttaaagacacctactaattaatggctaaattggagagtgagaacagatatgggaaggggaagtgagatttgttgtagaggtcagtaaaagacattgaagccagggatgaggatcttcttggagtgtgcccagatgacctcattggtagctgtgttaagggagacaaagcgaggatagggacagggctatatgtggtaaatcagtccctgtaaaactcttccttaggggttcaacccttaagaaaagtgttaagataatttcacttagctttttgatgaaagcaaatgactataatttcttctcaccaagaacatttttatgtgttactgatttctaatgaggacagtaactatcaagtgaaaacctatgatagtaggttccaaatggaagatgcaatttagattggggctgtttttgtcctgacttaagtatgccttgagtctggtttatgttaccccaatgctttcttactagaccaagaatctctttcatcctttttttctctttcatcagtggttatctttattaatgtgttttatgtgtttagggcacatttatgtgtttaagacacatgtgttaggtgttaggacatattaacgtgttaggacacatttatttataaatatatatatatatgatatatttataaatttatatatatatatataaatttataaatgtgtcctaaacacctgttctgttaaaaacaccatgtccaggcacacataggcttgttggctgagctcatctaaatgatcactcctggccagctacctcagatagttgagaaatttgctttgagaaatggtttgacagatatttgcataatgtgaatagtatgaatgcattttcttaaagtatgtgaagacatgaatgtctaagaaaatattgtatgtgtactttgatgtacacaacagggaaagtctaaaatgataaacaactattattcctggttatttcctgacattaaagttcatgaggaaacttttttttgaagaaatggttttgttttgtcaatttctgttcccttgtgggaagtttttctgttctggcctctgttcccaattttttgtcaatgttattaagacctttggtttggtcctataaggaatagaactttagagatgtgaatggatccagctaaaccagtagctaataagacctgtgaaaatgtgctcaaccagcttcttggaaagggatatttgactttgggggtcttcttcatagaggatggagggaaaagactttggagtctttgcactcttaagacttttgctggcaacccagctttcctaattactcactgggggagtgacttccttctgtaaacctcagtttcctcatatgaaaaatgaaaataattattccatgcctacttcttgggaccaaaatgaggctcttaagtgcttaggaagtgtaaagccttctggaagtcagggacttcctcagcctaggctttttctttgtctacagggctatctgaagcagtgccggaagagaagggacatgttcagtgacgagcaactgaaggtaatctttgggaacattgaagatatctacagatttcagatgggctttgtgagagacctggagaaacagtataacaatgatgacccccacctcagcgagataggaccctgcttcctagagcacgtaagtatcttatccatttggggagggttttgagaggtgttaggaaacaatggaaggagcgtttgagctgtctggttctgttcagctcctttttcctgcagtggggaatgggttcctcttgggccttcattttgacccctggtctctagccaggaaacaaggacttagaaaagtgctgtgatttgccctataaatgttaagcatgtgtatgacctgctggttccattcccgaatgtatattccagagaaactcacagaagtccacaagggagcacatacaaggctgttgttgattgcatggcagtgtcgtatgtggtggagtaccattagaagcaacctaggattctccttctttaccattcccctcccctctccctttccttcttggcagttaccagtagaatttttcttcatcttcccttttttgtttctgttaagtttccatgagactcagtattttgggaggaattcaaaatattcactgcacagagaatcaaggaatctgagaaataacaaggaccatggttagtaagaaagtggtccctgcaagacatttatgggaagggcactggagaaggtgaagtgacaaaaataggaaaagaacacatggacttcgaggatggagctctgggaaacaggatagtgacgatttgagtcctgtatctgtagtgtctgtctgggttactttgggcaagtccttcatgggctttggtttgttcatctggaatgtgaggttacactgtatgatctctctggttctttgacatcatctgagtctcattcacaggtgacctagttgttttgacagcatgtttccccttttaataaagtatttatttttaaagatttaatatgtgcacttaatataaaattcaaatgacacacaaaagcatgcagctaaaaataagccttcttggaaatattcctgttttacttctgagactctgtgttggggtgggttccctaagatcactcttatgtttagtgatttggactcagaatatggttatattgaatgtggtttaggactcagaacatgtttatactcatagctatgatttattatagcaaaatgattcgaagtaaaatcagcaaaaggaaaaggcacacagggcaaagtgcagaggaaaccaggcacaagctttcaggagtccatcccccaatggagtcacacaggatgcacataaatcccctaggaatgagttgggacaacacatataaaatgttgtctgccaagaaaactcattagagactcagtgtccaaggttcttattgtgggctcatcatgtagacaccttctgcctagtgtgtactaaaattacagactcccagaaggaaagcaggtatttagcataaaccacattgtttgtacaggcagtctggacacagtgagccactcttatcagggaatagtgggggaaccctcttgagaaccaagtttcaagatgccagtcaaggggaaatatttccagcaggtttttctgagaacagcaatttcaggcctgatacgataactcttttctgtatggtatgtaaactcattcaaccattctagaaagcacctgggtagtatttataaatgttaaggatgtgtatgaccttctggttccattcttgaatgtatattccagagaaactctcacagaagtccacaagggagcacatacaaggctgttgttgattgcatggcagtgtcgtatgtgttggaataccattagaagcaacctaggtatttatcaccagggagatatataagtggatggggtttgcttattgtgaggtattatgtagcaacaaaccgaagactagatgtatgtaccttatagcaacatatatcagaaacatagtattgaatggggaaagtagaatatagaatagtggttctcaaccgggggctgccctgtacattgtaggatgtttaacagcattcctggtctctagccactagatgtctgtagcaatgccttgctacccagttgtgacaaccaaaaatgtctccagacattgacaaatgtcccctggggaaaaaaaagaatcacttatgttttgaaatgataacatacttttacctttaatctgttaatgcagtgaatttggattgaatgattttcatatgtgaaatgaacattgtattactgggatagaccccacttaaacactgtgtgttatctcttttaatgtattattttaccttttaaaattaattgtttacccttttattagttctagaatttcatttttatcagctttacgtagatataatttacatacaataagattcattcattttaagtgattttaagtgtatactttaaggagttttaacaaatgtatatagttgtgtaaccaccataataatcaaaatataggacatttctataactccacaaagtcctcttatctagacattgcaaacaatctgtgcccctactcctggctactggcaaacattgatctcctttttatttgaaattttgctttttctagaatgtcatatatgtgaaatcatacagtatataatcttttatgtttagcttctttcatttaacatagtgcctttgatatccatccatgctgttgcatatatctttcgtttatccttttttattgcttagtagcactccattgcatggatataccacctattcacaaattaatggatatttgagttgtctccagttttgaactctaatgcataaagctgctatgaacattctagtacaatattttttgagaatatatgttttcatttttcttggttaaggacttccagggttagggttgctaggtggcatggtagattttttagcttattagataatgccaaactattttccaaagtttctataccattttgcattttcactactaatacgtaagagttgaagttactccacatggtcatcaacacttgatattatcagtatttttttttttttttggagacagagtcttgcttcgttacccaggctggagtgcagtggtgcaatcttggcttgtagcaacctctgcctcccaggttcaagcaattctcctgcctcactgtcccaagtagctgggattacaggcatgtgccattacacccagctaatttttgtctttttagtagagatggggtttcaccatgttggccaggctggtctcaaactccttacctcaagtgatcttcccacctcggcctcccaaagtgctgactgggattataagcgtgagccatcgtgcctggccagtcactatttttttttttaattttcgccattctaacatgtaggtgtgtagtggtatctcattgtaattttaatttacatttccaatgtatagtgatgttgagcattttttcatgtgtttatttgccatctatataaaaactggtgaagtgtctattcatgtatttttcccgttttaagtgtattgtttgtttttttattgtttagttttgagagttcttttattaaaaattaatatgtaatttacttatttatggggtacatgtggttttttttttttttttttgagatggaatctcactctgtgacgcaggctggagtgcagtggtgctatctcagctcactgcaacttctgactcccgggttccagcaattctcctgcctcaacctcctgagtagctgggattacaggcatgtgctaccacgcccagctaatttttgcatttttttagtagagacggggtttcaccatattagctaggctcgtctggaactcctgacctcgtgatccatccaccttggcctcccaaattgctgggactacatgtggtgttttgatacatgaatacaatgtgtaatgattaaatcagggtaattgggatagccatcatctcaaacatttatcatttatttgtgttgggggcattccaaatcttctagctattttgaaacaagcaattaattattgttaactacaattgtttttataactattttgaaatatgccattaattattgttaactgctgtgatatcaaacactagaacttatttcttctatataactgtagttttatacccattaaacaacctctcttcatccttctctccccacaaccttcctaacttctggtaactactactatactctccacctccatgagatcaactttgatagcccctactcacatatgagtgaaaacatatgatatttgtctttctgtgcctggcttatttcagttgacataatgtcttccagttccacccatgttgctgcaaatgacaggattttctttttatagctcaataatattccattgtgtatatatagcaacatgttcttcatccattgatccatcagtgggcacttaggttgattccatatcttggctattttgaatagtgctgtgataaacaagggagtgcaaatatctcttctgacatattgatttttcttcttttggctatatacaatatatacccagcagtgggattgctggatcatatggtacttctgtgtttagttttccataccattttccataatggctgtactaatttacattccgatcagcagtgtatgagagttctctgttctctgcatcctcttcagcatttgttattttttgtctttttgataataaccattctaactgcggtgagatgatatgtccttgtgattttgatttgcatttccctgatgattaatgatgttgggcatttttcatatgcctattggccatttgtatgtcttcttttaagaaatgtctgttcagagcatttgcccacttttaaatcagattatttgtgtttttttgctattgagttgtttgagtcacttacatattttggctattaatgttttgtcagatggatagtttgcagatattttctctcattctgtatgttgttgcttcactctgttgattgtttcccttgctgtgcagaagctttttagcttgatataatcccatttgggtatttctgcttttgttatctgtgctttagaggtattactcaatagagtctttgtgcatatcaatgacctgaggcatttttccagtgttttattctagtagttttatagtttcaagtcttacgtttaagtcgttcatctattttgattttattttttcatatggtgagagataggggtctagttttattcttttgcatatggacatccagtttgtccaagaacataagttgaagaggctgtcctttctccaatatgtgttcttggtgtctttactgaaaatgaattggctgtaaatgcatgggtatattttgggattctctattctgttcaattggtctatgtgtctgtttttacttcagtaccatgcttttttggttactatagctttacagtgtattttgaagttaggtagtgtgatgcctccagctttgttctttttgctcgggattgctttggctattctgggtcttttgtgggtccatatgaaccttaggatttttttcccatttctgtggtgaatgtcattggtattttgatagagattgcatttaatctgtagattgcttttggtagtatattttagcaatattaatttaacaatattaatttaatattaattaattgcatttaatctataggttgctttaggcagtacattttaacaatattaattcttcccatccatcaatatgggatatctttccctttttgtgtgtagttgtcaatttttttcagcagtgctttttatttttattttagagatctttcacttctgtggttaaatttattcctatttttttttaaatcctgttttaaatgggattgcttttttggtttctttttcagattgttcactattggcaaacagaagtgcacctgctttttgtatgttgattttgtatcctgcaactttactgaatttgttgatcatttccagcatttcgtgtgtgtaggtagtctttaggtttttctaaatataagattatatcatctgctaacaaggataatttgatttcttccttttcaatatggataccctttatttcattctcttgcctaaattgctctggctagaacatgcagtactacactgaacataagtggtaaaagtgggcattcttgtcttggtctagatcttggaggaaaggcttttgatttttttcctgttcagtatgatgatagctgtgggtttgtgatatatggcttttattattttgatgcatgttccttctgtacccagtttgttgtctttttctcatggagggatcttgaattttatgaaatgctttttcagcatctattgaagtgatcatacaggttttgtccttggttctgttaatgtaatgtatcacgtttatttatttgcatatgttgaaccaaacttttgtccctgggatgagacccacttgatcatcgtgagtgatctttttaatgtgttgtttaattcagtttgctagtattttgtttggaatttttgcatctatgtttgccagtaatattggcctgtagttttctttttttgatgtgtttttgtctggtttgggtaccagggtaatgctggcctcatagaatgagtttgaagtattcctcctctttacttttttgaaataatttgcatagaattattatcagttcttttttaaatgtttggtggaattcagcagtgaaaccgtaaggtccttggcttttctttgatgagacactttttattactgttttgatcttgttacttgttattggtttgttcaggttttctatttattcatggttcaatcttggtacgtcatatgtatccaggaatttatccatttcttctaggttttccaatttgtttgcctgtagttgttcatattctctgtaatgatcctttgtatttttgtggtatcagttatattctcccttttcacctctgatttcatttatttgagtattctttttttcttagtctagctaaagatttgttgattttgagtatcttttcaaaaaaaacaacttttcatttcattgatcttttgtatttttcagccttaatttcatttatttctgctctggtgtttgttatttatttccttctactagctttgggtttggtttgttcttgccttcctaattctttgaagtgacttggtagattatttatttgaagactttctttttcttttttgatgaaagcttttattgccataaattttcctctttgtactgcttttgctttatttcataggctttagtatcttgtgttttcattttcatttgttttgagaaatttctattttttaaaagaattttgttatttacccactgatcattcaggagcaatgtatttaatttcggtgtatttgtacagtttcttaagtgctcttcttactgatttctagtgttgtttcattgtggtcagaaaagacacttgatattaatttgactttttaaaatttgttgagatttgtttatggcctaacatatggcctgttttcaagaatgttctatatgctgatgaggaaaatgtgtagtctccagcagttggatgatatgttctgttattttcagttacgtacatttggtctatagtacaactgaaatccagtatttctttgttgatatcttgtctggataatctgttcattgctgaaagtgagtgttgaagttccctattattatggtgttgtagtctgtctctctgtttaaatctactaatatttgttgtgtatatttgggtgctccagtgttgggtgcatgcgaatttataattgttatatcctgtagctgaattgacccatttattattatataatgacattctttgtcttttcttacagtttttgacctgaagtctgtttcgtatgatatatgtgtagccactgctgctcttttgtggtttctatttgtacgcagtatctttttccatcccttcacttttagtctctatgtgtcttattcactagaaattcacttaaagaagtgaacttcttgaaggcagcatatagttggatgctgttttttttaatccattcagccactctcttttaattggagaatttagtcccatttacattcaatgttatttttgaaaggtaaggacttactactgccattttgttattattttctgattgttttgtaactcctgtcttccattattttactactatcttcctttgttgtttagtgatttttctctggtggcatgtattaattatttgcttttgttagtgtatcttttacaggtttttgctttgatgttactgtggggcttagaacatcttattataaactgatgacaacttaactttgatcaaaagaaaaattaaaaactaaaatctctaaaatttaagtccattacttccccattttaactttttgttttctcagtttacatctttttatattgcctatcccttaataaattgcctttttgttttgttttgtttttgagatggagtcttgctctgtctcccaggctggagtgcagtggcacgatctcggctcactgcaacctctgcctcccgagttcaagcgattctcctatctcagcttcctgagtaggtgggattataggcacgtgccatcacactcagctaatttttgtattttttagtacagatggagtttcaccatgttggccaggctgaccttaataaattgtcattatttttgatagatttttttcagtcttcatactaaagttgtgaacggtttacacaccacaattcagtatttgtctgcatagtttattctgaatttgtctatatacgtttaccagtttattttataacttcaggtgttttcttgatacatattagtgttcttttaagattgaacaactggcttcagcagttcatgtaagacaaatcttctgttgatgaattccctcagcttctgtctgggaaagtctgtatctctccttcatgtttgaaggatggctctgctgggcacagtatgggaggtttttttgttgttgttgttttgtttttttcattcagtactttgaatatgttgcccccctccctcctgccctgtaggacttacactgaaaactctgttaccacaggaattgaaactcctttatatgttatttgcttcttttctcttgctgcttttaagatttccctctttgtctgttaacctttgagagtttgattattatatgccttagggtaatcttatttagattgaacatgtttggttgtctttaaccctgtacctggatatttatatctttctctaggtttggaaaagtctctgttattattactttgaataagctttctaccttttgttctttctcaacatcctctttaaagccaatgaccctttgacttgctcttttgaggctatcccctagatcttgttggcgttcttcatttttctcattattttttctcttcttattgtgtattttcaaatagtcttagggctcaccggttctttcttctgcttgatcaattctgttgttgagaccatcccatgtatttttcagtttgactattgtatttcttagctctaggatttctgtttaattttttaaaatttcaatttcattgttaaatttctgtaatacatttctgaattgcttttctgtgttacattggcattttctgagtttcctgaaaattgctattctgcattcttgatctgagagctcacacaacatcatctcattagggtcagtcactggctccttattttgtctatttgggaatgtcatggtttcctgtttgctctttctatggatatatgtctgtgcatttgcattgaaggattagttctttattccagtcttcactgtctggcttggtttggtctttcagaagtatgtctgtctagaggttttgtgcagagtgactatttagttcccttagcctgagatcactgcctccttttcaacactagatggcaccctgaacccagatttgacatagtctttctcaatttcagagtgctactcatcctggatggggaggaatcccaaagataccccagctctgtgggaaagctggatggaggtttgttcccagaggactgatgaagtgtgcttcctgcaacgtgatgctgttaaacagcctttctgatttggtgtcttttttgaggtcagatgaagggaagctggagtttcatgcactgggtgttgctaaccccacccccaccctctaactctagctgcctttgggattttttactctgcaggcattcaagaggcttcttacaggttgaggcaggaataatttttctggaaaggaatctaagatggtggggaagctagctgtccacttttattttttccagtattataggaaccttgattttgagggtgcctttctacacagtgcctggcagcttggggaaggagctattttaccttttgcttgcagtttttcagttctctgtggcctctgggattgtcacaacttcagtcattgagttctggaatattccttttgataatctgggcagtggctagttctttttggttttctgtggaggagagtaaagctacatatactgtgctattttggtgacattctcagttatgagaattatatattttgttaacaagtcctttgtcagataagttatttgcagacattatatcccagtctgtggcttagcctttcattttcttaactgtgtcttttctaagttgtgcatatttatggagtatgtgagaaatttttaacatatgtataatgcatagtgatcaagtcgggttttagggtacaatgcattttttttaagtatagtcatcctactctgctattgaacattgaatgtattccttctatcttatgtttgtaccctttaacccacttatcttcatgttctcccttctcacctgctcacacttccgtctctgttatttttccaccctctacctccatgtgttcaaattttttagcacccccaaataaatgagaacatgtgatatttgtctttttgtgcctggcttatttcacttaagacaatgacctctagtttcatctacgttgatgcaaatgacataatttcattctttttatggctgaatactattccattgtgtagaagtaccatattttctttatccattcatttgttgatggacacttagattgattccttatctttgctattatgaatgttgctgcggtaaatatgcaagtgccagtattcctttgatataatgatttattttctttaagtcaatacacagtaatgggattgctggattgaatggtaattcgatttttagttttaagagtatcttaattttattgaaatccagtttatcgctttattttattttatgggtcatactttttgtttcctactttctttgcctatctcaaaatcataacggttttctacttttttaaaaatagaagttatatagttttattttttacatttaggcctatgatcccttttgtggtaatttttatatatggcacaaaatacagatcaaggttaattggtttctgtatggatatttgttaaaaaatactgattcccctattgaattgcctgggcacctttgtcaaaaatcaattaagcatatatgtgcagatctatttttaggtatactcttctgttctagtgatctatatgactattcttgtaatagtaacccactttcttgattaatataggttcatagcaagtctttaaatcagatagcataactcctccaacttagttctttttcaaaacaattttagctattttaggttatttgtatttctatataaatttaagaataatcttgccaaattttaccaaaaacaagcaaacaaaaaccctatcagtgttttggttgggattgcattaaatctgtggatcagttttgggaacattgatatgatgagtcttcaaatccatgaacatttaactgtttatttcgatttttttgtgatttctcccaggattgttttttagttttcattgtatgattttgaccttttaaaatttgattgttttaaaaaatatttaaggtataaatttaagatgtacaatgtgatgttttgatataaatgatgaagtgatgactacagtcaaacagattaacatatcatctcacatagttacttttttgtggtaatagtatctaaaatttactctcttagcaaatttccagtgtataatacaataatgttgactctagtccccatgctgtaggttagatctctagacttttcctgtgtaactacaactttgtgccctttgacttatatcttcccattttctcccaccccctcacctctggtcaccaccatcctaatctgtttctatgtattcattttttttttccttttgattccacatataagtgaaatcatgcagtagttttctttctgtgactggattatttcatgtagcataatgtcctctaggttcctccatgttgtgacaaatgacataatctccttccctccttctttttaaagtctgaataatattctattctgtgtctctgtatgtatatgtaatatatatataaataaattaaaaatagaggtaatttattaaaatataggcaacatattacatatacatatacacccgacagtttctttacccatttatccattaatggacactttgtttgcttccacatcttggctattgttaatagtactgcaatgaacatgggagtgcagatatctttacaaggtagtgagtgcatttcctttgggcatatactcaaaagagggattactggataatttgataattctatttttgatttctttgggaacatcttaaaggtattattttccacagtggctgctgtaccaatatatattcctactaacagtgtacaagggtctccttttctctaaacccttgtcaacacttgttatgtcttatctttttgataatacccatcctaatagatgctaggttatttctcattgtggttttgatatgcattttcctgatgattaatgatgttgagcatcatcgtatacctgttggctatttttatgtcttttttggaggaatgtctattcaaattctttgctcatttcttaattagtttatttgtttatttgtttttttttgctgtgaagtgatgtgagttccttatatattttgaatattaaccactttatatattttatatatattaaccactttatgtatattttgaatattaaccactttacagtttgcaaatattttcactcagtctataggctacctttgcatgttgttgactttttttttctgcatagcagctttttaatttgatgcagtcccacttgtttctttttgcttttgttgcctgtgcttttggtgtcatataaaaaagcacagcagtagtgcttttagtagttttattatttcagctcttatgtttcagtctcttatgcattttgagttgatttttgtgtatggtctaaaatatgggcccaattttgttcttttgcatatagatatccagtttttccaacaacatttattgaagagactatacgttccccattgtgtcctgttggtgctcttgtcaaaaattagttcactatatttgcttcggtttatttctggactctctattctattacattggtatatctgtttttatgctagtaccatactgttttgatttccatagttttctaatattgtttgaaatcaaagagtgtgatgcctccagatttatttttatttctcagagttgctttggctatcaagggtctagtttggttccatagaaattttatatatgtttttgtctatttccatgaaaaatgccattggaatttagataggggttgtgttgaatctctatatcactttgagtagtagggacattttaacaatattggttcttccaatccttgcacatgggaaatctttctatttctttgtgtcttcttcagtttctttcatcagggtgttttggttttctgtgcacagatctttcaccttcttgaataaatgtattccttaagtatttcattctttttgatggtatcataaatatgattttttaaaatttctttttttgatacatcattataggtataaagagtgcaactgatttttgtacactgattttttttttgtatcctgcatctttactgaattcactttttctaacaggtttttttctttttaatttttggagggagtcttttgggctttctacatatataatcatcttatctccaaatagggctagtttacttctgatccaatttggatgcattttatttatttttcttatctgattgccatggttagtatttctagtactattttgaataaaattggcaagggtgggcatccttgtcttataccagatcttagaggaaaagctttccatttttcaccattgattatgatgttacctgtgggcatctcataaatggcctttcttatgctgaggaaatttttaatattaatacctaatttgtgaagatattttatcctgaaaggatgttgaactttgtgaaagctttttccacatctattgaaataaccgtgtggtttttaaattattccttttgctaatgtaatgtatcataataattgatttggatttgttaagccatacttgcatcccagggataaatcccacttggtcatgatgtatgatctttttgatatgttactgaattgggttagctactattttattgagaatctttatacctatgatcattagtgatactggcttgtagttttcttttcttcttttttttttttgacagagtctcgctctgtcacccaggctggagtgcagtggcgcaatgtcggctcactgcaagctccacctcctgggttcacgccattctcctgcctcggcctcccaagtagctgggactacaggcgcccgccaccacgcctggctaatttttttgtatttttattagagacggggtttcaccatgttagccaggatggtctcgatctcctgaccttgtgatctgcccacctcggcctcccaaagtgctaggattataggcgtgagccacagcgcctggcccttttcttgtatttctgtctgactttagaatcatttgggagtattccctttagttcttttatttatttatttatttatttatttatttatttatttattgaagagtttaagagggattgctactaattcttatctgggtatttggtagaattcagctgtgaagccatctggtcctatgatcttttgttgttaggagattttaaatgactacttcaatctctttatttgttaatgttcaggctctctatttcttcttgattcaatcttggtaggttttatatttctaggaatatattcatttcctctggtgtttccaagttgttgtcatataattgttcataatagtcccttgtaatccttttcatctctgagacatcttttgtaatatcttcatgttcatttctaattttatttacctatattctttttctctaaaaaccaagtcttagttttgttgatttttttccctaagtttttctgttctctgatttatatctgctttgatcttttatttttttccttctgctatctttgagtttactttgttcttctttttctagttccttgaggtggaatatcagattgtttatttcagattttttttaatgctatcaacgcccctcttagaactttttttgctgcatcccaaaggatttggtatgttgtgctttcaatttcatttgtctcaagatattttttaatttcccttttgattttttctttgacccatttgttattcagggatatgttgtttaatttctactgatttaagaatgttctagttttcttcctgttactgacttgtagttttatatcatcatgaccagaaaagatacttgatatgatgttgatcttcttaaatttgctaagacttattttgtggtatagcatgtggtctattctggacagtattccatgtgtgctttagaagaatttgtgtgatagcctgtctgcgtgggtcagctttggtaacatgtggtagtgagactagaatccctagtttgggaccctagggctgtttgcaggtacatgcatggtagctgtgctgggtcactgggccagagcatccaaggaggtagtacttgcttaagtacctagagaatgcaaaggctcctgtgctgagtccctttgccaaggcacctgtggtaggagtagctcaggcagctctgggcatgggggagggaaagctctggtggatcagggatctggagaatgtgaaagctgttggcctacatcaccccttcccactgggctatagtaaccacagcagcagttgggcagctctgggtggctccaggaagtagagaagaagaagggacatggctcaggcatgttttttgttgttgttgttgttgttgttgttgtttgtttgtttgttttttctcctaaaactcaaaaggaagaaaaaacaacccatggacccttagcagtataagctgcagggcgtctgctgatactatactagcagttggttttctcagcaggaaaagctgaaaaagcttctggggtctgtgactgtgaacactgaagaatcttgagaggtaaaatctacaggaggtacccagtggctatgagggctattgaggtccttgacagagaggcctactggggccctgtgccaaagaggccacggcagatcactgcgactcctgctactttgctgatactgatataaccaatccctattctttgctctctgctgtttccagacatctaggctatatctgtcttttcagagatctgggtgggatgaaactgaagctggtcattagggcagtgtcccataaagctggggaagctggttgtacactcctgtctcctccctgtatgtaggacacaagatccaagatccaagttgctgtttcataatgagcagtaccagctatggggacggggtgatgcaagcaaaatgaaactgtttttcctactcgttttgtgtatttgttttctgactttttctttcactatattgctgtggcttcttaagtggacccctaagcttttccagaattattttttgttcatggatagctaccaaattgttgttgtttgctgaagaaaggaaggcgatatttcctactctgccatcttactgacatcctctcctaaaagttgatttctaagtatttaaaattttttcggctgccattgtaagtggtattttaaaatgtcaatttcctatagtctattactattacacaggaatacggttgatttttgtacattgactttgtgtcctgacacataaccaaattcactaattggttccagtattttttttgtagatttcttaggattttatgcatatacaattatgtcatctctgaaaaaaagagtttaatttcttcttttttcagtctatattctgtctatttccttttttatcttatttcactggccgggatatacagtacggtgttaactagaaatggtgagaacaggcatctttgtcttgttttgatcttaggggcaagcattcaatattttaccaagtaattagcttaacgtttttcatgggtgtcctttattacattgtggtagtgtctttctatttctagtttgctgatgtctttgtcataaatttattttctcaaatgcttattcagcattattgaaacgatcatgtaatttttctcctttaatctgtcaatgtggtaaattacattgggataagtctgtcctgatcatggtatattattctttttatgtgctattttgcttgtttttcaacccttatataacaactctatcttgattttttgttgatcagtttctattgcctattgtttctcttgggttttataaatattttctattctaatgtatcaggttatcttttattaagtacttgtcaatatataataaaaattatagagtttttttaaaactttacttggaattaatttcaaacttatggaaaggttgaaaaataagaaccatacaaaaaatacccagattcccctgttgttaacattttaccattttgtcttatcatttgagtgtgctctccctctctctcctgactctctcctcttcccctctctttatgtacatatttatatgtccatacatacatatacacacactcatacatttttttctcagccattagtgttttaacttgcatacatcttagattccttacctctaaacacttcatcacattgtgtttccttagggacattttatggagataatatcaggctctggattgtgtgattccttcaaacagatatttatttatatttttagcttttccagctactctcagtggcagggtttgcctgcaacaacttagtctgtcattgccagaagtagagtcactgatctcttgctttttgtgatccagtcccagagttttatttccatgctgtgttttactcttattagggccagtgttcccttattacccttcttttacagaatgtccctactattcctatgtactcatttttctataagaaatttacagtcagtttgtcttgttactgaataatttgttttgatatttattattaaattatgaatcaatttaagaataattgactcattatcattttaatatttctgcctaagaatatgatctgtctttccattacttcaagacttcttttggggtccttggtagacttttcctttcctttttttcttttcccacagcaagatggattctggatatactctgagtattgtaacaaccacctggatgcttgcatggagctctccaaactgatgaaggacagccgctaccagcacttctttgaggcctgtcgcctcttgcagcagatgattgacattgctatcgatggtttccttttgactccagtgcagaagatctgcaagtatcccttacagttggctgagctcctaaagtatactgcccaagaccacaggtaagggatcgagggagtcaggagtgaatgagggaacttcctctatctgttggttctcattgagaatacatgtccttttgccctttctgagcttctgttaacttatctgcaaaacaggatgatacattcttgattgcctcatagccaacagggtacagaaggcagagctatcactggctttgttactcacacaaaaggagggtcctttgccactatatttgggttaaaatctgaaatctgcctagggctccagaaccactaaagcatataagatatgatttgttagagaagcagcatcaatccaaaaacgaacccaaagatgtaaaccaaaccaactggcccacacccatggctcatgcatctgggtctgaaagttagccccaaggagaccaagcaatggagctaaatcatacttgtggactgataatattcactaggtaaattatatatggcataattcatcttaaaagttccagaaaaaagtttttaagcatagctcaaagctatgttagtttcttaggccaaaacaacctcagagctttttgggggtttggtgggcaccaaaaagataggacattcgcctgggatttgccatttctgtacactttcaccttgtgactggaactcctgcttcaaagtcctcttgccatctaggtccctgattccctctcctctcaccccttgcgctccagagtgacagtagagtagctcaggcagtgtcaggcgacatcaatttctgccctttctcagagtgacccgttgggcccagcacaactcccacgacatagacaaccccttttggcaggtctcaggaatctgtattaagatgatggctcctgccatgcatgtcaagagtagctcggatttgaaggcaactaaaggctgatgccagcttggaagcttagtaagataggtgttcagataggtagggctgaaatacaggcagtcagaatggcccctgagggagaagattagatgaagaatgataaatagagaagaatactgactttgcttacagatgattgatataattccctaccctaccttccttaagttgatgagaatgaagactgcatgtaagagggaggctagctgacatgtctggaagtagaaaatctttgttctgttgttctccccaataagaggctgggcccagacctcatctgagggctttgaccagggttaggctggaccacagctattcctttcttctcctgccgactgctaaaactagtaggacaggttagagatgggcacattccccctctagccattttgagaaaggcagccagctaaagatggcaaaaataggcagtatgggacactgacagtgaggaatccatgactgagtagtcttggtgtagaggaaatgaacattgtcatgccaggactgcccagtagaactttctgcaacaatgcaaatagtctatatttgtgttattcaatatagtagttacccaccacatgtgactacttgagtactaagaaacatagctagtgcaactgaggaactaaattttaaattttacttaattttgattaaatatggctaatagctaccatgttggacagtacagctctgtgctttacttccaagaaagtggtttagagcactgatctcctcaaatcagagaaaggaaaggtacaggggcagaaaatgggtccaaagagcaggagcacttacttatgttagcagcttctgtgctgcaatcttcccttctgtcaccactctacctccttctaagtgtcaggctcagacatcttgccaaggagaaacttcggtgatgtcacagagcccaaaagatccccatacattggagcaactaactgtaaaagaatgaaatgtaacagaaacaaatgtagagtgtttccattgggtctaagataagaaataaatagctcacggacaggctgagagagatacagcttctagagtgtgttttgaagagacttaggaagtgttagttggccataagctcaatatgggtcagcaatgggatccagaagaaaaactgataatagctaacattcactgaggctcagaataaagacttttctaacatatttgtcttgagacagaatagactggttaggaagtatagtgaaaagcctttcactggaggtgataatgtaacattgtttgagagccatggctctgacaggtgtgcagatcacagattggagtgagggatgtgaactaggaggaggtactacgtaggatctgccctggcaattagaagtccctttcctctgcctttctttggtccatcaacccactattcaatgttgtgggtgtgcagttgtgcagttgtgcaaagatgtgcggttgttgcacatctatttttttctccttccttttttaaaaaatggtactgagagattaagcagactagtgaccacaaggcattttcagtttctctaaagaaaggtgttaacactgaactgtaaggcatcctcttgtcttctcagtttatttttgcccccactgaatggctgagatctcactatcaatctgcctttcccaagagccatttgattgcaaatcagaaaagaacagcagaaaaaaactggataggatatgtaactctcaacacgtctgctatccagagtcccaggatgtggggccaagggttacacgtctgagactaggggttttaagaggcatcccatgtgatggctctactacggaaatgtttgatttgtaataatagtactgctaacatttgttatatgccaagagtaaaatagtttacatggatgattgtatttaatttatgaaaccttcaataaactatacttttccccattttacagatgaggaaattgagtcaatgagagagggagtgaggcttgccaaaggccatactgctagtcagtgagaaaaactggcatttgatcccacaaagtctggcttcagactttatgctcttacccactgtgctacattctgtttctatattgtgcaaaagcaaacgtgaggatatttcagagtgattttgggcagaagctccatagaaatagatgatggaagagatgataaggtggtctatactgtgtcatgtgtgaggctcccttcttggtccttggctggctgtatcagataggacacaaaaaaagtgatgtaacaaaatagtggtccatttgtctctcatgtaaaagaagtatgtattctgaagtttatgactggtatggtggcctcatggtcatcagaaacatgagcaccctacagctatctactatcctatacctagggtattgaccttgtccttatggtccaagatggctaccagaggttcggccatcacatcaacattccaagcatcaggattgagtaaaggctaaagaagcgtatgctctctaccttaaaggtgatttctcagaaggcctacctgatagagcaggagcaccgtcatcttggacaaacactgccacttcaagttccagctccctttctagcctcatgcatttcaaggaaatcacttcttttctaactacaagcagccagaaagagcagacagtaagagagctcaggcacagaaggaggtaggggggaaagtctcttgagtaactgccaaacttcaccctcatacaatgggccccagtaaaacagtgggcgttaataaacacattccttttccttcaggtgcactaagatagagaagatgaaagcagactcaggggatatgcctgcagctgcaaaaagatgtatgggaacagacacacaactctctcttcccagataagcacaacaaagaggcgcaaaagcagtctatgcctctgataaagtctcccaccctgaatccttaaaaactcttagtctgtaagaaagtgtggctctgacctaactcggccagccgctcctctcaggtttatttaaaatcaacctgtccctgttgactgaaaagccatccttcatgtttctctcctctttctttaattcttacactacgcaacacttctatttacatatcagtgtacaaaacttacttgcatagtcatttttgctgaaacaaaagatagaaaatgtagtctttaggtggtgtgggttcccatctgaaaatcaggactctgttactaaggaggtagaggagagtggatgttaagattggcacctagcacattggttctttggcacattggttggttcaacttgcactcttttgttttcacagtgactacaggtatgtggcagctgctttggctgtcatgagaaatgtgactcagcagatcaacgaacgcaagcgacgtttagagaatattgacaagattgctcagtggcaggcttctgtcctagactgggaggtaggaaacttaccaaccagggtattgggaaatctgaatagcttggcaaaagcttcccatcttagctaaggacaggtgaagagaaattacatttgaagagcaacagtaaggatttagattagactcaaggtaaaatttcttgctaatgagaagtgttggatacttgaataactttctaagaagcttggagaaatttttgtgatgatacctcattaagaaatgaaaggttcatttcttcaggtattgccaaggaacaattagggttgattcagtagcctttcaaagctctttctggatttatgaccaacagattcacacttagataagaaatagtatatactaatttacttccagacacagaatacgaggttggttctcctgttcccaaccatgcaggacagccaacatacttttttttttatcggtgataccacctcaccctagcacatctattaggtctctctattaggcctgtacactataggccacaaccatcatccctgccaaatccacagttttcacatctgtttttaaaataatccctgattatttcattgcagacagccatgacttctctgaattctgaaagaccttcccttcctagatgcccaccaaaagtatcaggagtaatgacatttcacatatgtcttgcaggcccaggttgtgcaatctgatagtctgctggctaaaataaccaagataggagaggctggacgtgctactagggagggattagcaatcttaagccttgtggtcacaatatagaggtagggtctgctccctattccactgacctcaactcaagtgtcattttcagtgattaagaggtagtatttctcttaatacttaaagtattttagcccgttccaagggaaccaagcatcatcctcacaaacagctgcttaaccaaggcccagaaaaaagtcactttccttttattctgctacctctgtcctaccttaatgtagattgctgaaaaagaccacaattctgatcagctgacatccttttgggctatatttgaaggataatgttcccatataagtagaacagcactttgatttgcagagaaaggaatttgtctagatgaagagaccctcattctcttaagcagaagccagcactgggccagacttactagaaaattgtgggtccttttttccttgtgttggcattgctttggccatttgcctgattaaaggcagagagctggaccaaatgacttctagcaagcccatcaactctaagacactctaaaattaaggtggattagctggccttattctctctcgttggcagggttttttgtaagagaaggtgcccagcagcagttgtcttcctattccctggagcatctccccaacttcccaatgcctagaagactttctgattcccctgtgtgctctgggacatcagtccttggagcaggagccatggggaaccaaaaatagcatgaaattacctggcctactcagggagcttcagtagcaccaagctcaataacactgagctatgatttaaacactcagcatctcagaaggaatttcctgcatgtatgtctgaatggggccacaaaaacacagttctaacagtgtctgcctcctttattagcctgattgattggtactctaatctcatgtaagcccacacatcccttgtacgctcctgcttggtgaagcctttcttcatctaaattgacatcctacttcattcaggctgctataacaaaataccatagactgggtggcttataaacaacagaaatttatttctcataattgtggaagctgggaagtccaagatcaaggaaccagtagattcagtgcctggtgagggccctcttcatagactgttgtcttctcattgtaacctcacatggcagaaaggatgagagaactctttggggtctcttttatgaatgctattcccatttaattcatgactgcctcattctcatgaccatcatcccccaaggccttacctccaaataccatcacagtagagattatgtttcaacatgtgaattttatggggatacaaacattcagcctatagcaatttgtaagaagaaaaattcttcatggtcttcttgtcagactgaggtcactgtggaacttgccagttccagcgaagttgtcctctaggaagtcttttctctagtaaagcctgatggatatatttcaaaggccaagcctaaagtttctgtcatatttgccatacctgtgttaaagacttctagaatgtcagaatcaccaaggctcttagaggactccccctacaaccctgacgattcttgtgtgtatacacatgcacatatgcacatgtacacatactctcacacacttactctcaaacaccttgcaatgatggtgaaagacagagaagcagagagaggtttatttcctaccaaggccacacagcaagtcagtgacaaagctggaacttgaatctagtcccctgattccttgtgtggtattgttttcagtaaggtaccacatattccttcaaccttctgcctctcacagcccaattgctgttctttgtgatatttcagcgacttgctttttgtatgtagtaaagagtttatatttaaataagacagtgagactaccttggggaggtcatccaaatcccagtcaggtggtgggtgagtgctggggagtctccccaagaaagcaatgagacatggatgctccatggcttgatgatggttaggattggtggcccaatttcacaggttccctggtataggttctttgtgcattccacctgcccaagaagttgtctaggcaaggagagacattctgccagattgccgaggactgctgtgaacagaccgtgcaaatcaagaaaaagatgccatattttgctgtctctgccaccccccttgtctcccagatgtttgaacaaacagagtggctgtcaaaagcatctgcatgataatttcagcttcatttgtcaaatgaaaaagaggagtcataggggaaaccttcagagcttaatctcccttgaagaggaatttggagggtagcatgcaggcaattagtgtctgctcaatagatcagagtgtctggctagagagcaggaagccctgcattatatcaaggcctgacccttctcttagcttattccgtgaacattcttggtctctttgcccaactctggttattatccctgccctctaccattctatagggactagagttcctgaagtaactttccttttaccccaccccccagggctcctgaaaatcaaatggatgagtaaaagtgtcagtcatctctctactaatcaatacattagagcagtatgcgggagcagcagggagaataatctgttcccagggactgcagtttctgggaaatttctatttctaatttccatgatgctgaggtttggttgagctgtcactttgccaccttgcacactcatttaatccacttgaaaacaagggaaaggtaacatatcctggatagcttctttttaatctttttttttttctggagatttgtagcaggaacctaacattgtagctcatatttgggagcttgattgtgtgtggttgtaatttcctctttgtgggatccctctcctcccagcctggttgtgtaatacccaaggacctgttccactttgctatttgatgactgaatccaaagaagttggaggaaacaagaaaacccaacatgatgaaggcagcaaaagcatctacttaaaagctaaagtggcttgatgaggcatactcctgggacaagaagatcaaatgtagggctagatggatttgttactcctctgccttcctgtcagtaggcagcattgaaaataaactagttaaaaagtatggcattccccttgtcctttccctggatctgctcagattacagccccacatcaattggcctataattagaatggggtgaaatcaggcagaatggggtgaattagaattagaatggggtgaggcctcttcgctcgggctctgaccccaaggaaggaaggtagataagctggcaagaaagctttgggtagtttttggtggccactgttcattccacacctattgatttagttgtcaaacagtatttattgagtatttaaatatcaagtactctgtgtcagaccttattctaggttctgcaaagacatcagtgaacatgacaaagtttccactctcattgatttatattccagtagggaaaagaggcaacaaacaaacatatatcatcaggtagatgggcctctgaagaaaaataaagtaggataacaggttagggagtaatgtggatactacctgaggaagtaacagttaagaacagacctgaaggagaggaaggagcaaaccatgtggttttcttggggcacagaattccagacagaggggaaaacaaacacgaagaccctgaaatataggagtgtgtgctaaaggaacaacacggaagccagtgttgttactctacccagagtagagtaagtgagtgagagagtgggagcaaatgaagttagggaggtgactggaggtcagatcctgtcttcataagactgactgttagtttgagtgagatgggagccactggagggtttttgagcaaatacgtgaaattatgagacttatgttttgaacatttcccctcatatgccaggccctatgctgggcaatgaggatattgagatcaatgagatgtggccttgaacatctagtgcggacaaacatattccagcagagggaacagtgtgagcaaaatcctggagggagtgaacagatccaaaggcccacggttggggatttttggaaggagttgtacttttgggggcaagacaaagagatgtgttatataagtggagcagaggaagcaagggtgagatctctaaacaatgagagggctgtctcctttccatgaactcatttgacgctctcaaacagccatgtgaagtgggtcaaacaggaactgttttaatattccccctctacaaatgaggaaacagatggcgagagtttaagctagtttctaactcaagagtgagttggtagcagcattggactcagagcccaggtcttttgagattctcaccttagaaatcttccatggcatctggttgttcccctgggttggtgacagtaggaggagattgggtgggggccatcattctaatgtggtttggtggataagagcataggctttggagggcttctgacctaggttctgcccctttgggcaaattacttccaatttctttgaccctggttttggggtaataacaaaacatcacttactgggttgctatattactaggagacaggataggtatggaaactggggcacacagtaatagtcaagaaaataagtatcacttatgttgagcttatagtgtgatgtgtaccttctaggcactttatatgttttaatttaaataatcctcacaacacccaaatgaagttggtactgttattatccccatgttaatgatgaggcaactgagttatagagagactacgtgtgttgctcaaggttagtcagcttggtgagcatagaggagtattattttaattttttttctaattggtggagttacatgttgcaagtaattaaaatataattgatgctgggcaccgtggctaacatctgtaattccagcactttgggaggctgaggtcggtggatcgcttgaggtcaggagtttgagaccagcctggccaacatagcaaaaaatcatctctactaaaaatataaaaattagctgggcatggtgtcacacacatgcctgtaatgccagctacttgggaggctgagacacaagtatcgcttgaggccaggaggcagagtttgcagtgagccgagatcgtgccactatactgcagcctgggcaacagagggagactctgtctcaaaaaagaaaaaaaaaaatgtagaattgagatgcccctggctggtggagtggatggaccagataatactgggtagccctcctggtcgtatcatccacatttagtaaattgtatatttaaaagtcattctgaccatcttcttatggcattggctctcttttatggctttattggacttcatacatattcaaagtggactgtagcacatcttcctagcctgcatcagggtgggaacctctctcagcttcccatccctccagcaggaaatcgctgtactgctccctaacctggtggctttctttcccagtatcaggcctccagaggttctgtgctagtatgtcagcccctctagaaggagtgtttacctagttcctggataatattgaggctaagtcgggagcctaaagttgaagcagtatttctaagctttttttcggcagtggggtggggggttctattattagaaaataattctactgagttccccctttccttcccatcctttagactggggaaaaaaatggtatgctcgaatacaccatttctagatgccccactctctggcctactaccctgcctgatttgtgtttgcctctgattatttctgggaggtataaaggtctccatctctaaccttgccttgaagcttttgggtgaaaggctgagatcttagcatcaaggtatcagccctatcatgaagatcatcctcatactacatctgggaaaactgacacctagagagagaggaaggaacgggttctccaatgcctttttggcctaaagacagtataatatagtacaaggagtgagcatattctatggagccccagaggttggagttgggtcatggacctgtagctaactagttgggcaactttggcttatcacttgatctttttgtacctctaactgtaaaatgggagcaagaatatctacttcccagggctatcgcgagtctcagataagatagattgaaaatatctggcgcactgtctgactcatataggtgctcaggaaatattaattcttctgtgtcttgggacactactctttgtccctatcttcacataggccctggaatactcacccctgtgcccacaacttcggtgttggtttgccttgtgtttcatgagttttgagcatacctgcattcgtctcctccatgaagacataagctccttgaggacaggggccaggtctaccttgacatctgacacacacctgcaacatacttctgacctatcagagttgccataaagaaggagtaggacttggaaactctgtagaattgaattagctaggacttaggtgtcttggtgcctatttgtgtcagactctttgtagcaaggaggataagtagttctaggctttctggataacagaccaaggaatcatgtggcagttaagtttcttattcaatcagtagattttagtgaactgagaggagaaggaaaaacaattataagaggggagtgggttctttttctctccctctgttatcatcttccttcttgtcctcccgtttccttctactcatgtgggaggcagtgagattaaggcctgttcttcaagtattagaaagagactgagggaccagagcagggattgagagactgggacagaaaaagagatttatagagaagagagatggagaaatatatatatgtgtgtgtgtgtgtgtgtgtgtgtgtgtgtgtgtatgtatatatatatgtgtgtatgtgtgtgtgtgtgtatatatatatatataaagaaaatctctctctctctctttctccacacacatatatatgtgtgtatgtagagagagagagagagagagagaggcagacacagagagagacagacagacagagaacttataggaccagagggtaactggtgtagaaaagctgtagcagtcccgggtggcagggcacatttggccttggggtgaataagaaaatgggtcttcctagctcacagagctgtaaagctttttgaggagtcccaggagtccctctctccctctgtctctaccaggccctttctggcctcttcctatcccagtctatgcccagccttgggtgcctccaggcaggtgatggtgccatccttctgcctggctgcctctcatcatcacatgtccttcccagggcgaggacatcctagacaggagctcggagctgatctacactggggagatggcctggatctaccagccctacggccgcaaccagcagcgggtcttcttcctgtttgaccaccagatggtcctctgcaagaaggtaaccctgcccccttcttccctgagggagatgggtacctaacagggtaccggaccctcctcttcatcatccccaggctcccaacaaagtgggcaaatactgatggggggaaaacagacaggagattggcagcaattctgtatcaggaacactaatgtggcatgaatgtcacaggcagggttggcttgtgggcagtgaaaaactctgaagtcggtgcattttgtcttggtattttttttaccctttgccctaatgaccctggggtgctccttctcactttcttctacccagagctgctggtctgcaccatttgtaaaaaatattgaaatatgtctatcttagttggtaaatagtagtttccctgagcactttccctcatttccactctaatggctctggccatgtggcccctctctgccctgggaaccaacgaggagcctcctacttttgccctgacaggtaggtacctttgtgatataggaattttttccatgcctctacctatttcctatacaaggtgcactggttccccacaacccccaaccgtgctcttctccactcttccttctttgtaatccattagaggagaggtcttactcttgtcactgactctggataactctgtgtatgttggtttctaggactcttctcctttgtgaggctgggaagggtagcatatgttctaagcgtcactcctccttatgggatactcttacccctacttcctcactcacagtagagagttcagaccagttttggctccaggggctaactgggaagaattggggaccaaggaaagtaaaaatggaagaagaaaccagaatgcttagagtgactttacaaattcaccatgctaccctttgctcttttgccatcatctagtccctttgtcctctccttcacccagtagtgaatgcctctgaagaggagtgctgagtcacaaaacaccagagtaaatagtgttacatttttctgggctggaacatgaaccacacagttttaagccccctgtcctctgtgtgtgtatgtgtgtgccatatcttgtattgaatctttatccatttgctttgacagtggattgaggggaaaaacactgagcttaggttcagactgcctcagtgtttggtgataagctctgaatgtccactctagaaccaatagccagtcagttaatggggataataacttacctcagtatggagctaaccctcaaacagagaacttttatgaatctgaaactcagccaaacactaatgcttctttttagctcccccaactcttctcaggactttcataaaatcaggaggtaggatttttgagggttaatttaggtggccatggaaattctcagcatatcagccatgtcaccaacactaatgtgcctgttcttcccactaaggtgtttacactcagaacaagtagccatagaggcagtaaacaaataggaacctggcttattttatagttctgcaccccctaggccctgttaattttggcatctgttagccaaggctgggattactttaactaaattgtgaaactaggctctagaaagcagtggctataagagatagaccaggatccagaacataaaacagtgagtcagaagccaggaataaaggggaagaaacaagataaacaatgggtttaacttagaactcaacgggcagtggaagaccaagatggagtaatgagccatgtctaagccagatagtgggagccaatgattaggaagaaactagaagtcaagccagggctggggattcaaaccagctaagctggcagggtaggggaagcatataacagggatggtgaaaacaagagaaacctcgaagcagtcatagcttcccacagaagggagctttcttgttttcacaagaaccataggctttcttcccaagacacagccagcctagagtctggagtataaaggctaccaactccatatacctgggtgttcttgacactggcttcccagaacacgagcagttatagcctaattgttcaaaggccattaaaactacctgatgtttgttttgaagatttccatttgttatctacaataagactttccattcaacaagtagggataaacttttgaaaaatgatcatgggaccaaaagaaggtatgcagagagacaaggtattttgtctgctgggttgtttagggaccttttgccattactacaaaagactctcttcttgagatagagctgggaggaatggactaggctctctggaggtgaaaattcctttgacaaagagaatccatggaggaaaggaagggaatgtctggattgggccaaggtgagtgaggctgtcaccttgttcacctcaggcacacaatttaattggatgtccgaaagttcagtaatcctttttaccaggaagaaaggaggtgaggatgctaaataatgaaatatggccacattaagctttctgatgatctcatatttaaaaaggaggaaacaaagacccctaggaagtggctaaataatatataatattttacatatgatataatatttaacaggggtgacaaaagagtttcatgaatcctagaatgagtcaaaattagtttttaaaaatgcttaattttaattacttttaaagctatgttcaaatgaagaaaaaagaagtgatagtctgacaaccccctgtttgaggcagatggtttactgataacaggggaatataaattccttctctatcaaggaaaagaagtcataaacttgtttcaaagggaattgaagcccaaaggatctgaggttgtaagagagtactttactgctctgaattctttcatgctatagatattgagcccctcttctgtgccaaccagctctactttcataaggattctagtctaacagaacttaagtatgatgttatttaaaaatatatacatcccagagcactgaaataattctatgatgtcccaagtggaattgctctaggtcatcttgacagaattatgggttccaggagatctgtgagaagactacacataggaaaatgtaccagttttcaaagcagaaaataatatgttctagaaagtagaaatcaacaataaagtattaatgaactagcatttattgagtgcttctatgattctgttctaagaactttacacttattaactcaatttaatcctcacaacaaacctatgaggtaggtactattattatattatttccatgttaaggatatgtaaagtgagacctagataagttatataattttcccaaggtgaaatagctaatgagtgatagagccaggaattacattcagatacgctggctccagattccacattggtaatatttatgtcattattaccattgagcttgtcaaaattctgtacttgattattaaacagcctgtgaacatttagaaagagatacagtggccacaggggtcatctttggctttctgagaacaagtcatatcctataaaactcagtttctattttgccagtaacttaattagttaataggaggattgcacaggacagagagtgtcctcctgcatttcagattttcccatggtttccttgcagacagaagtcatatggagtgatagataaaacataaagtttgtaatcagacaattctgggctcaaatcctgatttcaacactcgctaactatatgatttcaagcaagtgactttttccttcttgtacctccattatatcagttgtgaatggtgagaataactattctacaggattgtcatgaagattaaatggaatcaatgcatataaaatgcctgatagagtgcctggtactcattaatctcatcttacccaacctccaacaaagaaatagacagccttataaagtagtgaggtccccatcactagatgtacccaaatatgggctagattattatgtgccaaagatagtatagtaaacattgaaacactgatctctctccatgagcatgtggcctcaccactaagttctcatccaactgttaagattcccttaattcccagtcaattatgcaacaatgtgcctgttttgtacattgggaattgggattgactaatccactcagaacagcttaaacaacttatgcagcttgtagcttgtttcagagagagagagagagagagagagagaaaaggagagcaagagagtacgtgggcatgtgtgaaggtacctttaaaatggcaattatagtgtgtgggaaagtcaccagtggcttctaattatgtgaccccttctttaatttttgctgtcaccactcttttaacttttcttccaaaaaatccagataagactctgttctttttcttcgtattatctatactgtcagtctctgctcctctgtgtttcattgaatttttattttagtttttgatgtgttttattattttcttcgtgatataattatttgggaaattattttgatgctttgaggggatttttttctctttgactatttactgtggaaaggagcagatccgcttttcctgcaccctctgtcctattgtgccagtctggccatgttctgttgtcccttgtgtcataactgttctttattcctgttgctttcaccatattcaaggggatcagaactaaacaacgtgtaatgatgttgggcagaagacttctgttcagggaagtttctgcatttggacaatttcttcttgcactgaagggtcagacttggaggatgagctatttgggacagcttataaatccaataatagcaacagagatggggctggagcagaaagaagaaggggatttgaaaccagaactcctgagtacttaactttactctgtctcttaactaacttttctaaccattggccagttctttaactttgtccttattttcctcagtgtcaaatcaggctgatgatagaagtcatctcaagaggctttgggagagaaccacctgaggtagtggggaacagtggagtatggggttaagagcatgggtgctagggccagactagaaggcaatctcctttcgcccatgagctatatgaccttgggcaaactttctgtgcttataattatgcccttgtttgcaaaatgagaatgacagtgtatctacaaggaagggaagttgtgagggttaaatgagacaatgcagatgtagtacctggcacatagtaggtacttagtgaatgttggctattaatactattactatatatgcagtgttactaataattcattcagtacttttttatttagaggcaatatagcacattgtaaacaaaagcagagattttagagctggacagcctgaacccaaagccaagctctgccatttagtagcttttattcctggaaaaatttctgttttttcttccaatttttattttagctttagggggtgcatattcaaatttgttacgtaggtaaattgcatgttgccgggttttggtacacaaatgatttcatcacgcaggtaatgaacatagtaccaataggtggttttttattcccaccctcctcccaccttccaccctcaagtaaaccccagtgtctgttgtttccttctttgtgtccctgtgtactcaatatttagctccctcttgtaagcgagaacatgcggtatttggttttctgttcctgtgttaatttgcttaggataatggcctccagttccatccatgttgttgcaaaaggcatgatttcatttattttgatggctttgtggcattttatggtgtatatgtaccacattttctttatccagtctatcattgatcatcatttaggctgactccgtgtatttgctactgtgaaaagtgctgcagtgaacatacgcgtgcatgtgtctttgtggtagaacgatttatattcctttgggtacatacccgataatgggattgctgggtcaaaaggtagttcttttttaagttatttaagaaatatccaaactgctttctatcatggctgtactaatttacattcccaccagcagtgtataagcattctattcctgagaaagcttcttagctgctctatgtctatagttcctcatcagatggggttataacagtacctacattggaggattatttaggttaataaatgcagagcatttaggacagtacatggtacataatatatgctatttaaggggtcactgttgctattattgttgttcttattattttgatgtaattattaagcatgcattctaggatgctggaatatagtagtgagcgaaataaatccagtccaaaccccatgtaccttccctaggatctggagagaaaaggctagagaagagtaactagggtcccctctataaaggggcagggaggaccttatttacaaacaagtgaagcaggctacaatcctgaacagttacattccccagattgcagcatctgtcatttgtagagaatatcctgcaatgtcttactaaggaggaactagctcccttaatgtctcccaattcagacgagcacaaggaaaaaggaggaaggctggcattttattggaaatgataaacttcattaggcaggaaagttgtgatgatccaaatagcatctgttttgagcacctgctcaccgtgtccctgtgaaggcactcagactaccattaacaagtggcatatgggcagcctggttccaacaagaccacaggcaaccagggttcaagaggactttgtccccttgccatgtgcagaggacaaccagaggaaactctggggctttgtcagctgctcttctctggacaatccctaagtgaagcaagaccaaagaagatagagtgctgggcacagcctttaatgggcaggcaaactaaaagctgtgagcagcatggtggctaagtgccaagtgtgtggtatgtcagggccttcacaattggtgtcagaatttggagaaggggagccacatcagcttgagcagtcagagaaagtttatttcaggaataagaatgtgtaagtttgacctcgaaggctaagattggaataggaagcatagttgggccagagagcagctattagtgtgaccccaaatatatatctgttattttggtgacaaataccaccctgtcctgaaaggatgtatagaatttccagggacagtggggcagctatgtaaattgaaaaaatattcagagttacccttgctttgacttatttttactcacaatatttaaattatttggaaagtttaaatgagctaaaggaggtagtgagatgtttttcctttaagtttatcaaaagagggttttaaggactatgaaacactggcccaggagcaagaaagctcagggctgtatttggtggacaagtctggcctcatgtcctggaaatgacatgtttatattagagctttatagctattttacagagtaaggataactgtcttcatttcttagttgaggaaattggggctcagagaggttaactggcttgtccgtaaccatacagctggtaggttaggcagcaaggcatcaaactcagggcttcagactctacatcatgctctttcttttgttccatgctgcttactgcttatagtcttagctactctttctgattggagttcctcaactagtaggtcattcttaattattcctatcacatctttacatttggcttatgacaaatctagcgcctgaaaactcacatttaaccctctgggggaccagggagaacaggcaaagggataattttagtaacacatctctctagccctgtttccccaccacagaagcagaaattctctctagcttcttgtcatccttacatatctaaagaaacaataggagattcaattgatgcttttaatgtagctccaagatcatgcatattctttctatttttgggaactagcaaatgtgttgaaagctctcaatgactatgacacaccaactcggaatgggggcggagcggaaggaggctgcggactgaagttagcaacaaggaagttgaggctgcctgttttaggcaatgtggtccggtgagaatgtgtggttcagatctggctttccaggtttgtatgtattatattatgtatggtaaggcacaattcaaacctttctgagatcgagataaattacattcatacattctgcctagcttatcctgcttttgtacttagattagcctgatagggcccactttttatacatgtgtctcaaaaagtgttcctgagaattgtggaactcagtgtatgggaatcactctatccttttggccaggattgagcttgtgcacactgaacatggtaaaaggaacccaggttctgaaataggcttggggcaacattggccctctctgtatagctgaactcttcctctcctgtgaacttgatcctggggacaaccaatagatcagaatccatctatattcttttcttatttatatgaacaatcattatgggaggaaaaaagtaacatgattgttattttttcaaaagcaattcaacgacatctgtattttccagcctgggcctttgaggttgacagagctatgctgggaaaccttgctatgctgggaatcctgcaaggtagcctttcccagcccaactgaaaatctcagtataccgcacaatgtgaagagttaggattgggaatgtgagtgggcaaaagaagatccttcatagggagcacacagctgagaagtgagtcaagttaggcaattcagtagaatggaaatggtttaattgaactgtaaaatgctaataaaaattaatgagcatttctgactctgtccagctgactgaaagagcagataaagcagagaggagggagagctggcccgaagatatctgtcaggacaggactcataggggccttcctcaacctgactcagccataccacatctcccagcagtggatgtgttctcagaggaggctgagggcagcgccaagaggaggaggggctgaaaggccactccaagatatttataagatctgacattccataggcctatatgtcatttcttccatccctctattttcctttttaacttatgaaatatttgacattcaaaaagatataaaaataatataatgagtacccacgtgtttactatccgcattaagaaataattcattacaaatagttttccttcccaccctctcttctgcttctttttcttccccttcctctcttgcccctccccgttttctgctctgtactgtctggaacgtggcatatatcattgtcacttatttctttataattttctacatacatatgtatctttaaacattatgtggcatttttttgtatgtttttcaaggtaacagatacagatgaggtaaaactatatagaaaggaaaccatggaaatgatgaacataggatttaggatggaggatgccttggagttgtaactttgggattggtggcagattcaccagtactttatattattaaaataagtaagtaaatgaataaatagagaaataaaaatgccatgcatggaccaattatgagtgtctcatggactagggttaggattaatccaattttgtgtctatgagagcaaaacaacaataacaaataggcgacatactgtttgtatccatctacaacttctgtttttctccataagatttgtgacattcatctgtgttgatatgtgaacttctttatttaattttacctccatttctcttggcagactgggccttttctaaaaatccccagagtgctaagtgttagaccccccctaggtaatcctttgccagcagtctgtggcctcctagctactcttactactcagtccccctctgatgttcaggtctcactggcctgcacagatatttgaacacactccaggcaaccagccagctcatttcatacctctagtgggcttgctgatgttttcgaaaaggagaagcccttgctagccgtgtttatgtggcttactgtttcctacctcccatcagcagacttgcacacacgtccaaggattgattctggtgtctgaaatgatctttcgaggtgagacagaggctttttctttgggcatctagttaaccaacctgtcagtgtcagactactagtataacctggccaaatttagaacaaaccaacccccattggtacttcaaaacggtgacagtgttagcattctgctgtgcccctgtgccaactcttctagtactcgccgtgcacataccttcaagaaacctcttccttcccatctaggacctaatccggagagacatcctgtactacaaaggccgcattgacatggataaatatgaggtagttgacattgaggatggcagagatgatgacttcaatgtcagcatgaagaatgcctttaagcttcacaacaaggagactgaggagatacatctgttctttgccaagaagctggaggaaaaaatacgctggctcagggctttcagagaagagaggaaaatggtacaggaagatgaaaaaattggtaagtgacctgagagtagaaagaagaacatggctatgaagaacataggaggtttgaattggtttccattttcttggagtcagagggaagatttctgttgcaaactgacttaagctactttggtggttccttattattaggttctttttggtaagtaccaatagcttccattagtcagtggtaggtttgaactataggttgtcctcccctactagctaagaatatcacactgaaagccagcctcaggcttgattctcccaaacatacatttattagcaaataaacaaaaatcagttatacaacctgttctgtaatcttcataaagcctgagctctctgtcattaggtatatagtttgtactcctgattaggatacttcagatgttaactaaatccccctagactgtagattcaaataatatgcacatacacttcacactttctgtgtggaagtatttaaagtaaattatagaaaatataacaggacttaaaaccatgaccattttcatgatttcaaatcacactgaaacatacttttttgccttacaataagttgtttctcttttccagtggggatatagatagtagagatatttttcatgttgcttcccaactgtgggatttagacgccattggctatagctttgtgacttataaagtactgtctggtctcttgctcatggtcctgcctttctgtcataaaaaataccaagcaaccagacttgttaattccctgagaagacatacagtttctgtctttgccctattgcttatgggagtgaaattgtactttagaaggcctgaaagctcaagtttatggaaattgtctctagaaaaatgggcctactcattgaatcctggtgcaaaagggttctcttatccttccatgtgggcgattgaaattatccagaggtaagaaaggatggtcagaaagacaaatctaactccagtcttctcctcagaacttgggtagagtgcaaattaataactcactttgagtctcattggaatcagactgctttcagtatgtggacactccattgggacatgatgtggagtggcatataaatgttgctggctacttctctcaatagcaagcagcagcagccactgaccttgcctaggctgttagagttattaaaggaatggtcttagtgttcagaccctgaatcaattagaaggcccctgccattcccattggctctaacacaatgtctcccacacaatgccctaataaacctgtgactttatctgcttctaatagaaaagcttctagaaattactttctgaacaggcatatgttcatctttaaaaatgttgaggttttttttttttggtttgataataacagtaaatcacttccattgtaggaaatttagggaaaaagcaacagaaaagtacaagaaaaaaaaaaaacacatgaacatactcagtaataactttcataaacattttgatatatatttccagccttttttatgtgtctaattagaaaaatcaaggtgactgaatcttttttctttctctccccatacctgcctctctatagtggatagatataattttgtatcctcattttcactcatcattatatcattagcatttctatcagatcacttcatatttttaatcattattttatgagggtcatatagttttatcatagcttttttaaacttttactttttaattataaaattaatgcatgaccattataaccatttaaacaaatatggaaatatataaagaaaacttagcattccttccccttctctgtcacttccatactgaatgaaataaccagtgttaacagtgcagtatgcatctttccatacttatctcatgtccatataaacatatacaaacataatacttttatatttacaaaaattatattatatatattaccttgtaggttgcttttttaaacttaatttatcataagtaactccccagataaataatatagaatctaactataaccccttgtatcagttagggttcaaccaaagaggcataacctgtaggagatatatcataccactgctgaaaattgcattacaaggaattggcttatgtgattgtgaatgttgactaagtggctcagaattccatagagcaggcagtcagaaatggaggatcacaggcaggctcaaacccatggacataggccaaagctgtcatctacaggcagtcaggaagagaagctcatgagaaggatgaagtggcacagacatgggctaaagctgtggtgcacaggtagaatttctgccctttctgtgtgagacctaggctctacttttaaggtcttgcaacagattcagtcaggtccatccagattatctaggatattgtcccttatataaagtcaactgattagggcctgtattagcccatgttcacagtgctataaatacctgagactgggtaatttatgaagaaaagaggtttaattgactcacagttctgcaggcttaacaggaagcatcactgggaggcctcaggaaatttagaatcatagtagaaggcaaaggggaagcaagcatcttcttcacatagtggcaggagagagagagagcaagagggaagtgccacatacttttaaaccatcagatctcgtgagaactcacccactatcatgagaacagcatgggagaaattccccccatgatccaatcacctcccactaggcccctcccccaacacatggggattaccattccacatgagatttgggtggggacacagagccaaaccgtatcaggggctttgattatatctgtaaaataccttcatggcaacacctacattagtgaggactacagtctagtcgaatgggcacatcaataaattcatcacacttttcttataaacagctgtataacattccataatattatgtaataaccacagtcatctcttggtatgcacgggatattggttccaggactcccgtgcatatcaaaatccatggatgctcaaatcccttatataaaatgatatagtatttacatataacctatgtacatcctccatatactttcaatcatttctagattatttataatacctaacacaatgtaaatgctatgtaaataattgttatactgtattgtttagggaataaaaacaaggcaaaaatccatatgtgttcagtaaagaagcaaccagccgcttttttctgcatatttttgatccacagttgattgaatccagatgtggaacccatggttacagagggctgactgttcgttttttgctagacattcattttatatttagctttatttcccactacagatattgctgcaataaatatccatgtacgtatctgattgttacttactgatgcttttattcctgtaggatctgtaccctaaagtggaatgactgaatgttaggatgtgaacagttttaatacatacttgcatattaaattctgaaagatttgtagaatctatactcctagcataattttatgagtacccacttccgcatagcctcaccagcactggatagtatctatttgtttcagtttgccatttctcaactagtaaattgaaaaaaagtgttggaaccttttttttttcatatgcttaatggctattttcatttcttttgtgaattgcctcataccctttactcattcttttaacataaatttggaaggactctatattgttgatgtgacactttgtcagtcacgaatttcacgttttcaccagtctgttttttgtcttttgagtttgtttatattgcctacttctataaatatttaaatttttactttgaaaaatgtatctattattccttttttggcccctagtttcatcttgcttaagatctcttgccatccaaactataaaatttcctgattaaaaatatatttttggtttatttttagaacagtaatccatccggaatttacatttttatatgatgtgagaaaggggacctcatttttttcttcaaggtggatagtcagttgcatctgcatcatttattaaataaatcatttattttccacacagtttaaatgccatttttcatatatagtaactctgcatatatacttagatgtgtttttaaactttctattctgttccactcttctgtttgtcatttcttgtatcaagactatgctgtttcaattacagtagattttgagaaagatttaatgcctggtacaatcaattcttattcactcttatcattgcttcttagcagttcttagatgtttattctttgatatgaatatcaaatttatttattctaggtttaaaaacactgccgtaaaaactggcatagaaagcccatttggattctgattggcattatattaaattttttaatatgtaacggcttggcattgttattaagttttcacatttaagacaaggctctgctctcctttcatcaaaatcttgttctgtatgcttcaggaaaatggtagagttttctttagattctgtacatttctgcctctttgtacattacttttgataatttctatttttctgggaaattgttcatttcctctggatttttaatttaatgctatatatctacacataatattttctaattatcatatcttccataattgtagttatctctcttcttttgggttcataatatttcatatatttttattttctcactttaatcttttaatcaggcttatcagggagtattgatcttttttatgtatatataatcattatacatatttttaaggtacatgtgatattttgatacctgtatacaatgtgtaatgatcaaatcagggtaattgcgatattcatcacctcaaatgctcatcttttctttgtgttgggaacattccaaatattttttttagctattttgagatatacaataaattattattaactctaatttccctactgtcctatcacaaactaaatcttattccttctaactgtgtttttgtacctattaaccagcccctctccattgacctgagcctttctttctgagccactgataatcaccattctactctctatctttatgaaatccacctttcagctcccatgtatgagggaaaataatcttatttcacttaacataatatcctccagttccatccatgtttctgcagatgacaggatttcatttttttatggctgaataatataacatcgtgtatatatgccacatttcctttatacattaatccactgatgggcatttaggttgatttcatattttggttattgtgaataatgctgtgataaacatgagagcatagatatttcctcggtatattgatatcctttcttttggatacatacccagcagtggcattgctggattatatagtagttctatttttaatttttttaggaacttttctactgtttttctataatggctgtactaatttacatttggtcgtttcaaagaacgtgtttttggtttgtttatcccttctgcagtttatttctgtttcttcttaattttcacttttatttccttctttttcctactttcaggatttaaggaatattttagatcctttccactctttcattgactgaatacttactttgtttattttgatttttacaaaatcagaaaatcattttagacatgggagggtgtatgtgtcgaggaatttgtccatttcttctagattttctagtttatttgcgtagaggtgtttatagtattctctgatggtagtttgtatttctgtgggatcagtggtgatatcccctttatcattttttattgtgtctatttgattcttctctcttttcttctttattagtcttgctagtggtctatcaattttgttgttcttttcaaaaaaccagctcctggattcattgattttttgaagggttttttgtgtctctatttccttcagttctgctctgatcttagttatttcttgcattctgctaccttttgaatgtatttgctcttgcttctctagttcttttaattgtgatgttagggtgtcaatttaagatctttcctgctttctcttgtgggcatttagtgctataaatttccctctacacactgctttgaatgtgtcccagagattctggtatgttgtgtctttgttctcattggtttcaaagaacatctttatttctgccttcatttcgttatgtacccagtagtcattcaggagcaggttgttcagtttccatgtagttgagcggttttgagtgagtttcttaatcctgagttctagtttgatttcactgtggtctgagagacagtttgttataatttctgttcttttacatttgctgaggagtgctttactatgtggtcaattttggaataggtgtggtgctgagaagaatgtatattctgttgatttggggtggagagttctgtagatgtctattaggtctgcttggtgcagagctgagttcaattcctggatatccttgttaactttttgtctcgttgatctgtctaatgttgacagtggggtgttaaagtctcccattattattgtgtgggagtctaagtctctttgtagatctctaaggacttgttttatgaatctgggtactcctgtattgggtgcatatatatttaggagagttagctcttcttgttgaattgatgcccttaccattatgtaatggccttctttgtctcttttgatctttgttggtttaaagtctgttttaaccaagactaggattgcaacccctgcctttttttgttttccatttgcttggtagatcttcctccatccctttattttgagcctatgtgtgtctctgcatgtgagatgggtttcctgaatacagcacactgatgggtcttgactctttatccaatgtgccagtctgtgtcttttagttggagcatttagccaatttacatttaaggttagtattgttatgtgtgaatctgatcctgtcattatgatcttagctggttattttgctcgttagttgatgcagtttcttcctagcctcgatggtctttacaatttggcgtgcttttgcagtggctggtacaggttgttcctttctgtgtttagtgcttccttcaggagctcttttagggcaggcctgctggtgacaaaatctctcagcatttgcttgtctgtaaaggattttatttctccttcacttatgaagcttagtttggctggatatgaaattctgggttgaaaattattttctttaagaatgttcaatattgacccccactctcttctggcttgtagagtttctgccgagagatccgctgttagtctgatgggcttccttttgtgggtgacccgacctttctctctggttgcccttaacattttttccttcatttcaactttggtgaatctgacaattatgtgtcttggagttgctcttttcgaggaatatctttgtggtgttctctgtatttcctgaatttgaatgttgacctgccttgctagattggggaagttctcctggatactatcctgcagagtgttttccaacttggttccgttctccctgtcactttcaggtacaccaatcagacatagatttggtcttttcacatagtcccatatttcttggaggctttgttcgtttacaggctctaaaattgaggcaataattaatagcctactaaccaaaaaaagtccaggaccagacggattcacagccaaattctaccagaggtacaaggaggagctggtaccattccttctgaaactattccaatcaatagaaaaagagggaatcctccctaactcattttatgaggcaagcatcatcctgataccaaagcctggcagagacaccacaaaaaaagagaattttagaccaatatccctgatgaacattgatgcaaaaatcctcaataaaatactggcaaaccgaatccagcagcacatcaaaaagcttatccaccatgatcaagtgggcttcatccctgggttgcaaggctggttcaacatatgcaaatcaataaatgtaatccagcatataaacagaaccaatgacaaaaaccacatgattatctcaatagatgcagaaaaggcctttgacaaaattcaacaacccttcatgctaaaaactctcaataaattacatactgatgggacgtatttcaaaataataagagctgtctatgacaaacccacagccgatatcataccgaatgggcaaaaactggaagcattccctttgaaaactggcacaagacagggatgccctctgtcaccattcctattcaacatagtgttggaagttctggccagggcaatcaggcaggggaaggaaataaagggtattcaattaggaaaagaggaagtcaaattgtccctgtttgcagatgacatgattatatatctagaaaaccccatcgtctcaggccaaaatctccttaaactgataagcaacttcagcaaagtctcaggatacaaaatcaatgtgcaaaaatcacaagcattcttatacaccaataatagacaaacagagagccaaatcatgagtgaactcccattcacaattgcttcaaagagaataaaatacctaggaatccaacttacaagggacgtgaaggaactcttcaaggacaactacaaaccactgctcaatgaaataaaagaggatacaaacaagtggaagaacattccatgctcatgggtaggaagaatcaatattgtgaaaatggccatactgcccaaggtaatttatagattcaatgccatccccatcaagctaccaatgactttcttcacataattggaaaaaactactttaaagttcatatggaaccaaaaaagagcccgcattgccaagtcaatcctaagccaaaagaacaaagctggagctatcacgctacctgacttcaaactatactacaaggctacagtaaccaaaacagcatgatagtggtaccaaaacagagatataaaccaatggaacagaacagagccctcagaaataatgatgcatatctacaaccatctgatctttgacaaacctgagaaaaacaagcaatggggaaacaattccctatttaataaatggtgctgggaaaactggctagccatatggagaaagctgaaactggatcccttccttacaccttatacaaaaattaattcaagatggattaaagacttaaatgttagacctaaaaccataaaaaccccagaagaaaacctaggcagtatcattcgggacatacgcatgggcaaggacttcatgtctaaaacactaaaagcaatggcaacaaaagccaaaattgacaaatgagatctaatgaaactaaagagcttctgcacagcaaaagaaactaccatcagagtgaacaggcaacctacagaatgggagaaaatttttgcaatctactcatctgacaaaggcctaatatccagaatctacaatgaactcaaacaaatttacaagaaaaaaacaaacaaccccatcaacaagtgggtgaaggatatgaacagacacttctcaaaagaagacatttatgcagccaaaagacacatgaaaaaatgctcatcatcactggccatcagagaaatgcagatcaaaacgacaatgaggtaccatctcactccagttggaatggcgatcattaaaaagtcaggaaacaacaggtggtggagaggatgtggagaaataggaacacttttacactgttggtgggactgtaaactagttcaaccattgtggaagtcagtgtggtgattcctcagggatctagaactagaaatcccatttgacccagccatcccattactgggtatatacccaaagggttataaatcatgctactataaagacacatgcacacgtatgtttattgcggcactattcacaatagcaaagacttggaaccaacccaaatgtccaacaatgatagactggattaagaaaatgtggcacatatgcaccatggaatactatgcagccataagaaacgatgagttcatgtcctttgtaggaacatggatgaagctggaaaccatcattctcagcaaactatctcaaggacaaaaaaccaaacgccgcacgttctcgctcataggtaggaattgaacaatgagaacacatggacacaggaaggggaacatcacacactggggcctgttgtggggttgggggaatggagagggaaagcattaggagatatacctaatgttaaatgacgagttaatgggtgcagcacaccaacatggcacatgtatacatatgtaacaaacctgtacattgtgcacatgtgccctaaaacttaaagtatattaaaaaaagtgaaaaaaaaatcattttagagtatattttcctttgaataaagtctcaactgtatctcagaggttttaatataaaatttcctttttatttatttttagatattttataacttcagttatggtttccttttgatccagggtttattcagaagactattacactgggtacagtggctcattcctgtaatcctagcattttgggaggctgaggtgggaggatcgtttgagcccaggaattcaacaccagcctggtaaacacagggagacctcgtgtctacaaaaaataacaattaaaaaacaattagccaggtgtggtggcatgagcctgtggccccagatactcaggaggctaaggttggaggattgcttaagcttgagagatcaaggctgcagtgagccatgatcatgatcatgccactacactccagcctgagtgacaaagcaaaaccttgcctccaaaaaaaaaaaaaataataataataatagaaggcgattccttccaatatttcagattaggattctagtaatattatgatgtctgttttttgttaagtgagctgtcctttctgttgtgaagcttgtcagattttttttttatcctgaagtttgggaattatactagtcaatatgtagatgtgcatctatgtatgctcatcctgcctgggacttagcaagaccttttattctttccacagtaagtatatcctttttttccccttaaccgagtgttttgttacttatttgttactattttccatttgattttttcctccttcttaaacttttataatctatatatacatttgctgtttgaattatcttttgcctcattatgtccttttctttataattttgcttttggttacaaaatattttttccctatgtcatgctttatttaacgattctccattaacagactcttagcccatgttcataattctttttttggctctctattctgtgttgtgcattttgtagctaagtttttgttcaagtttgtgacaaatttccttagtgaaattcctagaaattactgggttaaagggaatgattttttttttttttgtatttcaagattttttatatgtcttagcaaatctttcttacagaaaagtttactcatttatacactcagtaagggtgtgtgtttctcatttaaaaaatcatatatttttcttttttaggctttgaaatttctgaaaaccagaagaggcaggctgcaatgactgtgagaaaagtccctaagcaaaaaggtaaagctgccccactcagtctctgtgaaagactatggaatcataagctatatgcttacatattcttaggcccatttctgtgctgaggtttacttgggggtggtggaggagtatccaggtccctaggtgtccttgatgacaggtagcaaatggttttaaatgcttaaggctaaggagtgaatagtatagggtattggtatccaaagatagctcattgagtatagcaaaaaatataacctctgttcctcttttttttttttttacttaaaaataagggaaactttactaacaatttatagatcaatggacaacatgatctttatttaataagtatagtttgggcatgatggctcacgcctgtaatcccagcactttgggaggccgaggcaggcggatcacaaggtcaggagattgagaccagcctggccaacttggtgaaaccccgcctctactaaaaatacaaaaatcagctgagtgcctgtagtcccagctactggggagattgaggcaggagaatcgcttgaacctgggaggcggaggttgcagtgagccgagattgtgccactgcactccagtctggcaacagagtgagactacatctcaaaaaaaaaaaaaaaaagtataaagatattgctcagctttctgtcaccggtctggaggcatgtgccaaatcaggagacccaaatcacaataaagaatctcaaactaagccaagacaaaagattcagatattctctttctcttaactacaagccaaagtacttaagaaaaaataccttgcaaatcaatttaaatctgaagttaagctttagtttctcttttctcatgaaccagaacaaaactatcatgctcagccaaacaaagggaaggaactaccttctgcttattggaatacctattcagtgtcagtcactttatatgttatttcatttcatctttatggtaatcctgagaagctggacactattaactctatttctcagatgaggtagctgagggtctttgagtgaagtaactgaacttaatttgacttgactcagagtccactgctttctcctctccatctcagggtcctgatgaagccccatgcttggaaagaagagtttggttttctgtcttgcctcaattactgacagctgcttctattactgatagccatgttcactgtccccaggtgtgggcaatcttaatgagaccttactttccccaggcctttccttctgctttctcagtgggctttgtggttctgaatgagtcaccatccaaaatgatcagattcaagtctcctgaaatttccagcagccatgtaaagcactattttttttccattgaagcttcttttgattgaggctgaatgcctgtgaacatctgatttccagttaagcagtgcacctagctccgctgactagacatgcctccccttcaactgcttattacttcttgctcttgggaggcccttattgtctcttttcctcatcatgcgaatgtgattccccttatatagggaatgaggccagccttaattagccaccaaaaagttgggagttaatttaaggtggggaattaactcctaaccttttgattgctataataacatgtgagagatggtgttagaaagcaatctggagttaatgtcagtaaggatatgacctgtattaacagaacttggtaagattttgctccagttcctcagacagaaatgtgagcagaaaagagcccagccaactgaagttttcaggctgcaaaagggatactgtcctaacagcttgtctcctggacgctctcaactcctgaactttctcactctgatttcctctacttcccccactgtattcttcagcgttctctagagggacagaactaataggagacatatatatatatatgagtttatatgagtttattaaggagtattaactcacacaatcgccaggtcccacaataggccatctgcaagctgaggagcaaggaagtcagtccgagtctcaaagctgaagaatttggagtctgatgtttgagggcaggaagcatccagcatggaagaaaggtgtaggcttggaggctaagccagtctagtgtttctaggttcttctgcctgctttttattctggccatgctggcagctgtttaaatggtgcccatccagattgagcatgggtctgcctctcccagtccactgactcaaatgttaatctctagcaacaccctcacagacacacccagcaacaatactttgcatccttcaatccagtcaagttgacactattaaccatcacatccaccatactgacctttatggtactcctttatccaagcctgggttcctcaagcatatctgagactgaattgtcttttcactgagaacacttcaaacaaaggaatatctataaagcaaccaggagttggttaaccagaagatagccctgctaactcatgccaagcattttggtcaaggtccttccccaccctatgtatctccaggccattccttttagggcctttcttgtctcccagtgtctaaatactgattcacttgaacagttttctttctttaacagcaattctaaagtcttcaaagaaattcatttagtttctgtctttctttctttttttttttttttttccctgagatggagtttcactctcatcgtgcaggctggagtgcaatggtgtgatcttagctcactgcaacctctgcctcctggtttcaagcgattctcctgcctcaccctcccgagtagctgggattacaggcacctgccaccacacccgactaatgtttgtatttttagtagagacggggtttcaccatgttggccaggctgatcttgaactcctgacctcaggtgatcccctcgcctcgtcctcccaaagttctgggattacagatgtgagccactgcgcccagcttcatttagtttcaaacctcccaggattactacaaatctcctcccttatttctatttttggtcttcaagactcctagtccagggctgtagtaactgatatgttttgagactcaagagtgccatacatgtggaagtggttctcaaatgtaggaattcagtagttacaatatgtacatgggaagagcaagaagggattatttaagataaccatgaaagctggcttccttgagcttttcaatgacccatcacaggaagtgaggggcattgttaagaggtctccaatgcggatgtcattagataggtaactactctaatgtccctttccaacaccatctgtaacactgggacattatcaactcagtctactgctctgggagagggggaacctggctgaaataacagtagagaataccagatctagctccaagaaaggccttttcacttgacctttgtctttcacgctgctttcattttaagtattgatatataacttcttgaaagttttatgctaattcctggtacataaacctaattaactagatcagtatagagctccccatggctatgagcacagactccatctccagaggccttggggccagcacaaaatcaaatgagtgccctagaatagcaaaaatgatctcgaaaaagaataaaatgtgagtaatcaatctacccagtttcaacactcattatatagttacagtaaccaagacagcgtaattttggcagaagggtggacatatcagatcaatgccacagaacccagaaataaatgtacacaaatatgcccaattgatttttaaatttattttgtattgatatgtaataattgtaaatctttactgagtacatgtgatattttgatatgcatacaatgtgtaatgatcaaattagggtaattaggatatctatcaccttaaacgtgtatcatttttttgtgttgggaacatttcaagtcttctgttttatgtattttgaaatatgcaataaattattgttaactactgttaccctgctgtgctactgaacactagaacttattccatctatcaaactgtatttttgaatccattaaccaacctctcttcatttccctaacaccatccttccaagcctctagtaaccatcattgtactctctacctccatggaatccacttttttagctcctacatttgagtgagatcatttgatatttgtctttctgtgcctggcttatttcacttaacattatgagctccagttccatccatgttgctgaaaatgataggatttcattctttttgtggctgaataatattccactgtgtatgtatactacattctcttcatccattcatctattgacagatactttggttgattccatatcttggttattgtgaatagtgctgtgataaacataggagtgcaaatatctcttcaacgtactgatttcctttattttagatatatacccagaagagattgtgattataaaagtgtaacaacagggatccttgtgatgatggaaatgttctatatcttgactgtatcctgttataatgtcaatatcctggctgtgatattgtactattgtactattgttttgcaaaatgttaccattgggaaaactgggtaaagagtacacaggatctctattatttcttaaaactgcatgtgaatctgtaatgatttcaaataaatgcttttaaaaaaaatcaaattagtaacaaaattccctctctaatatctgcgtattgtctgttggcattcagtaccctcatacttctgacacttaccaccttgcaaaactagctcttagaaaagattctgatctttctcactgaagtgccagtggctgatgatggcttaaatgatactacttccaggcaaagggacttagtcatcaagcaaaggcaaaaaaagtaactgtaatgttggaatttcagaccctgagtagcagatgaggaaggtatttgggagcagcagagaagccttcctgacatgtctgaattatatgctgtatgtcttgtcctattctgctctgaatgtagatcaggattaaactttcactttaggcctccaggttcctggaatcctccattaatgtggattttgctttgatggttgcaaacctacctacaaatgttgagaaggtttttaatattagtatcatttaagctattccgtttgaaaagacacacacatattccgtcttccttgctccccatgaattataccttctggtagtaagtttactttctccttcacctactaatgtcaattctctattaagtgcaggttcatcactctcaacccaggacagaacactaaatcacttgcaccttatgcttttagaaaatttctcctagaaacctgtcctgaagtcaatagttcttaaccaggctcttttaaaacttccaggggggactggagaaggcgaaatagagtttgttgggttctttgcaggaccaacccctgcataagggattctggtgtcttggaaagagctctgaactgagtagtcaaagaatgtaggttctaacccttgctttgtcgctaacttaccatgtgaccttgggtataacatttcttttcagatatcagtgttctcacctgtaaaacagattatagcaataccccaaatttctttgatacctgactagatgtggaagtgtgtagggttgcaatagtagccatggtattccaaaatctgtttgaaagaggaattctccccttggatgatttgtaaaaccagttcacactctctaaaccagtctgccttgagttgtctgcccagagtggtcactgggtaatttgagaagccctttgttacataacttataccctttccctttgatctctcatctactctaggtgtcaactctgcccgctcagttcctccttcctacccaccaccgcaggacccgttaaaccacggccagtacctggtccccgacggcatcgctcagtcgcaggtctttgagttcaccgaacccaagcgcagccagtcaccattctggcaaaacttcagcaggttaacccccttcaaaaaatgatacctacagggaggcagataattttaaaataaagtaaataaaattatatttatagatggaccttttttcggagaagcactgttgaaatttatacacacacacacacacagagacccttgagtacacatacacacacacacacacagacacacacacacacacacacacacacacacacacagagagataaggaacaaaagtgttttctgttgttttggggaagtgaaatatgtggttggtaggaagaggtaccaatgacttccaaacatgtgattccgtcttaaaagttttccatttttaccctgtcccccttccctttgctttcagaagttgacatttctattcattgcttttcttgttaagataatctctttactcccctgtgagtgattcactgccttgtcattattacgatagatgtgtttgtattgttttttttctgatgatactgatgttgatgaatttttaattttatttgatgtggtagagttgggaggtttcagggttttttcccctcttttactttccattgaggaagggaatgagctcctttctcctctccttcagccaatcattatcaaatgttccttcagccctgcagttgccccaaataaccttttttcagcatcctctgtcctcagtcatgccagtctggacatgctctgttgtgccctgtgacaaaactgctcagtattcctattgcttttactgtgttttaggtactgtgaagggatcaaaaaaccaaacagaagcaagggagtatcagactatgatgatgctggagtggacttctgttcagggaacattttgcattcaggctgtttcttctatcactggggtttcccatgttgcagcacttctgggtcgttgcaattttgcatctaggagttagtttgatcgagttattctcttttttcaagtcacttttgttataggtctccccctaggcctgtctctcccttagcccaaaagatctgaactggaagcagaggttgagattctgcctcccaggagagggatttacctgccccctagtaccagataggtttagggcagtgatctctacagcaatcagttcagtgtcctggttgtccctgctcccatttacagatgtttgggcagcattgatagaagtatggaggggttcaagacagagcccacctgatcaagatcatcagctaccttcaaattattgacctggacagggtccaagtctgatagtaaccttttacaagaaagaacagggatgggaatggaaagagatagccttgatccacagtattgtacctgcattttctaccaccctaaaattgtgtgagacttctcccattgttaacagattgcatggacaatcttccctggcttctttctttccctctctctttcttctttctcctgccatcctagcacaggaggatttttggtattgatatagttaaagctgttctggcactcaaagaaggccgtgtttccaacatcctctcatcccaggacatttggggcaagtgagttaggggcccaggggcaattttccctctgaataacgtgtctgaggcagggatgctaccctcaggctcgcttttggccagctttttgcttgggaaaatctaacttctttcacaaggaggcaggcttcctatggatgttggagtacctgtttttcctccacacatagcccttttcatggatagaccttgaacaacaaaaagggtataagggaataaggatgaactctgctgtgaagagcaagccactgtagtgaggaatgtggagactgggagtctgtcctaaaccccatgggagaagacttcatcatgacaggacttcagcttaccaagcagcagccatagctgtgtggaggcttcagcatagctagcatgtttactgctctatgcctcctgatccagaccaggcattgcccagcctgggaatcttttctttgtgggaatcaaattacaagctatttaagtttatattccatcacaaccaagtcagacttgtattataagtcaaggatgagcctgatctggggagagggccggggctcgggactggccaccactgttcagcacatgacctaactacgtaagcctctttggcaagggtcctggtgcccagcacccaggctaaaatatcctgtctggcagagtgttttggtagctatgcaggcctcccttcagtgtacctctttttccaacttctcactcctccttactaggcttggccttgacatgcttcttcgagggttggcagcacaccgggaggggatgcttggacaagtttctgggcctacatttcttgactaggccctctcatttcctccctccttggggcttctgcccagggctccaggatcagggatattacttctcaacccgcacttctcctctactgaacccactggcatcacctgatgccactaatttgtgaacaacaagaaatcatttccccattggttggagtattccctcagcctatagcatcaaagcagaccagtggccaacagccccaaggggagcccaattaaatacctgggttcagtatcctaacctgttatgtcctgacagcaatggtaaccccagtaattctgtaatgttgtaatttccgcatggccctgagctcccttttcctcaactcagtgaggccaggatttgctctccaaaaggctttgctagtgtgttcaatgggacctgctgtggggagtcctaagacagacatctaattattctctctttttccccccctctctatgtgtatatttctaatggatctataagaacagcaacaagagagttctaacaattctagtgtgaagccaaatagtgatcttttagtgctttggggatggggtgggctggggtggatggatgggcaacagtgactttgattacccttgctgctctgcatttgccagtttattcttttgtttcttttatctgactgactctgtcaaacaagtgtcaaagttgtgtgttaaaaaatgtttaacaaaaaaaatgttgtaatgacacaaagccttatgaaaatatttatggagttcaataaaagaag

SEQ ID NO: 4640 - DNA, 150566 bp, human
gcagcgggaggcaggcagaggtagcagctgccttctcctgggcgggcggaggctattcgcccccatcctctccctgcaccccacccccacagttctcaagccttggtgggggacaaaagcagcccattaggacccccccacactcgcacctctccctgccaagacctctaggagcagcagggcggagagacagagcctgccggttggcatggaacaaactgactgaaggcgaggtccggggcggaggggattgggttgtagggctgtggaggaggggcggcggagggggcgctggggctctcgcttgcttcagcccagcccttctagtcagcccgcgacaactcgcgccagctacggggcctcagagaagccggacttcgcaagcaccatgcagtggataaggggcggatcgggaatggtgagtgcatgtaaccttggcttcccttgcttgagcctctcagtcccccagccccacctccagttcctccaacgagccacaaggcagtgagcaccctggcctctgcccaccgccctagccgccgtccttgagacaccagtgagcttgctgtggccattttaggagtccctgctagcctgcctgcccaggaaacccccctaccatccccctccacttttctatctccctctgagattaaggtggaataggggtgggggccagattatgtgcccaggaacatcccaggggtcacttgggaggccagagagggaagggggatggcagagggcttctctggaagcagtgaagctcgcaggaggctgacaagctggcacggggttgtggggggaggggacggtcacaaagcctggaattgtggagggggccttatgggagagctgcatgactcccccctgcccccaactagattttctgcaactcctttccctggtcagccccagagcatgagggccagagagccactctctctctctcaggaagctgcctgagggagccctaaagcccttccttgtccgggctggggtcaccctgtccacacttggggctttgtcaaggagagacagctgcagaaacccacattctggaaatgggcttgggccacagtcagttaacagagctcttctctccctcccaaggagtgtgtgcttgtgtgtgtgtttagtataatcctccaacagttcattttatgccatggtgttcccttctccacctggagaccttggaatgacttccttttgcagagaggaagtggtggctgcattttgatgcctctctgacttagccaggagcagcttaagcctggttagggcctctggggagtgggaggcccccatgactttgtcctcagctgggaggcataagcaaaagggccttagaaggcagttaggttgggtcagcaggcactgatggcaatagcccacacttctacgctgccacccataacccgcagatgaaggaaagtagcctgaagtggttgggcaaaaactgatatttaactccatttttgctttcattgtggaggggaagagggaatctggtgtgggctaggactatattcagaggggctgtcctcttcccttcctcagagttttgttagatctctgtttcagtggttcttaagggcatccggttcatatgcctatgtgctggggcttcaaaagacccttcttcccagacctccctacttccctgaggtcccattaaagctgcatcaaatgtttgtagaaccagaaaagattagagcaggtaaagaccttagagtccttgctgtccagccaggaaagctgggatccagagagtgggagagacttgcccaggaccacaaactccttggaggcaaagctgagtctagcacttgagtctcctgactgccacagtccttccccactgctccaccaatcatttgctcaaatggtgctgagaggggaagaaaggaacatagtcatgatcttgggaaaggactttcttcaggatgatctagtgccattaaatttacctgaaagccgggcgcggccgcccacgcctgtaatcccagcactttgggaggccgaggcgggtggatcatctgaggtcgggagctcaagaacagcctgaccaacgtggagaaaccccgtctctactaaaaagacaaaattagctggacgtagtggcacatgcctgaggctgaggcaggagaatcactcgaacccaggagggggaggttgcggtgagccgagattgtgccgttgcagtccagcctgagcaacaagagcgaaactccatctcaaaaaaaaaaaaaaaaaattacccgaaaaaaatccatgccagtcctggcatttctggcaactgggaactgggtcagggtgagacttacttcctctcccaaatatattgaagtataggggcccagagccactcattgacaacaggttaaattaatgaagaaatttgaagttttgccaacagtgtatgagagagaaaagggtggcagacatcttgtggagactgtgtaattaaggattggttgatggggaaaaatctcataatattcttagaggactgagacaatgaatattatatgatgaaagcatttatttagctgtttaccagaattcaagagatgggagtagtaaactctattcttgcctgagaggcagggaacctctaagttttggccttgccactaacagaaatcctttgggcctcagatttcttacctattaaatgcggatgttaataagcaccaaaattccttctaggccttagattctcagattcctagaagtatgtgttggataaaatttaactagtggctcattacgaacaaatagggattgtgtatctagccaccattttataacgtggctagctgaaagatctttgctccttgttctttcgtttgcaaggtgcccgaagtacaaactgagctttttataacagtgagatttctttttagtacatttgactgtagtaacttatttcaagtgttacatgtaaatcgtgggccttgaacataaaacattgttcaagattttacagaataaaatctgtctcatagatacaggatgctaaactgtgagttcacactggacggtaaattgttatttattcttggcttctttctgcaatgccagtttgtgctgggttagccagtatgcctaaattggaaagaacactgttctcagagtaacaaatcagaggtttaggacccggcttttatgtttctcagtcctgaaactattaccaattgtcgaacctactttattctcagtattctcttacataaaatggggataaagtgcctttttataggtactatcgggtcattaatttattcaacacaaatgtaggggatctgctatgaaatgacactgatctaagttcaggggagatcacaatgaaaaaaaattcctcactttcatggagcttatattctaggggttgtgaagttcattaaaccataacagaaatgaatatacactatgtcaggaggtggtaatcactaggaaaaaaaataaaacctgttaagagcatagagacacatgggaagttggatggtatattagatccatcaaagcctcactagttaaggggcatttgagcaaagatgtgaaggaagtgcaggaacaagctctgtgtatatgtttaggagaagaggattttaggcataaagaacatccagaaagaacacaactggtttgtttaaagaacagcaaggaggccaatgtccttgggataaagaattagtacatggaagaaggatagatgaaatcagagagaaaacagccacttttatagggcattattctgagtgagattgggagccattgaaaggttttgaacagatgagggacatgatctgacttaaattttaacaggaggctaaattgtagtgggacaaggacgagaactgtgaggaggcccaggttagacgtgatggttgcttggatcagggtgataatggtggagatgatctatatgaaatgactgacatcattgtttatagatgatacgtgtctttctcctttctgatcacctgctcggaccctcagatcgctaagagtggggctagaaagaacatagagtgggtctatacatggaggggcatttcatatctaagtcaatgttcgagtgatctgcttttggacttctgaccatggtagggctaattgagacttggttctatgtggattaccaataaattaataccctgctttctggaattctggagaagaagattaagtgtattattagcacttcagtgttgtggtacacctactgtttatctgtaatatctagaatggatcatttttaatagtcttatatatgaaaaaattattttcagtaataatcagtactatttattattttcttgatttattcttttattttcaattaccgaggaaaacaatacattttaatggtaaagatattcaaattcaaaatttaactcatgtataaactacaatgtgcactcactaaatagaagtattacacctttcaattttcattgtttcactgttttagattttaagcacacataaaactacaattggtcacacagaatgacagaattgaagtgacccacattctgttttttttgtctttataatcactatgttattattgtttactttcaacctactgtgtaaatgctggaacatatagtaccagagggattgtggacacaaaactgacctaatggtatcttgaatgattttgaacctttacaaactgaaatgagctgaacgaacacttgtagttacaactgtgtgcgtcaggggccaacgatgcaactgggagctctctgagtcaacttccatgtagaataaagtgtcgattaaaggataaataaaaaggtgctaatttcaagcttcatatatattattaaaagtaaccacaattgttttaaactttgaccaaccaaagttgttttgttttgtttttgttgttgttgttgtttgttttttgtattaaggaaggagtgttttatttctaacattgtttaaaattgctggtgcaaggtgatataaaacgctttgacttttagtcttaaaaaaaattatctatagctagtgtactcttgttgcttgcactcagggttgtctgctcccattgccacacctttggtgtgccaccactctggataagaatatggaattgtggaccaattccatgccaaataccatatgacctgtgtaagagtcatatatgactcggtggccatctctccagatggaatgaccaactgcaaggtttaacagctgattttactttattcagctatgaataacagaagtatatctatactgacttaaaacacacaggttttattttttcacataaaaaaaaatcaggagacaggcatacctgggccagtatggcagcttcaggaagtctttagagacttttctcctctatcatccatagcacttggcttccattattcatagtccaagatgagtgctaaagctcaagaaaatctattaacatccataattttggaaggcaaaagagaaggaaaagttcttcacccctcctttttaagaagtcttcctagaagtcctatttaatacttctacttatgtctcattgaagaactgtgtcacatggctgctgctagctgcaagggaagctaggaaatgcagttatataaactaggtggcaagtgtacacctaaaaattgggagtagggtttctaatacagaggaagaagggaaaaacgatgtttttgggagacaacctgcagtcattgtcatgattagttgaactatatgcctgcgattgtagaaacacagaatctaagggcttgtagtcagctttggactgtgggccaaagcctgatagatgttgctaatagtaaaaatgctgctatcaatcttgtgaaggttcaataaacacctgacatatcctagtcctcctatgcttccttctagtgacagtctttttgtgaaactagatggatggttatatggttttgctgtgtccccaccccagtctcatcttgaattttagttcccataatccccatgtgtcatgggagggacctgggggaaggtaatcaaatcatggggtcagttaccctcatgttgttctcatgatagtaagtgagttctcaaaagatctgatggttttataaagggcagttcccctgcacaggctctcttgtctgccaccatgtaagatgtgcctgtgctcctccttcaccttctgccgtgatcgtgaggcctccccacccatgtggaactgtgagtccattaaacctatttttctttataaattacctagtatccggtatttcttcatagcagtatgaaaatggactaatacagtaaattggtaccagtagagtaggatactgctattaagataccccaaaatatggaagcaactttggaaccgggtaacgggcagaggttggaacagtttggagggctcagaagaagacaggaagatgtgggaaagtttggagcttcttagagaatggtttagggcctaggtttaggacctggcttttacgtttctcagtcctgaaactattaccaattggcaaatctactttattctcagtattatcttacataaaatggggataaagtgcctttttataggtactttcaggttattaatttattcaacacaaatgtagaggatctactatgaattgacactgatcaaccactgaatggttttgaccaaaaagtccaggctgaggtggtctcagatagagatgagaaacttattgcgaactggagcaaaggtgattctttctatgttttagcaaagaggctggcaacattttgcccctgccctagagatctgtggaactttgaacttgagagagatgatttaggatatctggtggaagaaatttcaaagcagcaaagcattcaagagatgacttgggtgcccttaaaagcattctgttttattaattcacacagatatggcttggaattagaacttatgttgaaaagggaagcagagcatacaagtttggaaaatttgcaaccctggccatgcaatagaaaagcaaaacccattttctgggggagaaattgaagctggctgcagaaatttgaataagtaacaaggagccaaatgttaattgccaagacaatgaggaaaatgtcttcagggcatgtcagaggtcttcccagcagcccctcccatcaagtgcctggaggtctaggaggaaaaaatggtttcatgggccagcccagggccttgctactttgtaaggttttgggacttggtgacctgcatctcagctgtggctaaaaggggccaacgtagagctcaagccattgcttcagagggtacaagccccaagccgtggcaggttatacatgatgttgggcctgcgggtacacagaagtcaagaattgaggccaaaccttcccaagaaagtctgcctagatttcagaggatgtatggaaatgcctggatgtccaggaaggagttcaatgcagcagtggagccctcatggagaacttctgctcaggcagtgtggaagggaaatgtggggttggagctcccacacagagtccccactggggcactgcctagtggagttgtgagaagagggccactgtcctccggacaccagaatgatagattcaatagcttgcactgtgtgcctggaaaagccatgggcactcaatgccagccatgaaggcagcctggagggggactgtaccctgcaaagccagaggggcagagttgcccaagcctgtgggagtccacctcttgtttcacagtgacctgatgtgagacatggcgtcaaagaagattattttggagctttaagatttggctgctccactggattctggacttgcatgggacctgtaactcctttcttttggccaatttatcccatttggaataggcttatttacccaatgtctttgtatctaggcatctttatgtctataatttcattgtatctaagaagtaactaacttgctttttattttccaggctcataggcagaagggacttgccttgtctcagatgagactttggacttggacttttgagttaatgctggagtgaattaagactttgagggactgttggaagggcatgattgtgttctgaaatgtgaggacatgagatttgggaggggccggtggtggaatgctatggtttggctgtgtccccacccaaatctcatctttaattgtagttcccataatccccatgtgtcatggaagggacctggggaggtaattgagtcatgcgggcagttaccctcatgctattcttgtgatagtgcctgagttctcacaagatctgatggtttcattaggggcttttcctcctcttttctctacacttctccttgctgcctccatgtgaataatgatgtgtttgcttccccttctgccgtgattgtaagtttcctgaggcctccccagccaatgctgaactgtgagtcaattacacctctttcctttataaattgcccagtctcagatatgtctttattagcagttcgagaatgggctaatacatgacatgcttcctggagatagggggtgcaaaatagagcagtgtttctggaggatttagcgggaggagatgactagtacagtagtacagtctcagccctgatgagtttcagatgcttggacaatcttacattgtagatatctaataggcagttggtgatcagatattgagctcagagggattgggaggtattgatgacagttgaagttctgagggtagatgaactacctagcatttaaaagtgccgtacagcttgggaaagtgagaggtaggagcagaacttgaatctccttcttttttaattctcctaacctggaacagtccactttgttatctactttctagaatttacatgtcagcactattgtttcaggctttactctctgcacagtgctcatgttgcttctggactgcctgagctataatgtccaagttggatgaccttggggataatctagctcaactccttagatcaggggtcaacaaactatagcctgctggccaaatctagccaacaagctaagaatgatttttacatttttaaattgttaggaaaatatcaaatgaagaatagtgtttggtggtacaagtatatgaaattataatgaaattcaaatttcagcatccaaaaataaaccttcattggaacacagccatgcccactcatttgcttattgtgtatcgctgcctttgtgatacaaaagcagagttgaatagttgtgacagagaccatatggcccccaaagcttaaaaaattcagtatttggccctttacagaaaaggtttgcagactcctggctctgaaccctagggttaccatggcagtgccttggtgagggggagaaaggagcagaaaggagtgtggatctctcacctctggtctagagcacctggggcctttgctttatacattggattgttgcttaagattttggaaaaaggggtttttctcatcctgcattccctctatcccccacacaaaatgtactgggctgaggtgtgggagagtcaaaggaagatgtggcttatgtcttcaagcagcttagtattgagtaggggggaaataaagacaggctggactaaatgctttaggaatgtatatagaagataatgtaaggaaataggggagcaagaacgtggtgggtgaggggttcagggtattgtgtagggcttccaagagacagtatttaaatgtacttttgattttattttttatttttatcttctaatttttatttcaggttcaaggagtatgtgtgccagtttgttatatgggcaaattgtgtgtcatggggtttgatgtatagattatttcttcacctaggtaataagcatattactcaataggtattttttcagtcctcaccctcctcacatccttcaccctcaagtaggcctcagtgtctgttgctccattctttgtgtccatgtgtactcaatgtttatctcacacttgtaagtgagaacatgcagtacttggttttctgtttctgtgttaattcgcttaggataatgacctccagctccatccatgttgccgcaaaggacatgttctcgcgtttttatggctgtgtagtattccatggtgtatatgtaccatattttctttatccaatccactgtgacgggcatctaggttgattttatgtcttcgctattgtgaatagtgctgtgacgaacatacatgtgcatatatctttatggtagaatgatttatattcctttggctatatacccagtaatgggattgctaggtgaaatggtatctctgttttaagttctttgagaaatctccaaactgctttccacagtggcttaactagtttacattcccactaacagtgtataagtgttgccttttctctgcaacctcatcagccatttgttattttttgacttcttaataataggcattctgactggtgtgagatggtatctcattgtggttttgatttgcatttctctagtgattaattatgttgaatattttttcatatgcttcttggccacatgtatgtcttcttttgagaaatgactattcatgtcctttgctcattttttaatgaggttgtattttttttgtgtgtgtgcttattgatttgtataagttccttgtagattctggatattagaactttgttggatacatagttttcaaacattttctcccattctgtaagttgtctgtttactctgtttcttttgctgtgcagaagctctttagtttgattagttgcatatgttaacttttgtttttgttgcaattgctgttggtgtctttgtcatgaaatcttttccagggcctatgtccagaatagtgttttctatgttatcttctagggtttttatataaactgcatttttacagcctttcacatagcacagttgcataggatggggagtaggcatggtaggtgaagcatgagttgttccaagcagagggtacaacataagataaagaatcaaggcattaaaggaataataagttctggaaatagcacattagtgttctggtgtggctggagcctgtaattctggcaatgtgtactggggctagaacaagagctcagaagctttgcttggtagaaaggatacatgatgaaacaaagtagtggaggattcctttggcaacacaggacactggcagagtgggttggaaaaggagaggggttgcatttgacaaccagaggcaaattacacagatattatgataggcaatctcaaatactctgactgaaatgaatgtctgttgtagaagtttcatgggaaaaacgtatgattaaaagtcagatggacctgggtttgagtcctgcctccaccagcagctgtcacaatgtgtccttggccagaatcctaaacctctctgaacttcagatccttatcaattaaatgagggtaataccttgtattagtaaaggttctttagagaagtaaaaccaatagaatggatgggtgagtggataagtagatagatagatagatagatagatagatagatagatagatagatagatattataatggatttgctcatgattatggaggctgataagtcctaagatctgcattctgcaagctcaagtcccaggagagttaatgtgtaggtgtagccctagtatgaaggcctgagaaccagaagaactgatggtgtgaatgccagtctgaaagccatcagacttgagacacaagaaaaattgatgtttcagtccaaagtcttaaggctagaaaaaaacaatgtcccagctcaagcagtcaggcaggaggaattcccctttacttggcctttttgttctattcatatcttcaactgattggatggaggctcatccacattgtggagggcaatcttctttactttgtctactgattcaaatgctaattgcatctggaaaagtcctcacagacacacccagagtaatgtttgatcaaatatctgggcaccctgtggctcagtcaagttgatacattaaaattaactatcacatagcccttgcttgtcttcccagtctgctgtgagaatcagatgattgagtaggtatagatgggaaagtgttgtgtgaactgcgctactctgtatctgtgtggggagtaattattattcctgacaggacagaggagacacacacttgggtgggcagagtatgatctttcccacttccctgaatttataccttagaagatcataccttctccttctatgagtgctaagaaatccaataggaattttattcacaaggaacaatccctcctgccccaacccaaggcttcctggattctgtgctagagaaaagactgagaaaacaccaaacagtcctatgatataatgtgaggagcttcttcttaagatatcattgcttttaaagttttcatatgatgctgattttgttttttgtgtttgtgtgtatgtgtgttagaatgtggttagttctgtaagtggttaagctgctagatgatggaaactagacagtggaggagagaaatgcatttagctatctctaagagatcctattgccatgaggacatatactgtcaaagggtcatcctagcacaccagagaagtgacatttcagctgagtcagttgtgtagagacttggggaaagatcctgacacatttggattacaattaaaaaaaggaagagacagtgaggcttacgggaagttgaggggaggcagcaggaatagcatatgcaaagggcttcaggttgaaacaacttggtacacttgagagacagaaagaaggctagtgttactgacacagtgagagagggggacaagtggcatgataagagggtagagagtaaggcagggaccagctcacagagaaccttgtaagccctaggaaagtatgcattggctatactcaaagttagtgtggttcagtggtcaatagcacagactctgaaaccatactccctgggttcaaattctgactgtgtcacttcttagctatgtgaccttgagaatgttacctaatctttctgtgcctcagtaatgccctctgaaaagtgaggaaaataatgacactattcatactgttattgtgaggattaagtgagttaacatgctcacagtgtgcatggcagtactaggcacatggcaagcattatttattttaaacacaataggaagtgttcgaaagagtggaatgatagggtctgctttgtgatacaagaaaaggacttttgcaggccctgtagagaatggataggagatggtaagcccaattgagtggctgctgcaaaaatccatgcagctattggagttggatagaggaaggaagaccgacatccatttttgaaataaaatcaatgggacttgctggtgaattaattcagagacatataagacagagaggtaacaaggaagatgacccctaggtttctggctctgccacagaccagctgtgtaattttgagtaagtgacttcacctgtttaagcttcagtttccatatttattagtgagggttctccagagaaacagaaccaataagatatgtacatacatagagaaagagagatttattttaaggaattggctcacacagttttggtggtgcaagtccaaaatctgcagggtaggtaggcaggctggagacccagggaagagttgcagtcagagtccaaaggcagtctgctgtcagaattccttcttgctcagggaaggtcagactttaattgcattaagatcttcaagtcgggcatcgtgactcatgactgtaatcccagcagtcggggaggctgaggcaggtggatcacttgaggtcaggaattaaagaccagcctggccaacatggtgaaaccctgtatctactaaaaatacaaaaattagccagtcgcggtggctcatgcctgtaattccagctactcgggaggctgaggcatgagaatcacttgaacctaggaggcagaggttgcagtgggttgagatcataccactgcactccagcctggatgatggaatgagactctgtctcaaaaaaaaaaagttcttcaactgactggatgaagcccacctacattatgcagggtattctgccttactcaaagtccaccaatttaaacgtaaatctcgtctattaaaataccttgacagaaatatgcagaataatcaaccaattatctgagcacggtggctcagccaagttgatacataaaattgaccatcatgcctttcctatgaaattggaaaaatgataatatccagtcattggtactattgttttgagcatgaaataatatgaatttaagtgaataatattcatttaaagcacttggtacagtgtctttcatatagcaagggcccaattaatgatagcctttactatttcaatgtaataataatccttcacattcatttggtatttcatattttcaaagtaccttcacaagatatacaaatggtcaacaaacatatgaaaaaatgctcagtgtgactaatgaccagggaaatgcaagctaaaaccacaatgagatacaaccttactcagccagaatagctattattaaaaagtctacaaacaatagatgttggcgtttatgtggtgaaaagggaacacttatatactgctggtagaaatgtactgtattagtttgttttcacgctgctgataaagatatacctgagactgggcaatttgcaaaagaaagaggtttaattggacttacagtttcacatgcctggggaagcctcacaattatggcagaaggcaaggaggagcaagttacattgtatgtggatggcagcaggcaaagagaatgtaccaccagaggaaatgccaggtacttataaaaccatcagatcttgtgagaactcactcactattatgagagtagtaggaggaaaccactcccatgatttaattatctccacctggccccaccgttgaacaagtagggattattacaattttaggtgagatttgggtggggacacagagctaaaccatattattccgcccttggtccctcccaaattttatgtttttacattttaaaaccaattttgcctttccaacagtcccccaaagccttaatttattttagcattaacccaaaagtttacattttaaaatttgaggcaaagcaggttccttccacctatgagcctgcaaaattaaaagcaagctagttactttctagatacagtgggggtacaggtattgggtaaacacagccattttaaatgggagaaattggccaaaacaaaggggctccaggccccatgcaagtttcaaatacagcggagcaattaaattttaaatctttaaaatgatttcctttgactttatactttacattccagttacgctgatgtaagaggtgggcagttaaattttaaagctttaaaatgatttcctttgactttatattttacattcaggttacattgatggaagaggtgggtttttatggttttgggcagctccacccctgtggctttgcagggaacagcctccctcctggctgccttcacgggttggcattgagtgtttgcagcttttttaggcacaagatgcaagctgttagtggatttaccattttggggtttggaggacagtggccctcttctcacagctccactaggtggtgcccagtagggactcagtgtgggggctcgaccccacattttcctttcacactgccctagcagaggttttttatgcatctccccctcccacagcaaacttttgcctgggcatccaggcatttttatacattttttgaaatttaggtggagttttctaaaccttaatctttgacttttgtgcatctgcaggcttaacactacatgggagctgccaaggctcgggccttgcaccctctgaagcaacagcctgagctgtaccttggccccttttatttatggctggagtggctgggacacagggcaccaagtccctagattgaatacagcagagggaccctgggcccggcccaagaaacaattttttcctcctaaacctctatgtctatgatgggagggcttgccatgaagacctttgacatgccctggagacactttccccattgtcttggggattaacatttaacttcttgttacttacgcaaatttctgcagcctgcttcagtttttccttagaaaatgggatttttttttttcattgcattgttaggctgcaaatttttcaaacttttatgctttgcttttattataaaactgaatgtctttagtagcacccaagtcacatcttgaatgctttgctgcttagaatttttttttcacctgataccctaaatttttttttttaagtttagtttcacaaatttctagggcaggggcaaaatgccgccagtttctttgctaaaacataacaagagttacctttgcttcagttaccaacaagatccttatgtttatctgagaccaccacagctggactttattgttcatattgctattagcattttgggcaaagccgtgtaacaagtttttaggaagtttttaactttcccacattttcctgtcttcttctgagcccttcaaactgtttcaacctctgcctgttacccagttccaaagtttctttcacatttttgggatttttttttagtagcaccccactcccggtaccaatttactgtatttgtttgttttcacactgctgatacatacatacctgaaactgggcaatttacaaaagaaagagttttaattggacttacagtttcacatggctggggaggtcttacaagtatggtggaaggcaaggaggagcaagttacattttaagtggatggtggcaggcaaagaaaaaatgtaccagcaggggaaatgccaaatgtttataaaaccatcagctgtcatgagaactcactcactattacaagaaccatatgggggagactgccccatgatttaattacctccacctgtcccctcccttaacatgtgggaattattacaattaaaggtaaaatttgcctggtgacacagagtcaaacaatattgtatacattagtacaacctctatggaaaacagtatagagatttctcaaagaaccaaaagtagatcttccatttgatccagctatctcactactgggtatctgcccagagggaaagaagtcattatatcaaaaagacacccacacacatatgtttatcacagcacaattcacaattgcaaagatatggaattaacctatgtgcccaacaattgatgagtggatgaagaaaatatggtatataaacaccgtggaatactactcagccataaaaagggactaagtaatgttttttgaagtaacttggatggagctagaggctcttattacaagtgaagtaactcaggaatggaaaatcaaatactgtatgttctcacttataagtgggaaccaagctatgggtacacaaaggcatacaaagtggtataattgatattggagactcagaaggggaagggttggaggacaaaaaataaaaaactacatattgggtacaatgtacaatacttgggtggctggtgcactaaaatctgacttcaccactatacaattcatccatgtaaccaaaaaccacttgttctccaaaagctactgaaataaagaaaaagtgccttgacatgcatgaattcatgtaatcctcacaacaacactctccctactttaaaggtggggaaactaaggctggaagagggggaatatcttctccatgcaactatctccaaacagagccagaatgaaaaccaggtgtgtaacaccatagtagttatttggtcattactcttctcacttgccaggagtgaacgctgcccagcctccttcattctagaggtgaggggtaccaggaataaggttataaatacagtatgtcttaagaaagatagcttacctttcccaagccagcgtttattttgtgccaggcactgttctaaatgtttttgcatgtgtatctaatacaatcttctcaacaatcttatgaggtcggcacaattcttctttttttaactaaagaactttattaacctttgtctcaaactttattcccaggcttcttcatcttaattagctgcaaagggtgaattgtttataagcaaaaactgaaaacagctgcagtgtccaaggggcttgggcttaaaaatattacagaactagattttatcagatccataaacaaaaattttttaaaagcagtcataatataaaatagcagctcccagtaacttcttcaagttttatcttcttcagaagttgactcaattcagtttgcctcattcttggaagcctcatcaaaattttctacaagatctggaacttcatcatcgtcatcctctccagtagcaagtggtgctttccatccacgtattgtttaggcagagcttcagccagtctccttaaactagccaaactgcaccaagctggtttaagatgctgcatggcatttctgtcagctgctttgtcacagcatggcctgtaatggtgaaagtgttcactgctagagatgcctaaactttagggttgttaaagtggatcactgttccttggtttgtaaacatattcacctcttcaataccagagacagtgtttacctctaacttctttaaggagaactgaagtttttaatcatctgctgtggctgttttatgaaccacctccttctttctgtgagcagttcctttcctgcagtttggtgggttttcctggcccatgattgtttctttcatcttgtcggagtggatgaggggccgcgtgggggactagggttggtgatcaggggtcttggatggctcagctgaggttaggcacgcacatgcagagacacaagatgggagatagaggggcacagttctttagtgaggaaaatgcaggtagggcatggaggagagggacactcagttcatacgctgagaagactcaaatgacttttgccctttcttctttcaccattgtacattccagagaggatgaaaactcagagaagtcctttgagtgtttgtgaggtgcatacattggggtatgtaaaggcagtgatgcctgacagaatgcattttgtagacataacaggcactctgttaccgtgaacctcaggcaacctgtagccatcaagcctggagctggccctaagagaggacagaggcattggtagcaaacatttcttttggcccaggtaagatgccactgaaccagccaagcagtagggtgaggggaacaggctgaaacaaaacacttcagaagtcattcctagaaaaattacctaactcctctggatatcagtttattcacacacaaatggggcctttctccctccctccatttcctcctctcagtgtgcatacacacacattcattcagtcattcagtactattgagcatctgttatgtagcaggcactgttttaggcactagatgtgtgtacaaaacagacaaaacagatggtttacaaaacagaccaaaattctgtcttcagggaacatatattctagaaggaagttatatgctaagtaaatgactaaatatgtaatatggtagttttacattctaaggagaaaaaatacagcggggaagagggataagaaatatgtatgtgggtggttaaaattttaggttcctatttcctgctgcatttccctcacaaggttgtcatgaggttgatatgtgataaaaagcccagtatttaggaagctgtgaagttccgtttacatgtaaggtgcagttattcttgggcgataattttttctagttccttatttgctcttcccttctccattaacagtatagtaaagcttcaagaattctggccgggaggatgggaaactcaggttctaggcttcactctagcatgacaatttttaaaaatcccaaatgtgtagaactgtacagattctaaaacacttttcccggaactgggtcttctggctgttaatcctttgttctttccactcttccatgaagcagtaagagcagtggcaactcatttgcttcctcagaaacagtctttcccttctggaaaatgggaatgatgaaccaccccacccccaccactacccctttccagtctccttgggcttttgtgaggtacaaatcagataatgcttatgaaacaactttctatgtcataaaataagattgtaagggctggttgctaaggttgctaagatctagagagttggtgctcctgcttaagcgagggtttttttttttaattttttttatccttgttaactgggtgtatgtgtggagtggtgagagtgagcctttggaactggtgctacttcctttcctttctgagaagcagctgaggggagcaggggcagcactgagccccagcatctcctagaaataggaacagttacatggaaacacttggcatctcatgatagactggcaaccactgatgtgcagctcattttgtccactctgcttttgggaggtgggaactgggactcatttcctgaaacttaatacacaaatgactcatggcctttaaagacttccacttgcccctgtgatacaatctcatttggaatgctgggggtgggaagggggagccttgaataggtgagatcttcatttagtacctcacctttttctactatgacaattcttttgtgttgttttatttttcttcaacttttaaattccagggtacacgtgcaggatgtgcagctttgttacataggtaaacatgtgccatggtggtttgttgcacagatcaacccatcacccaggtattaagcccagcatccattagctattctccctgatcctctccctcccccagccccaccaacaagccccagtgtgtgttgttcccccaccatgtgttctcatcattcagctcccacttataagggaaaacatgcagtgtttggttttctgcttctgcattagtttgctgaggataatggcttccagctccatccatgtccctgcaaaggacatgatctcattccttcttaattctgcatagtatctcatggtgtatatgtactacattttctttatccggcctatcattgatgggcatttgggttgattccatgtctttgtgattgtgagtagtgctgcagtgaacatacacgtgcatatatctttataagagaatgatttatattcctttgggtatatacccagtaatgggattgctgcattaagtggtatttctgcttctgtatctttgaggaattgccacagtgtcttccacacttgttgatctaatttacattcccaccaacagtgtaaaagcattcctttttctccacatccttgctagcatctgttgtttcttgactttttaataattgccagtcagaatggcgatgagatggtatgtcattgtggttttgatttgcatttctgtaatgatcagtattgttgagcttttttcatatgtttgttggtcacatgaatgtcttcttttgagaagtgtctgttcatgtcctttgcccactttttaatgaggttgttagttttttccttgtaaatttgtttaagttccttgtagattctggatattagacctttgtcagatggattcattgcaacaatgttcctccattctgtaagttgaactatgacaatttttgacatactaactgaatttttcattccatagagtactttcaaatccatgatctcatcatctctttgacaggtattatgtcttctatttatagatgaggaaactgaggctcagagaggttatgatttgcctaaagctaggcacatataatcacaccctcaaataatagtatttattgtcatttactgagcattactatgtgctggacattgttctaagtactttacagcttttcactcattaaatcctcatgaaaacctacccctgttttgtaaatgaggaaactaggtgactgagagtcaggggtttgctcgaaatgaggggcagcatgagtatcatgacattataccattctccctgatttaaagatgagtaaagtgaggctcgatgacattaaataagttgttcaagttctcacaactagcaactggaagaactaaggttggatctcagtaggctggttctagagcctgtattcttagccattaggctatatactacttctaactcttaggatcttcctagcttgataaactgaagcacggggtggagggagggggtggggaaagagagagagagagagagaacttattaagatcacataatggatttaacattttaaaatttaatatattaatacataatatatttatatgctaaaaaatcaaactataaaaatgtgtacagtctgtctctctatctacccatcagagatcacaaacttaatggctttctatgtatccttccagagtttctttatgcagatataagcaaatccaaatatatttttcccctcttctttacctaaaagatcacacatcataatactaaatttgaccctttaacaacatggggattaggggccccaaatcccaccctccatgcagttgaaaatcaacgtgtaacttttcactccctaaaaacttaactactaatagcctactgttgactggaagccttatctataacaaacacagttgattgacacatattttgtatatgttttatatactgtattattacaataaagtagctagagaaaataaaatgttattaataaaatcctaagaaagtgaaaatatatttactattcattatgtggaagtagatcaccacaaagatcttcattctcagtgttttcacattgagtgggcttaagaggagaaggaagaggaggggttggtcttgatgtctcagggatagcagaggcagacgaagttaaggaggtagaatgggaggcaggagaggcaggtatacttggtattaacttttattgaaaaaagtcccggtataagtggacctgtgcagttcaaacctgtgttgttcaagggtcaacagtattctgcatcttgctttttccacattgcatatcttcaaaatctctccctatcagtccacagagagcttcagcagtcttagctaggccctcatgaatttctataagcccccatctatttatgtgtcctgcactcttctcttctttaccaatatttggggatgtccagccctttcttaacatcttcacttagagtctcattgctagactatcttggccttctacagaaaatacagctcctcaaagtgaattccttagtctccctccgacatataatctagcctcttacaaactccccagctatacttacctcctttcttgttttgcaatttcaacatattaccatatcctggctacctacctgcccacctacctgcttatctatgtgattcttgttgagtacctcttataagcaaagctccatgcttaatttgatgatgagtgattgtgtcccgaatgtccaatggcttgcagttcaaataaagcttgtaaacaaatacacctggacatggaggtcagaggggcttagctgactgaatgagttatgaggctcaggagtggaattatccaggagattaggctctacaactaaacactgggttctgatactgagagaaatgttcactccccaccacagtcttgaactgatgcatgattgactttagctaccccagaaagatcctgagcttgacagaaaaccattgtacttcctctaaaggggcttttagacctttgctgctcttttccaaccagttctctctctaccctgagtagagccagatggtctggcctactagcttgcttgaaatagaactgaaagaggcctaaaataaatgtgaaataggcccaaaatagattcatgtgaaggaacagaaggaaactgctgtttcctgggtatttactcaggtatttattcagtcattagccacaggagggtggtataggcagtttttcttgagggaaaagtttctgggtggtggtttagggtggcaactatgtcatcggagaacagaaaactaaagagatcttgaaattctcaaactgtaatctttatagtaccttttggaggagtacttactaatgaaggcccttggggtgggagaagggtgaagattggtattctcaggctgtagcagagaatactttccataacaagacttcctttacattttacattgcgagtcctcagggctatgccttgctcttcattcactcattcattcattaatttagttattcagtcattaaaaatatatttattgagtgctaagcactattttaggtgctgaggatacagatatgaacaaagcaatgtgctttcatggagcttacattttataaaggagacaataaatcaataaacaataaaaatatgtaatattttaggcagatgtaagtccagcctctgcttcttggtagctgtgtgacctcaaacaagtctcttgtctccccaaaagctcaaacggctgacttatttttagtggtagatttttaaaagcattggtagttttaaatcttcaacagccttgccaaaggtgtggcaggcatacccttggtctcaggcggtaacctgcacaaatgaccatgggtgatttgtggctttggaaagccaggactgaggagctaatcactccatgagagggtctgggataataatgccctcaaattcacactagttctcaggtctgaaaggcagttcaatagattatgataatgatagttaacacttacaaactgctttggaagagtggctttggaaagagatctcaattcaaatcctgctactgcttcctcaaacttgtatggttatgggcaaatgatgtaaacactctcaggtatagttactcttttaaaataatgataacaatttcttcttctcaaacttctagggataattaagtaaaataatatgttaaaaggcctagcaccatgtgggcccaaagtaggtgagtaggtgtttccttctcctcctccccctcacctttcatgtactatagagaggatacctacacagggaggttgggaggagatgatctctttttcccttttgaacataaaattatttatttgttcgtaatcatcaacaactttattcatcacctgattgtgcttgggatacttactgtatgacattgaaattatgtgcatcactgattagctctcccactaaactgtaaaatccctgagatccactctgtatcccttagctgtcagaataagggcttattgaattgaactgattttggaggagtagtgatttctgtgctgaataattgaactaaacaggagtttttgtccttagggggcagcctgtcttaaatagagatgatacccatgaacatgcaagagcatctagtcgtatcagtagctaagacaataaacagacaggattcagtatctgtagactgtagcaagcatgagggactatgaggaagctagggtaggggttggatgggaagtgagcagcagtggagatcgggacaaaaaaaaatggaactttgcctgggagtgcttcctggcagaagtgggtctttgggagctatgcaaaacatgagaagcaaaggacaaccaggaatttttttttttccctgacagaaggaaaaggtttgagaactagggatcttgggtttgggaggtaggccactgaggcccagatgaagacactgaaacagtttatccctgtgacctaggagacatcatgtcagatgttattgaaagatgggacatgtgtcacttattggcatttatatagaatagtgtttaatagcagactctagagctagacaatttgagtttacatctgcgctccatatcttactagccatgtgaccttaggcaagttatttaacttcattctgcctcagtttcctcatctataaaataaggacaataatagtacctaccgtacctacctcatagagttgttgtgaggattaaaagagtttatgtatgtacagggcttcaaacagtgcctgacacagagtaagcagtttgtaagtgttaactatcattatcataatctattgaactgcctttcagatctgagaactagtgtgaatttgagggcattattatcccagaccctctcatggagtgattagctcctcagccctggctgtggtagaagtagtgacaacatctggctcaaagagatggaagaactttctaccatctgagattgtcccaaagatgaaggggctgtcttgggagggaggaactgccccatcattataggtgttggagctgagaccggataaccaattagtggggatgttgcagaagggatggcaggatggaactggagttgtgctagaccaagagattatctaattccttgagacttgtcagcaagaaggaatagatctcgggaggggtattgctactccaaatgtagaggactccattaaaaaaaattgtgagcaaagttgattggtcacataactcagaaagctacccacacatggacagggctggtatcaaataccgtgttccagggtctgaaatctctcaaaagtacttttgagacttaagatacaagggctttggttcccactctgccagcaattagctgtataatctttgacaagttgcttcccttctctgtgaacctggaatataagggcttagatttttctctgtggttccatcaggtcctgccttctgtggttggaagatatgagtctttgagtggagaccagtggatgaaggagacattcatgcatccaataggtgtttgttatgaagcacctgctaagtgtcagacactgcgctgggcacaaagggagaaagcagtgaacaagacagtcgtggtctctgccctcctagcttcacagtccagtaaaggatacaaacaagaaaaaaatacaatacagtttaataaatgtttcaagagggctaaacgtaggatcctatgggagaggactatcattcagaatattgttgaggaagagaacattagagaaagccttctggaggtggtggcacctcagctgagctttgaaatggggagctggaaaaataaagcagcagtttatataggccctgaggcaagagaacctcatgagttatgagaactactgtaggttctatgtagctagagaacagagaatgagagggcactggtaagagctgaggatacagaggccgaaggacatcagattggcaggacattttatgccacactacagaatttgccttaaatgcgccgaggagctattgaaggcctttgaacagaggcattatataagtcaggtttcagctgcaaaaataaaccactgtagttcttttcagcagaaggagttttaatatagaaaataaagtgcttacaaaattggtgggagggctggaggggcaagctttaggctatgcctccaagaacagtgtcagggtagctgctctctctgacaagcaggaagatgaggcgtcaggggctctaggagcatgctgccttgtctgcaatttaggaatgaggaagctgccacagctctaaccatctgttggctagagtatcactatgcctaccagatcctcagtgacaaaaaaaaaaaaaaaaagtcccattctctggctctcagaatgcacaaagccaatggctagacactggaacctacggtaacacacacaaaaaaaccccaacactttcaccattgtgctttccaacagaagcaacagagacatgacttctggctcaccaaccacctccttctaaatactgtgcatgtgcatatgattggcatcactatgtcatatccagaacgctggctgcaaaggaatcttggaaatgccagtttattgttgttgtagtttttttggtttttagcttttcagcaatataggaaggcaggctagaaggagtggatccttaaaaaccaatccagagtatctacccaagattgacaagagcaaaactgcttttgaggaaagaatttgggcagaagagtagaggcttaattggggagggagagcagcataagataactggtaatgaattgtgatggatcagagatgatgaggaactgattaaaagtagtgacagcaggaagagagaaagggacaaatgagagagattaaggaggaagaggatcaacagaactaaaagacttgttggccaccagtgaggtgagggagagaaaaaacttgtagatattttcttggtttctggcaagctcagtgtgtgactgccattcccaggagacaaaggactcaggggaagaaggaaaccagcaagagtgggaggagatgacttcaatttgggactttttaagtttgatatgcttgtgagatactaaggaggagatatccagaaagcagtagaactttcattctggggtccaggagagctaccttggagtcatcagcagctctctgcttacgtgcaagcaaggtcctatgtctgttttgtttcccagtggtggtgtaattttgtagaaaggaggtgcatcaatgtgcaatgtagatggtagttcaagccttggaagtagatgagcccattcagtgcaaatgcagaatgagaagaaaaggggactgcaatcagaagaactcagaaatcatggcattaatgactggatgaagaagaacccatgcaggaagtgaagacagcataaacatacaggtcatgtggatggtgttcccaaggaaaaggagcatttcaggattgaggaaggcatcagtggagtcaaatgggagaaaagttacgaaaggtaaagattgaaagttggccatgagatttagtaacaagttggttgttttttttcctattcacaagaggtttcagttttctataggacaatgagggtaaagccaggatgcagtgggttgaggggtcaaaagataatgaggaaatagagacaggataagactgaactttcaaagactaggagaaagactgtagttgtttatattatggtactgtcctgatcaccagtatctgtctcaacataatctagaagagtagttttcaaaccgttttgactattacttgctataagaaacacatttcacattacaggccagtacatttatatttatatataactgaaacaaaagcatcatgaaacagtatttacgctaactatatgaacattttctataaatggaatcttacaaaagcctttttctcacgtctttcacttagcatgttttcaaagctcatctatgttgtagcatgtatcagtagttcattcctttttatggttaaataatacttcattgtatgtatataccacattttgtttacccattcatcagttgttggacatttgaattgtttccatcttctggctattgtgaataatgctgttataagcattcatgtataagtttttgtgttggcatgttttcatttttcttaggtatatacctatctgttcagtcatataatcctataatataagagcaaaaaggctctgagagatctcctgtataagggaatccttggtttgaaggcccagggaaccactgaaattgtttttttctgaggtgagtgttctgaggtttaactgaattctcagataagtctaagtcctcattgacaggagggagacagaagacagacccctgagaggaaaagggaattgcccaaaagtcatacagcaagtttgaggtagggctgagagtaaatttgaaaccttctggtctccactccatggcttttccctccttagctctagataccaggtcacagagcagggcaatgattagaagcagattgcaagttctgtagaggattttccatggcgaatgtttaaccctatgctggcttcccttcatagtacccagaatgctggaaaattgcaagctaactgtcctagtctgaagaatctataatcaagaaaggaaatctgaccaggtaagggcagtggtatcagggaaagccaaatagaattggattttggaaattctgtcgtgtgtccctgtgattctgtccacaacactggtttgttggctttttatagctaattgtgggttgcctgtaaattcttaggcagtggccaaaagcacctttgcttcctccttggcccaggctccaaacaaagtggctgctaggcacatgcattctccacagctacctatccgtttttcccccattccttctttctcctcaccatccttttttctgcctttccccacaattctctttcttcattatcttccctctcttctccttcctcctcgtcttttcttctttttctccctcttcacgtgatctcctccccttgcatcctattgggtcccttccctccctctttcccagtccttttcctccccatctccttatataccccctctatccgcccccaagaagctccccacccccaaaccagaactggtggctggtgactctcgccggtctggggagagcgagcttgcttgggagccttgaggctctgattggcggtcgcggctagcacgccagcgcaagtcccgcccctgggcagcgaacgtgctactgcggcatctgttattggtcggcgggtatgtcagtggctctggccgcgcctcacgcaagcgcccgcagtcgctcggtgaataaaaaggcagcctatgggctgagcgggggatggggagagaagagggatagggccagcaaggcagggatcgaacgagtgtctggcagccgggagcccagcgaagagagcgagcaagcttaggaaaacgagcgaagtaaagggagtaggggagactgagactgaccggtagccaggcaggcggacggacgcacgcccggacagactgagcaggcgccggagaaccactcacaggttccccccgcctttccctttgaaagctaggattttgcctttcccgtggcgcccgagagagaatgctggactctgccgacttcagcgcaagctaagatttctcagctagggacaaacgatcagcccaatcctgagaaggggggaaccaagcaccccgtccccatccccctcccctcccccgactaaactcgggcgccaaacccagcccttctctaaccaccctacttcctcctctcctttctagcatggtggctgtatggacagtctgacagaacagagactgacatctcccaatctgccggccccccacctggaacactacagtgttctgcattgcaccatgaccctggatgtgcaaactgtagtcgtttttgccgtgattgtagtcctcctgcttgtcaatgtcatactcatgtttttcctgggaacgcgctgaatggagtccagccacctgagctgtcgcgaactctcgctttgatttcatcccgagagccaccgagaaaaaaaaaaaatcacagacagagacagggaaagagagagaaagaacaagctttcttactcaggggggaaaacgttttgagcttcaacatggcctcgctgtgatatgtatgacgttggtatattatctctccctaaatcttttgtcgtgtcttgtcttttaagaatgcctgcgcgtatagttgcctattgcttgagtgaaattgttgatgaagaaatgctttctatttaagtgtgcatgcgtgtgtgcatttttaatctatgtggcgttcatggagcaagctctgcgtccttaaacagtggctttgctgtctgtggtgtcttaactcatttccttgaagactacctttaaactccatcagggaattttagtcaaaatttctctcttgccatcaggagtgcatttgggtttgtttgaggggaaaagggtttgtggaagagcatgatgaatatttgacatcataggaaagacagtctttgcagtggatatttagagggaaaataatcgatgcaaggaatggatttagggaaaatgcttctttagtgtctaaggagaagcaagaatttgggaagtgacacgggtgtgttgtgctggcagttggtgactgtgtcctttgaatctcaatttgctctccagggttcacaattttcaattttgaaagaagccacatttaaaacacttcttgaaccttaaagctttaagatatttaaaatgtcaatttccttggaatcatgaaatagtatgtgaaagcattctctgattttttgaactggcaagagaggactttgacaggagctatttgggctccctttcccaaagattgtacccctggatttgagtttggggattttgtttgtctcatcaaaaaaaaaaaaaaaccccacaagaaagaaaaaacagctctttatccaccttgggaataatagtatttggatatggctcctttgggataatctcgtttgcaatgatgttcttgaactacattttaaatgtaacttgataaggctgatgagaaagtggtgatgctattgtttgctcccgtttgttactttaagatcagaggtctctgtaattgaaacattcccataacaaactgaaagtctgtaatgtgctaaattaagagttatcaaattttggtgctaaatttgaccaccaaaacccaaaaacgtctagaaggaaagggatgagagcatggaaaacatgagctggaagcaacattccagtttgagatatgactgcttgtctgtatcagatggtggtggtggtttctgttgttattgctattgctattatttttatatttctgtttcctctgagaaagctcttggcagagccaggaaaaaaaatgtctcatgccagtctgtataatacttgtttttttgcgttttgattttctttctcccctgttaatgtaggcaggctttccccattccattgcttacctggcttgaaataatgccatttatggctcatgtattatagcagtgaatcaggacacatacacatctacacacatgctccccctccacccatgtgggtggctgttcatgtctgatgtgcaaatctgctggcattatgctgtcaagttccatgtccggttgttcagtctctttggaaatgattatgaaaggagaggggctgtgaagggggcctttgaaattgtcttggccacaggacccagagagtattatttaatggcgtcagagggtgttttgggcctcaaagcatgctatccttgacttggtgtgggtgagaagctgaggtttttgtgagattagtaccatggtgtaaacatgatctgggaggtttgctggcattggttcttattaattactctttggtccgtttgtggagaccccctggatggaactgagaacctatttctttgcaaagataatttagtgagtttttttccccccttagcttcattgtattatttaaagtaagcttatatcttttctgggcactttgttttgatacagtgttggagagtggggaatggctctatgctgggcagctgcagacctgtttttttgttttgttttgttttgttttttgttttttccattcagcagctgtttgaccttggacaatttttttcctcctcggtgggtttgggattcccagtaacattggcattttttgatggctccactaggtgacttccaagttcttgcattttatgattttatgacccctagacacttgaagttgtggggggtgggggggatgagctggaaagacaagtgaaaaggaaaagaaaatgttaatcaaagggtgatgggaggaggggaaggatatctggtactacagcctggataacaagtttaagcgaaggggttttttttgcctagttatttgggaaggaaactgggacagcaataagggaatgctttttgactttttttcccccaaggggagaaggggtctctgagactagtctttgatctaggtttatgacttaaatagtgtcacgaaatgccttctcctctgtgagcctgacagacctttggcagaaagcctctgggaatgtatgtgtgtgtgtagggtgtgtggcagtatgttcatgggggtgtgtgggggggagcacactcctgagtgtggatgcggggtgtggtggtaggaatgaagaaagacagtattgagttccacagttctgaatagcctccttgtgctaggacctataaggatttcacaaatgctgggatggatgggtatcacccatgccattcctcttttcaccacctaaaacccctcaggctaaggaggtgtcttgaatgagcccttccattagtaatttagctgttgaaatgggttagcgcttttaaaattgtctccaggcaaataaagggatgttgctagccagatggcaggccaccatctagcaaccagaagggaatttgagagtagagaacaaaaggtagcagtgtgactttttacttgtgtgaatcctaaaggtttggcatttctgcttcagacttgtgaggatatttttctctagcaaaaagagaaaagagtgggagaaaatgagaaatgcagcccagagaagcggaaccctatgcattttgacttgtcttcttttttccttcctcctctgccttctctcttaatctttctccttcttcctttcttcccacccctgacaccacctcctcctcccacctccccactgtaaatgggtgagaagtaaaaaagagaagaggacttttcctctctgatttgtcccaacttttcccaataaagctcctccattcccttccctcctctctggcccctttgagtagaggataagcttttgccatgtaggaggggcaaaatcccagcttagggattttcgctcctggatccccatcaaagaattaaagaaaatgccctctactggtatcctagcaacccctgtatcactgagcacccactgagctccagagcccaccctttaaaggcccaggcaccaataactctagaaaaaggggactagagcctagtgggacttggagagatgcttttggggagggaacaaagaaagaacagaatcccaatttcctgcaaatgcctcggaaacatgtccacagcagacatgtagagcctagcctcgtccagctatgagattatttattagaaaactcctggtttcaaattcctttctagtcagtcccatctccttaagattaactgtgccattttactgcctagctttagtgccagaagctctgccggtcctgaaaaaacaatttttttcaccctaacttttggctgcatcagggagggggtgaagtgatatcttggtgggaacaaactgaacagcattcttcttccattgagacagcctccatctgtcagaacctgcagtgtgcttgtgcagtgtgccccaattttgtctgtggcttggggaatcctgatcagcctagctttatagaatttgggaatttttctttctgtggttttggtgtagtagtttctgacgggggaggctggacaagttgaaagagcaagtttgataatggagctggtaaacagggcttggaccctggctcagagactctcacccaccggtgtgtgtgtgattcagctactagggagctgaaagatcccaaaaaggctgtaggtgaggtgctcttctgcccttgaggtaaggcccagattgagagcaaccagagggcacagtctggtggtttgaaggatggtaacaaagcatgtcttcctctttagcctttgtctgccatctcagtttctggtcccttgacctgcagagtgcttgctctgggcagggatataagaattgagccttttctcccaaaataactgcctcctcagaagacctcctacaaggcatctggatcttgctccagtggctttgccccaagaaatgggatggaggaggggaatcttggactctctagctcttatttccagctctgcaacttgttctaggccaactgagtctctggctttccaagaatccttgatgaaggtttagcttctccagtatctgctcagagtgtctccttctgtcttaggtggatctagctccatagagtatttagtttattgtactttgctctagcacgaaagtacaaagaggaaaaactagaaggggaagaacatagaggggagagaaggctcaggaagcagtccagtaatgacaatactaataactccttatcagtgcacgggcctatagcgtttatgaaggaatttcacatcctttctaacttgagcatcacatcagccttgtgaagtgggtagagatgattgtaattcccagtgttacagatgaggaaagtaaaggtcagcaagattgttgggatgggagtgggtctgcctttcaaatagagaggagagtcagagttggtcattcctaactagtgtgatgttgaatgtagggagggagggcctgacgtggtggctcacgcctgtaatcccagcactttgggaggctgaggccggtggatcacctgaggtcaggatttcgagaccagcctggccaacatggtgaaaccctgtctctactaaaaatacaaaaattagccgggcgtggtggcacacgcctgtagtccagctacttgggaggctgaggcaggagagtcacttgaacccaggaggcggaggatgcagtgagccgagatcatgccactgcactccagcctgggtgacagagcgagagtccgtcccaaaaaaaaagaaagaaaaggaaacaaaagaaagaaaggagatttgggagtcatccctgaagtcatactagcttcctcagctactcacatttttaataactttcatttgtatagcacttttgctcagaattttcattctataaaatgcctttttgtcttgaatatgcatcaaagagttctgtttagttttatgaaaactcactatttgggatcttcaaggtgagaggccagtgtgaattgctgaagcctaaaatacagaatgttttcaaggaactgtagttttaatacaattgttcttctctttgaagcacacttatttttctatatttctttaaaaatctgctgcctagaactgttcatgctactctaggtgccacctgactgagatcaagtgcaaaagaactttgttttgtctgtgaaatgtctaataatgcagccttctactgattctcaaccctcactgaacattcagatcacttgggaagcttttttttaaatacccatgccaggtcccctatctgaaagattctgatttaattttcatgggctagatcccagggagctttatttatttatttttttaatttaaagttccctaaggtgattcaaatgtgcagccagggttaagagttagccttttgagcatgtaggtccaaaccatttactgtctagtccagtcctctactctcttgtgaagttggccacttcagggttttttgaaccaaacttgctacattttatcttgacatgttggtccattattctagctttctgtggattttaaaattttttcttcatgctgtgctacaaattagcagtcccttctagcactgcatcagttaaattctatttgtttggttggactattgttctagcctttgggaggtttttattttttttcttcatgtcacacaacaggttagcagcctcttctagtgttgcattatttgaacaccaaataaatggcattcgagtcgttgattcaaagaaatgtttactatgatatgattaatgctagctcttctgtcacctcaccagagcccctcttggagttgggacttgttaatttttgtatgtatctggtcaaccagtgcagactgcacctggttgtgccagcatttatcctaccagggtgttaatgtgaataacatagcacgatagatttgttgtatgctttgtgggcatcaagatatgctaggttcatagcaagcatctgccaaactgatagccccatcagaaaaagcagtataagttacttggcctcttactcatggtaaatctggttgcaggctccagagcttcttgttttctttctgtgcctacaatgcaaatgtttctaaactgggttcagaacttggctgagggtcagtactacaactgtagtttctgtgtattactttctcctctttgaaaaagcaggacataatggatttagctttaaaacagaatatattttgtgctcaaagagttccggaaattctttgtgtatgtttctcttgttgttttgcttaattgtttccattaacccagtggttctcagcactggctgcacatcggaatcacctggaatattaagagtaacaacaattcctagaatctttgggagagatctgattgagttgatcatagtggtttcctggcatcaatatttttctaagagttccctgaggtgatgggaatgttcagccaggggtgagaatgactgctatggaatgcttcataggaaatgttagctcagcctgtctgacttatcacacatgtgactaggcaagcttcacagatggtgaaattttattctaggactgtgggagcctcgataagtcccaggggcttgtgctcactctaaaaaggaggaatcaaccctagggaatgagtagtctggagacctaattgtatttaaaataatcagctgtgagatggtttgaacacttcaggaataaaaaaaaagtcagttcctacacatttgctgtaatgatggggaagattctgctcatttgctagtgacctcaggcaaattacttctctcctctgaaatttggttttcttcatcagcaaaataaggataggtggatttgatgacttcaaagatttcttctagctccaacaatatgtgcttattttgtgattaatattaatgatcaacacgagtacagatattatttaaatctagcaggtaatccagagatccattttagcaggtttagaatacacagagtggttttaaggatagcagttttgccttcttaattatacttggcttaggtttcttttagaacaagtgaacttaggttgtattctttgagcacacactggccgccaagcaggaaaggagactgtatgaacacgcattggctgccaaacagggaaggaagtggtacagtgaattgagtagctagggtatgccagtttgggattctgtttattaaagagatatgtcatggataattgagaattgcctctcatagatataataccagtctcataggtctgaaaaagatggattgctttgacagctcagagccccttcctgcagtattttaagtagccattcacttggttaataatactacttctattaataagaatttcaacaaataaggtttcctatgtatttcatgggcttcttcctcaaacctaaaagtagttaagaaagtgaggctcataaagattaagcagcttactcagtgtcaaacaggtagtggtagtgactagtggtagtggtagttctagtggcctagaacctaggcgtcttgataccacatcctgcagtgcttctggtatagcctgcatagtggactctgtggtcaggatgcagtcatgactctgagaattaaaggggttttactgacatagagcagtattcaggaggaagctttgaagaaaggagcaaaaggggcaatgtggaggaagaaaaaaggtttagagagggatgtgttcaggccagtttttctcttgcccttatcactcttatgtgctagttccaggcccctgatgggaattggccattgatctttgagcaccaaggttgagtgttggtagcagagaagaaggaaagttgtacatgcatggcagaaggatagcatagggaaggcagacttgcagtaggagaaaaaacaagaaaaggccttaggagccctaggattaagccctggctctgtacctaccttgctgccagatcttgatcaaggcccttcccacctaggcgtcagcttccacgtcactaaaatgagagtggtttcagtagaagaactatgttctcaaatggaatgttagccagaagcttctatataaaacaggaaaaagcacagatggtctggttgaaatgggcatgggacaggtatggaggacagagtctaaagttccagggaaccatcttgcgtatgcagattttggtcattaggggaactggaattagaagagtggagatggctctgccaagcccagccatagtgcttggggagatagagcatccttggatagagttgtgtgatgggggtgggtatttcatttaagtggccaggatttacagagaatcacttaggggcagatattaaagtgcctagtacaacacactgcccccattcctttttttacaagtgagaaaactaaggcacaggaggggaaagggatgggtccaaggttgcagtgatagttctggaattctgattctttagatagggctcttgcctgctgtaacttgctacctcccctataggtttctggctctatgctcccttggctggatcagagacctgaatgctctttcaggtttggttggagaaagcaagctgacgagaggctgggagaacaagagctttatataacctcctggagagggagcaggcctgttagtagtccttggagttccagggagtaggatggggatgaggggaacacagagtctcctgaaggccacattagctctcctgaggcagagcagtagatgcagccctgtgagtggccatctaccctcagggcccagaggaggccagcactgcacatccatagccagctctgggaatggctttggcagctgatttctccgcctgcctgccttcattagagaaaggaaagccatgtacctccgtgcccagctggctgcaggaaggatgtactaagagcccaccccccaccccctcagagtgtggtgcctaaaggcagtagctacttttagctgaacctcccacagcctctcctccacccactctctccctcctccctctgtgaattgtgcaggatggcaagaaggctggggagtaggtgccttggcattgggatagaggcagaggaggagctaggcatctctaggaggggctctgataagccctgcatggcaggagggcttagaacaaaagcaaaatgatgagattgctttgtgcttaggacccaaagggagttgagggatttattaatttcctttggagcatgcaaccagctgaagttcatgtcttgtaaatttagactgaactgcatgggaagacttacactctacttggattaagaggaaagcaactggggctagtgggtactcacttgattcttaactactcctcttgaacagtcttacacttttcagtggattttgtacatcgtctcacttgattttctctgtggccctgtgaagtgggtagggcagagattatctccatttcacaggtgagaaaaagaatgttcaaagacttattgtcacatagctgcttctagcctggccttctgggcttcagctctggaagttacagtgccacttaaagtcactgcagacagctatattttctagaaaaataggtgctggagctgtcctgattctaatctcctcattgtggaagctggggaactaggtccagagaagaaaaggacttgccccaggaaatgtagtacatctgtagtagtgctggaattagaacattgccatgcaaggatgtgaattcctggacctgcaagatgtgcaagccactgtggtctttcaagggttgtttgggaaacctgtgtggtgtgatggaaagcaaagtgtcacagaactaggagtttgttatttttcagttcaggcagaactgtgggtgactgccccagtggaggcctgacactcagtaagccctctataaagatttggttgaatggaagatgtacacatgagtaaaaaggaggtgcaaatgtgaagtcagttgctgtgtgaccttgaacaaatcccattgtctctgtccctcatttctgtctgtcatttttggaggactctttttacttctctcccttggaagaagaaaggccctgtgacccggcccatgtcttgggtgcttggtggaaagctgttttgttttctgatttttgttgttgttgttgtttttaaataagctttcttttatttatcccaagctccatttcccatgcagtcacacactcgctgctatgaagagcagactaactttgtctctcctcatctcctgcaaagttaaaagaggaacttggaagaaagccaaaattaattgtgtttttatttagcaccttcttaagtccatcaagccataaaccacttaggcacatggcaattaaaaaacaattcttggcccctagatccttggctaggatttgtgatggattactgggttttcatgatatgatcaaaaactgttttagaaattgcaggttcttgcccaatgagctgtgtagaacaaatcaacactcttcacttatactcgcattattttgtttggaaacatctcactgatctgggggcaggacaagaagataaagactactgtatagccttctgctcctgacacatgttcttttctccattacactattaggtggccaaagccaagattattttcccaattttatggctaaggaaattgaagctcagagaattgctttgattgactcaggtcagtactgcatcttaaagtcagtggtgagctaggaagaacatagtatatagcgttaggtattatcaactcaccagtaccaagtgtctctaggcaagccatttaagattccctctgtagtttgcttctgtctaagtattttgttgttgttgtttgtttattttttgagatggagtcttgctctgtctcccaggctggagtgcagtggtacaatctcagctcactgcaacctccgcctcccaggttcaagcaattctcctgcacgccaccatgcccagctaatttttgtatttctagtagagacggggttttgccatggtggccaggctagtcttgaattcctgacctcaagtgatccacccacctcagcctcccaaaatgctgggattacaggagtgagccaccacacctggctctaagcatttttacaaaagttaatcaagatagaagaaagaagtaggcatatgctactggataattggataggttggcattgaaccattaattggtattttggtgcatctactggatctacaataaattcatctggatatcacattgtccagggatacatgagaggcctttcaaaatgaagaaaagtggccccagattctgtagtctttggtgacctacttagtttggacgctttctctctgtgggtttatctggccatgttcttaaagactgggccttgatcctaaaagcaggctctttaccattaccagtttctatggtcatcccaaaggatggggaagaatgatttggataaactacatgtcattttgcctgggctttggtggagattgtatgccattccttttactccagttggttcaggccactgggaaaatgagtgtggaatgacaagaatagggagacaaccaatagcttgctgagggttagagggggcctagctgggatgagacatctgcaggtgctaatccacgtgcacatatctacacactgattctttgtggtgttggggggagcaagcagagtttgtccatagtacttcagctgagaagtgactgggtaacagtgagaggaacccaagcattgagctcgttccttcagtgtacttctggggaaactgaggtctaaggagaggcaggaacttgcccagagtctcagaatttgtccgtgatctttgcctattctctctagtcagccaatggctaatttaccttacatttgtgaggctctttagatgaatgaggggtggctaagcctcttgggaaaagcacctgtgattaccacattcaggaagtgacagagatgaaatctgaacccaggtcttttgtcctgcttaagagcagattgacccagacttgaaggaaggctgttagaaacaaattgatggggaagaaaattggttcagctttgctgtctatccatgctctatgcccgtaccttcacatacacatacatgatagatcatatgtgatgcacacttacacatactcagacacatgggatgtatttgggacacacatgggacacacagctggaacatattttcacattaacacacttggaacacacattcagttaaacatgggaggaatattcacacttgcacattctcagcacaggcaggatacacacacaggaacacacatgagggatacttgtacgcatctgcatgtgtgaatgcacatggatgcatataaggcacaattgtgcacccacatacatatggggcatgctgagatgcactctcagatatactgttacccaggacatgcactcctatacctgagatacacactcctaaagactacttgggcaaacaacactccacacttgagtgttgagtcacacttgaacacacctatgggacatatccacatgctccacacagccatgtgggacatattttgatgcagaacacgtccttcccttagggccagccagctgtcactttttcctaagtgggcatgacagggaactggtcccagctggtgggcctccataagtttgctctggctctcctttaaccttgaaattagacttgagagggcagtatgctcagtaataaaatggatgttcaagatggcatgttttgtagcaggctctgtaaggtaaacagggttcagagcagagccctcagatgtgagttaacaggcagatgcagaagaatggaaaacacaaattgggattgatcaatgcagaaagcttgagcctgctccttcatcccccagttcacttacaaaccattgtggagtgatatggttatgaagcaatgtcaaagaaggcctaaagtcactggatattaaagtttatctttcttgggaatgaaataacagtctggactagagcaaagatatctaaattgtgggtgttagggtgtgaggggaagtggtaggatgcataagcgggagatccctttgggcagtggcccatcctctcctgggttagtggtggtctgagaccagcctcatccttaatgaccacaacctagcccctaggcacagcagcttgggtcatctggccccactaatgaatacctgctatttttagagttcctcaagctggaaaccaggtcatggtgtcctggggaagcctttgtggtccttggtacctaaggctgaagctggaaagacagggccctagattgggtctgagtgaagggtgggaagcagggggacacgtagctggggaataccaggctttcctgggagcagcatcctcagagcctcagttgggttactattaactataacagcctcatgcccatttctcagctttggctttgaggtcaagaaacatgagtttcagttgctactctgcctcttacagtgtgtctcagtcacgttcccctctgctgtctgagtcttacttgctttatttataaaacatccagtattgcccttagatgatggaaaggctcagctaggctaagagttgagaaaatgttttgaagatacacttttctccatgcataaagctgcatcatcattgtccctaagctggattcaattcctgccaacaattggacctgactcctattggagtagctgtagacagcaaaggccaaaaaaaaggagccaagagaagacaccctcatggagtcaggttggtcaaagtcatgctgagattacccccacatatacagatgcttttcaatgccaggtcagtcattctgggaaagaaaacagatttgcagcatttaggtggtcatgtagctttggctcctcaggaatctcctaggtaatgagagaaggggaggcatcaggagcagggatttcttcctaaactaggaaatgcaagaccaggtcacctgtacctgccacctgccagaggaggcagcctagagtgccagctctggctctaagagaatcctctttgtgtttgtgctcatggccattttatctggtttgctgagagggagaaggtcagaaactagactatgtagttcaagtttccccctgctgcagacattgtgggcaaagttctcctgaccctcagttttctggtctgtggaatgggcttaactgtagtctctcataagagttttaagtgcaagacttcattgtgacataggatgtgaaaagtgtcttgtaaaatgttgaacatgtgttcctgctgtttggattgttaagatttcatccaggttgtaattacacatagtttggaggtaattgagaaacttcactttatttctctacccctttcccataccgttcttttaaggcattattatatccattttacaaatggggatactgaggctcagagaaaagagaaacaagtctgaggtggcaggattaggtggtggtagattcaggactagaagccatgctttcagattcccaacccaatgtactctggccctgggctgccaccaatgaattccagtgctaaaggaatctgccagaggttacttaagtaaatatatataaagagttagatttttctctgacaagcagtacagggggttctctggggcacagctttacccagcactctccctgcttgcccaagagagacacgctgattgtcccttcatccctcctacagcagctcatgtcctgctgtctcctgcatgttggaagcagtgaagaattggagatgttaggctgttgtgagaagcaatccttctgccggtttaagccacttcaagacaataggaggattcttggaggcacaaaatccaccttggtcacccgcacctcctcacagttttttgggtacccctgacctgcctaaggggttggctgaaagggatctaaggaaatatatttgagggccttgatctctggaggattgtgctaatagttgagggataagattatggaaataatccaagaaccaaaactgggagtgtctctggagaccatttgggctgaatttcacctggcctcaatgaggacattaaaacccagctgggcttaccttttctcccttagtgtggttttcctttgtacaccacagattctcgtgttcagtcagatttcctggagtctttctagcttgcttgtttttgctattctgagcccagaagagggaaggggtgacacattgagtggagtggtgagaggaaagagatggaggaatctgatgagctcaggccttgaggggcaggcattggaggaaaagggcttttgtgtctctcttcatttgtattgctgctgatgcattattttcctatcttccactgattggctgtgggagcctaatccaatctgttgttatcttcacttttgctgctcaaacctccaaaatgactacagtattcattttgagggatgtcttctgtgggattggataagcagtggggcagggaagtggggtggggggaatgcggtgcttcaggaaaaatggggagaggaactttcttttcttcaaatttgagagcccagagaagtgaataggaaaaggttagctggcacagccctgccaagaagtagccatgcagtttcctaatctcttttgaccatagataccttatttttaaaattttatttttggataggaaatatattcacatgtttcaaaattcaaaaggtccaagagagtgcacagtgaaaagtctcccttccactccctgccctctgcagaggccaccaatgagtccttccagaaaaatgttatgtggatgtataaacaaatatgaatatattcctctttctcttttttatggtaatatacaacacatattgttctgtaccttgctatgctttggagattctttgatacttcattgaatttcaccttttggggatgtgaagatgtgctgtggaaagtagaggttaagagcactgattctagagggaaactgtctgggttcaggtttggattctggctctatgaacttcaacagttacttcattgtttttctgaactttggtttccttatctttaaactagggatcaaatgagttattatatgtaaaaacttagatttgtctctgacacatagtaaacattcaataaatgttagccattttttattattaggaaaaaaaccccactggaccagcgccagtagatctaggttttctcctggcctctgtgctcctgggatagctgggtaacttcctttgttcacaaattagtttccttacctttaaaatggaacaactcatccccactctgcttatccccaggatttctgggtgggtccagtgagctcatgaatatgaaggcaacttagcaattgtgatgttctgagcagatggaagaagtgcaacttaatattttcatagacactactttgggtggcttgaacccagtggtctgaactgggtggaaaaggcagtgtttttccttctgccagtggaacccaaaagccatccctgtactggtgttgtattttgagtgggagatagcccatggcaaaattttgaaatactcaggttttgtcttctgaccttttttattccaccccatccctctcctgacttccttgtttcattttttttggggggccaccccacccctgtcaaaacctgcttttagaagcaaagcagcagcatatgtcaaagatgacctcaactttccatttgaaataatttaatacagctggctcagagaggcgctggatctgcccaagttcatacagcaagtccagaatcaagctacacctagagctcattcttcccatcccagtttttattactgacatttgcattttagtgtgaatttgaatttgagattccttagcaaaaatcatctggtcgtgggggagattctggaagtatctttactaatccttcatactgaagtgttcttatcttttaatcttcagggtcagacctgtttgggaccctgagcagggagggaaagtcaggttctggttttagtactgaagggatgatgtctatagagcagtgggagagaagagcaccagaaaatgttgaaagcggtaacctccaaggtgagacttagggagaaaatattagttctttatatattaaattgttaatctcattgttatttaatttctattttgtggagtttttttttataaaacacatactacattaatatttaaatattgggataggtgtttcttgttttgttttttgtaaaataaattttattgtgtatatttgaggtttacaacatgatattgtaatatagatagatagtaaaatggttactgtagtgaagcatatctgtcatttcacagaattacttttttgtgacaagaatagctaaatgtttgtatttttgtttttaacattagaggtacatgatccaaaaactattggctaccattcttctaagactataggcttggtttctaatcttggcagctctgctgctaactaacttgatgccttaggaagcttttctcattggagcctcatttttcttacctgtaagaaagggaggactgagctaggtgtgctaactagttacttggaaatctccaatcctgaccacctctgagtataagaatccactgcctttggggctcttgagctgagacagttaaaaggagttcaagccctgacaccttactagatgctttatccctctatcagctgccttggtttccttcccttctctacccccaccactttcacctagcccagactggtagatgcttccttacataagtttagcgaacctacttgacattgttttgttacaagcacaaccacttttcctgtagacacagacctggtgccatcccttctgagctttgagggtgtgtctgattttgcttctattttgtcctctctggcagcctaggtttagtcgttgtatccctctggctaagtctttggtttcaaggtctgaggggaagccagctcagccagtttgagtcccttggggcctgacccaatggctgctcactgaatccctctgccacttcctcatccaggactgggctagacttttttaggagaacatagtccattcctgagcataaaaggcttctgacatggactagaggcattgctaggtgccttggccttggctggatgtcttttctctcacagtgagccaataggtagagggaaatcattgcaccactggaaactatcttccactttttgatgggctgtttaaatgcagatgtcctctctgggctgtaaaaactccctgggagatacttacattctctttggaaacgtatgccaaggtctagagtttttgcaagcctgtgtccttgctgggcatgctcagtagacgtaaaggtggtttcagttaattgaaatatattcatttttcctgcttcatctctagatataggagcaggtcacagtgctcctaactaaatgttgtttctgttcttgtcactgtaaaccagatggtcacatttaacgacgttaggacccttagttccaacctatctcctcccctgctcctcccgctaccttcagctctcctttctctacaagattttaacacgacatctgacaaatggataaaaaatgaatttccctttttctctctgccttgcccacccaccctctgcctgtggtgttgagtatagaaccatgcatgtgggagtcatggaggacagattcttcttgtagttctagccccctcctcctaccttctggaaacaaaggaaccccacccctgcccagaaaactccaaggcctggcttcaagtcgtagtccaggaaaagttaaagctcccaggactggtcctaaggcgactacatgaagaaattcaggaacccagatgcagaccttaagatgagtttaggtcgcctaagggatctgtggctcttagagcatccctgcatattccctaggtttgtcctggtcagctcccatatctcagggtagtaaggcaacaaaagtctccagtgggtagctggagctcggcattcacaccaagtccaagaagacgagcatggctcccagggcagggacattttgggtataagacccacgctggctcaacagatgggtgaaggtcagggtaacctcaagcttgagatggcatgttctgactcaggaactcatggagagggcattgctgagtccattattattatttttactaaccatctgtctcttagaatattggaggttgccttggggagatttaatacagctctaggaaatttcttccagattatagcatagagagatgctgctaggacttgctgttagaactagtggtagcttcagtgcctgaaggttgggacgggaatgagggtggaacagagcagaagcaaatagtctctcaaggcaggctgggagaaatcctctccgacaggccaccgtaattcctcagcctttctggaatctgacacaagaaggataagcctagagttggagttccagagattctggtttcttttgagtggcccagtgcagtaagaggaaattcctgcaatataaactctctggtcccagaaagattaagacagttggtttcagtgtggcacgtgattcagaatcactctggttgcttgttattaataaatatggtacggtggttctgagcaggggtctgtggacctcacattaagaaacagtgttgtaatgcgtcagaagtgccaaaatatcccagaataacttgacaattactcctgtttccaagatattttgtagatacaagctaatgtttatcagattgggagctgttgtagtatataggaccttctctagccaacatcatctaggttggccattcagaaacatgtcttctctctgatctgtgcaatccttggcccatttggctgcattttctttaaaggggatcattctctaaacaagaccaagttcttaacattgtgaactttgaggcagcagctgggtctcacttcagaaactcctgggcccatttggctgagctactggcttgggtttcttaccatctattgctaaggtccagacaagcaagcaacaacccttttctcatctgttgggtcaccattagagcagagatcaccttttaacttcctttggaagaagtgcaggaagaagctgttctttgttattagcctcagtgagaaaatattctggatggcatcatgccctaaggggcttctctgggttttccaagctaaaatgtcctaaaaggtcctggaaagtgtgaatcggcttatgaccactgttcatattgggctctagatcaggtggtctgtcttgctcaaggctgaccccatctaggcctaccttttgtgtctgccaggtgtggctgaacagtagatctttcattttattaaagtgaaaactggatagtataatgggatattgaaggaaactgatgtgtaatgactcacaaatcacacacccaaattaggaaaaagatgattttgtgtcatgaaaaaatatatgtacatacttccattcagcatatttagagtcattatcacttgagtgcattaattattctgccaagaaatgaaattatttacttgtgggcaatagcaacacccacattgaaactggaaacaatcaagtgcaaaatgttaaaacctgaggaaaagaaaaagcaactcttgggatgtttttgatattcacagtgggatttttcttacctagcatctatctctgcctctttccctggtgatcactgggcaccagtgcagatctttagcaaaaactggcctgccatagaagccacctagcaataaatcctggcaacaatggactggcatatagggcagctgggtacatattatgtaaacaatttccttggccccataaattgttctgccacctgacagagatgcttactctattgctgtgttctgcctcagagtttgcttgcttttagaactcaagtcagaactttaagtggagtatacacattgttcattatggattaagcttatgttttagacctatcattcagaagtatatactctggttatttgaagaataacactctggtcagcaacttgaatagctcttccaaatttttgttttctgcttatcctaggtagataaggttactgaaagaggcagagagagagagaggatgcagcctggagtcatcagagaagggattacggagtaggtcggccacaatcacacagctaggaagaagcagcctggccccagtgtcgctacgtgtaaccattggctaaggatatggccaaatcagaggcacagaagtaggattgatcattattttattggaggcagtagcaggccatccagtgaaatgttgagcaggcagtaggaaatgtgggactggaggtgagtgacagctgatgtcatgagaaggatgcaagagactcattttgacaagagtggtggaaagcccctgccttgttagaggtaaaggttggatccagagatgaggctagattaaggagagctttgagatagtggggagttactgaagcttcttgagcttgaggagtgatactagcaaaaatgctttaagattcgcatcattaaggcatagcttgaggaagggacagacctgtaagggccaaggaagccggttgggagacagtttgagctgatgaggaccaggataagacagtgggaatgaagagaatgcgttgtatctgagagggagagacatgaagaagaaagaaatagcagggccagaagattttccttaaatgggaaaaattgagaaggagggagaatgggggaatatgatgaattttgcattttattggaggtggtagcaggccatccagtgaaatgtggagcaggcagtaggaaatatgggactggaggtgagcgagaactgatgtcatgagaaggatgattcatctgaagaactaagtggagagaacaaaaagcaaaggtccctattgacttttgaatgcggcagtcaagggtttaagtgggaagcccacttctcaattttcccaggtagtctgactgtgttgccagcaatgcttgagtgagttatcttcaggaaaaagttctcatttttttgagcagaaagcagtaaaagcatcctatcaagcacaaagaagggtgaggagaattaagctgcaataatgacatccccgtcctttgcagagtaagtgttagcctcagtagaataccagagctggaagggacttgagaggtcatctgtatggttccagtctgtcacttgacatgtaaaaaaactgagacgggctgggtgcggtggctcacgcctgtagtcccagcactttgggaggccaaggcaggcggatcacctgaggtcaggagttcaagaccagcctggccaacatggtgaaaccctgtctctacgaaaaatacaaaaaattagccaggtgtggtggaagatgcctgtaatcccagctgctttagaggctgaggcaggagaatcacttgaacccgggaggtggaggttgcagtgaaccgagattgcaccactgcgctccagcctgggcaacagagcaagactctatctaaaaaaaaaaaaaaaaaaaaaaaaaactgagacagggaaagggacctgtccaagatcatttggtgagttactggcagattttcttccaatagccaatctgagtctttactgtacaccatggtacctcatagctattgttggggcagcctggttcacaccttcccaaaaatagggaggatgattatccttcaacactttgggcaagatagccagagcgttttcaaggctgtattaaaaggaatctagctttttcaggagagagcataaaatctcagcttgttttagatatgcttaagggagcaagggaaaataatttgctcttgcccaagtttagctgttcaggagaagggggccttctgagaggatacgggcagacaccaacctgagaaaacctcataggcaaacccctgtcatgtccctccttttcctcctacggagcttcttggaaggcaggtccagctcatctaccttcatggcaattggcatatttgctattccatacatgtgaggttcacattttttaacccattctcccttctgctgcttcttattaaaacactaatatttctgacagccaccaaggctaattaaatgtctattttgggggtggtgctgttgaactagaggggaagaacaagaagttgtagataagtggcatggctctaaaagactgggtgacagccataatcccaagttttttcctgtgttaacacagcctgacattgggcatgctgcttacatgaccccaaatacccttttgcagacatttaccaacaactgaggaaggccttgtagataggaagggagtgctggaggcagggagcacaacatatggtgtggcatggggaaatctgtgaagaatgaggcatcagaagaggcaagggtagggcctacactaggacagtccattagggcagtggttctccagatgtgattcccagaccagcagcatcagtatcacctggggatctatttgaaatgcaggttctcaagctgcacttcagacctacctaatcaatactcaaggcctatgtggcccagcaacctgtgttttaacaagacctctgaggaactgagaatcactgctgtaggtcattcacagggtgagctggtccccctccctgccatttgactggttccatgggggactggcaaatagcaaagctgtagagtaaggccaactggagatttaaatctgctccaccacctactaactgggtaactgtgggttacttgttttatctcacaagtcatcttcagtaaaaatggagatgttaatgcttacattggagaattatagaggttgaaatcacaaaagaaagccctttatccagtttgcagcatatgttttctacaagtataagcttctcttgcttcgtccttccctttataactcttttactttccttctgtctttcccatttcttcttctgttcccactgaaagggtccactggccaccccaagctcactgcaaacacacatgccttttttggtcacagagaccagccttagatctcagactcccagtgcctccagggtatagcaatcatatttctaggttaaaaatcaaggcacatgacagctgataaacagatatatctactttggggagcaattagatagaatatttgatattaggattgtcttcggaaatctggatacaaagaaataatatcctattctgtctttaagcataatgcaggactcttaaccctccccatcctcttattcatgtccaaaagttttgttgatgtgggagtgggaaacactatgtgtcccactcacttgtaagtctgagcaagagcttccctatatttagtgcttcctctgaaatgtcctggggattgggaattattttgttagaagccacagtagtgctgtcctaaggctcagagctctttgagtaccttgctagaatgatgctgctccatcttctggctttatgataggcttgcaagatgaaggatggtaacagttggattttggcagggagggaatataaaccagtttgggaatagagaatataatctctgctatagctactcccaaatggccttttcttggttttcttttttatagctctgtaccatttgataatgttgatgagctcttgctgcttgaaactcttgtctttgacttttgagagatcatgctcctttgtatcctaatgatgtgctaacagcttcttttagttttatttatgtagctctttttctgttccttacctcacattccatctttaagcataaatcttgatttcccaaggcttctggccttagcacttttttccagggcaaactctgattttcacaatttcttctgggccattgattcccaaccctgtatatataccctaatctctcttgagcttcccacccacctgcatgtcctgctggccccccatatttaacaccttaaagagaaaatttgtcatcacttcttttgcaaagccaagccaatatttcctcctaatttgtcctatgctttaattgacgtttgcacccaaaaattaactttgacctttttcttttcctcagactagattcaaggtccttcaaacatgacttcactcacctttttagccatcactccctccactcccctttcccaaccctaacctctccaaactccactacttgttcaccatcacatttcccagtcttcttctctgagacttggcttaatctcatttctctgcttcaaatgcccctccctttcctcctgtatctggtaccatcctacccatcctttaagggctatcttcattgccacacaaaacctttctatagcccaatacccatgtgtaatcaacctcctttctctgaagtcttgtactaggccagcacatgccaggcactgtatatccaccatctgagttcaccctctctataaccctgcctgtgaggcaaacattattacccccattttgcagatgaaaaaactgagacccaaggttgtatagttagaaactctttggcttttgtgaaattatactcctagatgtcataattacatgctgacaattacatttaagtttgtgtttctgactcctcttctattcctcacctcctattgtcattgctactttctaaagtagtaaagcccagaatcgaaggtaggtatgcgtgcccataaaaccacctttgcgtcctgctggaaagatatgcattgttggtacctggaaaccctttgttcttcaggtaaggactgcagctgagtcacagtgagcagatccctgcacacagtaggagctcaatgaatgaatgttggatggaagatggatgagcagagcaaagtgcattttaacaaaaattgtagcaagttaaaagttaattctgtacacaaatggaagatttggaaccaatttccaggttaagtttagtttacattttcaaaacaactcagaagatgagggaggaacatccctttgctccggcttgtgtttgtgaggagagaacacagaagccccacacagctgttaacgccttctggattagcgttcctctcacctccatgcacatacctgtcagctctcagttcagtgttttataccctacaaagcagatggtagagtagaattatccccattttataggtgaagaaactgggacccagaggcagaatagtttataagttaagagcagagtctctagagccagactgtgcctctactggaataatggcttcagtagttattggctgtgtgaactgcaaattatttaacttctttgagcttcagctacctcatctgtaagatatgaatagtaatagtttttccttaaagggctgctgtgaggcttgaatgaattaatgtatataacgtgtttagaatagtgcctgacataatagcgctctttattagctaacatcatcataattatcattacacctttagctagtagtataacaaggtcttaaattcagattattttttctacctgtattccctctctgtggtgttatgttagaaaaaacactagtccagaaggctgaccatttgatgactgtaggcaagttacttttgttaaacctcatctataaaatgagggcatgaaggtgatgatctttaaaattctgtccaattctgacagtcattgattctaagtaggccctgacaacaggcttgcaagttggttagttgtttttgtgaccactaggtcctagattggctttgtccagggtatagctgagccttgtgacctgagggcccaggtatatcagctggactaaatgggggacaaaagtcagcgatctgcttctgggaaaagccaggcatggagttcctgaaaagaagactgcaaagtaaaaaagtatagacagtggaatcagccagatctgggcctgggagacctcaaagagcaccacagatagtgtcctgagcagaaggttggtaattgatactgagatactctttgacccttgataaaaagctatggatatagctttaaactacaggtcttaatggtgctctgggttggggctgtatgtgcttactgagttctaacaatgcccacttgggacccatcttttccaggagaggggagacttctctataaaaatttactttagtaagccagtgaccagcttttctttttcttcactgaggccaaaacaaggagaaattgacttttagtacaattggaagaaagcaagttcaacataaaaatgaatgtcctcagcatcaggggcacctatgattaaaggtggctgtgtacatctcctgtagggttctttaagaataggagccaactggcttatgatatcatagatggagttcagtatagataatgagtagacattggtagtacagtttgataattgtaagagcacacaaagttagaagacccagcttcataatgtattacttgtgttattggctgaaggactaggtcacctttctgagcctcagtttcctcatctttaaaatataggtaaatggccaggtgcagttgctcacacctgtaatcctagcactttgggaggctgaggtgggcagatcacttgaggtcaggagtttgagaccaccctggccaacatggaaaaacccccatctctactaaaaatacaaaaattagctgggcatggtggcgtgcgcctgtagtcccagctacttgggaggccgagacaccagaatcgcttgaacccaggaggtggaggttgcagtgagccaagactgcgccactgcactccaacctgggcaacagagagagattccgtcccaaaaaataaaaatgaatgaatgaatgaatgaatggtaatagtgaggcccagttgattccgtaaggatcaagtgatgtagtagatgtgaaaacacttagcaaagcgtaaagcatgaggtatttgaaaggtggtgttgtgaaaggtcctgctggaaatttattttttatctatcctgaagagctcaccctatgccttaccttctgtggaaggcacaaagatgaatcctgagccatgacagatgcatctggcaggacctgaacaaaacatgttaacttaagtcaaagatcagcatgtgtgtatgtgtgtgtgtgttcatatatatgtgttcgtatgtgttgtgcatttattttgagaacctagggttattctgtggctagcatgttggagggtagatatatgagacaggatgtatattctatagactatttctattgtcttaaagttgttttagttttggtcttatggagccattattgccttgagcaaagtaggctgatggaaaagctgacttctagaggacttgttcagaaattcaatgcttgggagagagtgcttgagtctctttgcctgataggccatgtgttctctattctggaatctgttaccccaaatgctgagaagactgatggcccatacaagctggaacagttgagggaaaaagaacaaataacacagtgagcaggatggtaaagagaggcagactacctccccacccccaccccatccctatcaccgtgcttagatgagtttcatgaatgtctgtttgctggtatggcagtggaatagatgtctgcctgctcttgtgtggagcccagtcctgctagccgtgaagtctagtgagcagggttagcgtgcattccatgcacaggtcctgccttgccagctgatctccagctcatcacttgcttgttcagttttgccatccatcaaatgcagaattcaacccagacctctccccctactgtatctcacaggatggttgtacaaatcactgagagaatgtgtgctaaagttgagtttcttgggtacaaggcatcacagaaagccatattctttcctacccatgacctctctggatggcatcatgtgtgagtgagaggaggaggctgcaggactggggtccattatgcgtgaggaatgttatggtctgttaccccaggaggagggtcacggtggggttaaataatgtaccaccaactctcaattggtcagttccaaggaggaggaggaaagggggaggagcacagggaattgaaagcaaataagcttgagtctcattttagccattgctgtcagcctctccacccattcctgacctagagctgccttgaagcaccaaggagagatggactggagctttctttgttctgcacaggagaagttcatgattagggataaaaagcatgaggcatatgtagtacatattcatattctgggtcattccatgcactggctaacagagagttgacagtattgtttgtcttgcggtctaatggaacttttgttccagtgccatccccctcacccctatctctcaccacttgagtatatgagtttctctgtaagtagtagagctctgtgggtgggggaaggggcaagcaaggtagctgtgtggactgaacacattctcattttgtctcctaagctgatcactggagattccatcgttagtgctgaggcagtatgggatcacgtcaccatggccaaccgggagttggcatttaaagctggcgacgtcatcaaagtcttggatgcttccaacaaggattggtggtggggccagatcgacgatgaggagggatggtttcctgccagctttgtgagggtgagtgtcagtcttcactctcctctcctatttccttggctgcctgtacctggcttccccttcaccagcctctgttctcctgtttatttctctcctggtggcttttctcatatttttttcctttttttaaaattgtctcatacagagaacctgggcttcctttaatctgtgcccttttaatttttagacttttcatttgtctcttgtttaacacccccgccccaccacctcccacctttgtacaaatcacttaccttgtctgggtcttggtttcctcttttggggttggccttggtggtttttgaataagactttttaaccctatattgctgtgaacttttgtctttcttatctctcttttttctgctttctatttctcatcttttttttattctttcttctcgtagtttcttcccatctcctcctcttgctcctctgctcttctctccttcctgtctacttctttgcctctcacacccctgtgtgttgtcactgtgtattcagatgttaatataagagtgtgagctccctgccccccaggcgctagagcttactgatatcaaattttacttttttcaagagaatcaagtggctgggatctaaatgtgctgggggtgggaagcaagtggcatgtaaggtcttgcaagccttctgcctctttgacattgtaccatgaagaacctggcccttaacagagaggctcttgggaggaatttctcagcagtttttgctttttctgggtcactgtaaaggaagtgatcccaatgtgcttatgacctcagggtgctatgggagaataacattggttaggtgtctcagctcttattttttcttggaattgtgagctggaatcagctatttgactattttgagctctgattttcctcatctgcacaatggtcttgacagttctttaatgccagggcatgtcacagtgaatgagataaaacatgcgaaaactgctttgtggcaagacaagtactgaagctacatgagggtgtcttataactatccttacgacagcctatcacgttttgttagtttctcctgtaaaattaggctgaagtcttctagaccccaaacaaaaggtcagaagggctagctagggctcctagaggttgaagggccccaatattagaattatggcaatgtgatataaagaaaggaacagggcatttggagttagaaaactctagatacagttttactaccttctagctctatagcttttggtaagatttttaacttccctgagccctgatttcctcatctgaaaaatagggataacagactttttataaggaattagatcatacatgccaataaggtgtctagcacagtgctagacagatattaggaacttagcaaatggtaacttattttatgattatcatcataattataatcatcaccactacctttttagctccaagaaggtccatgtatcaaggcttcccttgaggttgatagaggcctccttcctcaaggtaaaaaatccagaaagtattgttacctggttgggacagtttaggtgagggcactgcctagaagcagaggaatggacaaaattacctctcattcccttctatcatgagaatcttctaatgaaatatccaatcttttcttctcttcagtcagagtctgcaaatgccatctgtgtcccatctcatctttgctggttaaagaatcagtcccagggatagtcagaaaaagcgtatcaataaccacagaccttcaggactaatgtgaggccctgtacgcatacagctggtatgtcttgtgcttacagacctccctctttaaaagaaggattaaactgtaccaaatgatgatgtcacccaaatccaaatgcatttcattttcaaggaaatgttacttttataataaatagtaaatccaaggatggggggaaatgattgagcaagccaggatggctcagggaagcaaatgacagagccagacttcagaatatcagtgggcagccattaatgcccctaagtccaaggccgggaggagtgttcctacaggaacaaagccccagcagccagagtctagctcaagtggttctcaaccctggctatacaacagaatcacttcagtagcacaaaaaaaaaaaaaaaacaaaaaacaacaagaagaacccaaacaaacaaaaacactaacacccagcctccaggctagtaaaataagatcatttgactaaattggtaactgacatggtgaggtatcttcattccctacctggaagtctcattgctgacatttgaaccctaggatggataatcaagggtggttagtgtggttctgttcaagttagccctacctgttgttacacattaaaacccaacctgcagtctgggaaacccagatgcttgcctcagttctattattagaaatgcaacttgagcagcttcctatgcatcttcaaatatcagttttcttccttgtaaaatggggacaattcagtcttgtaaaaatgctttgttacctgtgatatgctggatacttgtaaagaggaattataataccatttagccactgtacaggaacttaccaggtatatgtgtcttgacctattcacacctgtctcctctgttgttcagaatttcatacttgtatgtgcttatgtgtgtgtatatgtgtgtgtgtgtgttctcaggttctttcctttctgtactggggatatggcttcacaagagcaatgtaggagctgatataccttcccagtagttggtaaggttaaatgaattaaacttgctgaacatcagtcctcatatctagttgtcgacatcgtcagctgttttcctgggctggtttccctgctaggagctaagggtagactgctaggatatgattgtgtctctaagtagcaaatcccacctctgtggtgggcctccttttgtctaatagaccctaacttcaagtcattcaggctcttttcctttgtcactgtgcacaaaatgaaccttttttttctgactttgggccatggcctgaggagagcttgctgcctaattaagggtaggttgtggacaggacacatgacaacctgttactgatgggaggtgaggctcgtgtgacaaggcatgggtttggtcagaaagtaaagagcttgctgaggtgtcatcaggagctggatatatacttttcttgttctttcaaattctttatttctctggtttctggcctgcttggaagtatggagatgaaaggatcacctaagccaatcattaccatcatttcttggctttctacagaccagatgtcatggaaacccaacttttccttttcaaaggaaagcccattgttccagagtgtgacctggcttttatttatgtattatctctttttggctgcaaaaagagatacttgggaaaagcttttcacctctatgaaaccctagattcactgtagatttagaactgaaaataaccatcttagccaagagtggccaacttagatgcttacaggggccaattaagtgagtgaaacaaattgagacaaggggtaagtgggcacctgtgtccaactgggagatccatgccccatctaaagacagcaaaagtgacttggatggttcccatcattagagtgggatatagtggagaggaaagcccagaggggccagatcttctagtatttcaagaaaagccgggaattggatttttatgtaaaactctttatatttaaaaaaatgttaatgaggaattcatatttttaaagaagcacagtgagagtcaaacaaaacacatctgtaggataaattatctcccaaggacccagcttgttgccattggtcaccctacctccacgttgtataaatactgaggcaacatgggcccagaaaatggaaatgacttgctttctcatgtagggaattagtggcaaagccaggacttgaacccaggcctcctgaatcttaagacaattttactagacagtctttgtctaataagtttaatgtcttggcttcctttggtatgttttctgccaaattatttttttcctgtgaataggtcacatgttcctgttttcttgtaggccttgcaattttttgttgaaaacttggcattttcaatattataatgtggtaactctagaaatcagattttcttctctccccagggttttctactgttgattgttgagggctgtggttgtccatttgtttagtgactttttccaactatttttgcaagaccgtattcttgttatatatggtcactgaagtctctgttcttttatctcattggtcagccaataacctgacatttctttaaacatctggatccaagaagaaacaaacaatactactttcctggtttttgtagcttgactctgagctggagtacccacttgagactgtgccaggtcatcaactcttctgtctcagccttctcctcctgtttgtatgtagatcacacatcctccagaaatataagcctatggtcctctgaggtttttttctgagcatgcatctggtcctgggcatgcgtgttatagtgtgacttccctggtatgcatggtggcccttatgaatccttattccccaaagaaacttcctttttagcttcctccttcctgtgctattgcatgtgtttgctatttgtcctgtccacaatcccttgtcccaagtgggcatgagcagtgtatgtctttaaatctttcaacaaaggcagccacagcctggaaagcctctccagccagaggtcaacctctgtgctagtccctcagtgccaaaaaggtcaaaatgcacagctacaatattgtaaagaacaaggtcattatctcctggcaccagcaagccacaccaggaatgtgggccactgtcacctcagccactggggaatggggaatggtaagaggataagcaaaagtgcttcaatgctctcttaccaaatttttgctgcccttttctgcattacacagtcccctgtaagttgctgcaagttttggattagattctagagttccaaaacaatgtgttctgtcattcattgccagtttaaggttgtttcagtggaagaactgattctttgtgtgccctgctccaccacttttagtgatgttgtccccttctgaatcttaatcctgtgctttctggcctatagcataatcaagaaagggcaggcttgggctgctaacaagactgttaacacttgaggacttaccttccattccagactaaaggcaatagtgtttttgcgttcttgagaggagtttcactataccaacccttgtttatccattcaagcttcaaagtgttcataagtctctagtcttaaacatttatatcatttatgtagaaggtcttgcttgtggccctagaggtaacacattataggttgtgagtttaggctgacattaacagggagagtctttctccctggattatggctatttctctcccctgtactagaatttcaaatgacattattataactcatttgcattcacataatccatcttaatggcttctcactatgcacattttttggattacatcatctagtacatcatttggctaattggaggttttttatttttttcttttaatatggagacctcttcagctcagagagaatcttaaatgtagctgttacatcacccagatgattcctccaaattaggtagcacaggtcaccctcatagaaatcccaagttgaaagcaaccttgagagtcatatagcctatccctcagcctccaggcaggaccagagctaaaattaccctgggcttttgagaacctggccagcatctgtaaaccaagcttgaactactctgttatttccagctactagcccttatgctgtagtctgagccaatttcttgaaacatgttgcttttttcaataggaagatggtatttaagagttgacaccagtaggagacattctgaatggttttcttggctctggggctttccaaggccctattgttgacccatagcatggatttgtaacctggttggctgcctgagttgaggctatgatcttgggcctggcacctgtttttctctgtgtaatcaacccccgggtttatttggggattagcttagaccttcctagcatcgtgtatatactgccttggtggtgtgatgacttgaggagaggaggaccatgactgagtacctggagatgaggtctgtttctgtggctctttgtaaagtacaacatttttggaaaatcatcatacttgtatatatatattttcttttttcatcagtatatttatcattatgagtaagagtgaaaccacttatctttacatggctctagtgctattaatatcttctcaccagtatttactaagtcctgaacaaaagtgactgtctagcacttagcaacagccacctcctggagtggtctagacaagtactaagggtatctggcatcttgagaggtctgttgtcctctatattagagggtcactagagaaacaatactcagaagtgggttggtctctttttttagttttcagaagtgaaaactgacagctccatacctcttcaggccaccagttatacctcaggacagatctgaaatagtttgtccttaagttgaactagaatctgtctttctggagcttctactcatgggaagggtgtaaatgtccaagagaactggctctggagataatctttctggattagaatcagagcctttccatttattagcaaagtggccattgtatgcttcagtgatctcatcattaaattgaggatataacaacacctatctcattaagttgtcaggagaactaaacaaaatacaggaagagcactgacaatgggatctgacacataggaaacactcaataataatactggtaatacttgcagcaaactcttaatgtaaatggtagaaataatgtcctcatttttccctgctcctctctcaaaccctcttggaatatactgactctccactctgtctatagcccatcagagatctgaaacctcagaccaggtcagccaagcctctcctgtcctccaggcttctgagctttcaccttttagccattatttggatgaatcagtttcttgttgctgctatgtgtgagtggctagactgaggccatccgggcatgcaaggcccactccattcagccacttgtatgagaacatgggctacatggaggcctggacatgctgacactgccaggctttcaagactaataggaatgatattacaactaatgaccctgctgaacatgtaattggacaatgttctttcttggctgttctgacctctaccaagaggcataataatgttactggggccatacatcagcagttagcttccatttaggaacaaataaatggtggaacattgtgttatatgtaggaacccaagaatggattgaaaaacttctttttaaaatatactggggaaaaaagccataataatagacctgaacattctgcccattggtccaactctttgttttgataagcttattaaggtagtacagttattgacattgctgctcagtagagcttggccctgaatgccatgtgccatgtgtgcgatggactcattcccatatttatataaagtaagcatagcttactgttaagcgtacatttaataaagatgctatatacgggacagggccagcagtagccctgaaaaacagtgcagccagatgaacttgaatttggggcaggtcctagaggttcactttcccttgtgggttgggataggctgagagtgtgtgcgcagtgggtaaggtccctcccaactgaaaatattgggagaaagtccagcccagtaggtagagtgtagcatcagtaggcagcagacagagggtggtttgttgtcatgacaagtgactggtattattggtccaacgtcaggttgtttagtgtgcttcaataagcaggtaaagcatggtgaccaggtatccagaggcagggagtatgcagtgaaaatggtttcttaatttgtagaatgaaggacttaataaaaattcattcacccaacagatgatcatcaaatggctactgagaagatacagaggtactctagaacttcagcccatcctctaagagtctgatagtagatgtgaaaacttatgcataagggaggtgatttgccaaagctctgtcactttagtcaagttctttacctttgccaaatctcacttttctcccctgaaagatggaggggttggaacagatatactccaagaacttttctagcccattctccataatttcttcttctttttttttttttctttgagacaggatcttatgcttttgccctggctggaagtgtagtggtgtgatcatggctcgctgtagccccaaactcttgggcccaggcagtcctgccacctcagcctcctgagtagctgggactacaggcacctgccaccacacccagctaattttttgtattttttgtagatgcaggatttcaccatgttgcccagactggtcttgaactcctagactcaagcaatccacctgcttcagcctcccaaagtgctgggattataggtgtgagccaccaccctggctaatcttgttttagttgaggtaaaataaacataacatcaccttccccatttcaatcattttaaagtatacaattcaatgcatttgcaatgttgtacaaccatcaccactatctcattccagaacttttttatcaccacaaaaagaactccatacccattcacactcattcctcactcctctctcctctcagtctgtagatggtataatgttttgtacaaatgttagcaggtagaaaatacaggatagttagggaagggattaaattcataggaactgaggtcaggaagaggcatatgacttcagtagctataggagactacatcagcctggatacaggctaaaaggagtaaaaaacataagacagatgttgcgggaaaagcctcaatagggaacaggtgtcatctaaggcattggtactatcctggaggatcagaaagtaaatgagaccctgccagacttgcctttaacttgttagtaaatggcatagcccaaacaagatcacattccaactccaaagccagtgtttgccacatcaccatcctgaagtgttttttttttttcttttctaaatgtctgtcaaataattgcaagctttctgtgagatgggtaactcaggtcagcttgatttcagcattctgcttagcgtggctttcatcatgaaatcggtacttccatatctgaatagcttaaatggaagtcttctcttcattttagctcaaatagaaagaaaatcaaaggaaatacagaataaatgaacttctaaaggtcctggcagagcactccttttttggctacttaactaattaacctaaattctatcaacgtctaagcaggataattccatgaaaaccaatgaaaggagaagacttaggggtagagtggagtgtagttcttattagaggcatctagttttcttgactgggaaggaagctatgttatctgtgaagggtttccctacactccaatccacccccattctagcttgagttctcactttaagaagccttgtcatgggcagaaatcatcaatacctccagcctcgactaagtaagtctccattcgttgggaagggtttttgagtctggttgtcaaggaggtggcatttggggtataagaaatttgggacaattgcaaagcaattacaaaagtacttcctaaaactcttccctgactagagaggacaatgtttctcatatgttgcttcattgttctaggggcagatgatgccaacctaggggataataacaagaacagctaatatttgactctgtgctagaaactgttttacatgcacagtttaataaggattaaataaactaccttatttaatcctcacaacagccccatgagatagatagatattatttctatttcagaggtaaggaaactgaggatcagaaaacttaaagttgcttactctgtgttactcagaggtagttgtagagccaggatttgaaatcaggatcccgagtcttcaccctttaccactgtcacagactgtctctcctaattttggcctaagagtccagagactttgcttcaatcctgactgccactttgatgcatccccctgtctggccttggatttctcatctgggaaatggaaataaaaaggtttgcttgcctgccttgcagggctgttttgaagtccaagtaagagagttcgtgggaagacactgttcttgaactaggttttcagagaagccagggacaaaagaagaatgatagaaaagagtagggaaggccttcctgaagaaggagtagggggcaggctttagaaggatacaaggtacagaggtgtgaataaacagaatgtgttggaatgaatgggaagggtagcttgcctgaggtcacacgtctgtgttgaagagcagtgaaactcggtgggtcggtcccattttaatgtgctgatgggaagccatgaatgcaaaaacagtatattcacacaggtcttttctttttctctttttgtctgttatataacaaaaattttcattgctctggttgaagctccttatttctcattgtgttggtgctggagagggagaacaatttgttagcagccttcttattatgatacttcatataattagtgagagttattaaatcttcccttgaggggtagaggagtagtttctgtgtctgactgtacataccgtgctgattgtctttgtgccaggcaggaatgctaagtgcttcctggcatgcacattcaggaatccctaagcacttctgatcctcctgaaagctgagactggggctccaaaactgggtgtgtgtgtgtgtgtgtgtgtgtgtgtgtgtatgtgaagtgggagctctgcttgcaactaaccaggttcctctcagtccctcacattcacctttgtatccacacttcaccattgcttcactgtggtggcagagaaaaggccttttggtgacctttgttattgaagagttcacgttccctccaatctctcctttatctgtgttttgcccttttgtagtgtttgctgagatttttggctggcaactttattcagacagagacagagctcatgattagaatgattagaattatctgaaaaaggaaagggctgccttgggagacagtaatctcatcattcgttgtgttcaagcagataggctgtgcaattgctggcagggtatgttgtcaagggagtttatgtattgattggggagcaaggggtggcatggactagtccaccttccatttcctttataaactgattctatagctctgagagtctattgttcaataagactggcaataacccctcaccttctcaaaggatgtcttgctttttactcctctctggttgattagatttggcctttgaaaatatcaaggtgagatttagacaataccgcttacccattctcttctcagaaatattacactgctggagacaggggccggctggctttctaagacactccttgagcctttattgactttatgaaggaattactggctggatattatggtagttttcttttagaactactgatccatttgcagggaggggctactaaagatgttgaagaggttgtaccaagggctgggtaatcatcactttatcatatggaacaatggtgagtctattggaatatgcatataggtatataaatgcaaggagagaggttgacaaggatttcacacaaaatccataaccatggtttcctcaggagaggtagaatatggttaggatgaggaacaatcaggggaaatttcaccttatctagacagttttagctttttatgtatttattttaatagagatataatttccataccataaaatttaccattttaaagtatacagtttagtgggttttagtatattcacaaagttgtataaccatcaccattgtctaattctggaacatatttttaaaatcatttttaatagataaaactgtatatatttgggggatgtaatgttttgatatatatatatgtatacacatattgtggaatgattaacatatcatcatctcgcatacttatcattttttgtagtgagaacatttaaaactgtactttcttagcaattttccaataataatagtattctattacataactatgccatattttggtttatccattcatcaattaatgaacatttgggttgtttctacttttggttgttatgtataatgctactatgaacatttgtgtacaagaatttgtgtgagcatgtgtttttatttctcttgagtacgcacctacgagtggaattgttgaatcatatggtaactatatgcttaactttttgaggaactgccaaaatattttccacagcagctctaccattttacattcctgccagcagtgcgtgggagttccaatttcttcacatgctcgtcaatacttgttattgaccttttaaattattacagccattctaggacgtgtgaagtggtatctttttatggttttggtttgcatttctcagatggctaatgatattgagcatcttttcatgtatttattggccatttatatgtcttctttggagaaatgtctattcagatattttgcccatttttaagcgagttgttactttattgttaagttacatatattctgaatactacatctttatcagatatatgatatgcagatatttttcccattactgggttgccttttcactttattgatggtatcatttgtagcacaaagtttttaattttgttgaagtccactttatttttgcttggttgcttgtgttctaggtgtcatatctaagaaactattgtctaatgttacagattttcctctatgttttctttaatgacttttataatctgattccattcagatatttcatccattttgatttaatttttgtgtatagtgtaaagtaggagccaaagttcattctcctgcatgtggatatccagttgtaccagcaccatttgttgaaaaaactatattttcccccttgaataatcctggcacctttgacaaatatcaattcagcatgaatgtaggatatatttctggactcctggttttatttcattgatctttatatctattcttgtgccagtcccccattctcttgattactgtaggtttgtagtaagttttgaaatcagaaagtgtgagtcctccaactttattctcctttttcaaaattgttttggttatcctaggtcccttgaaattccatacgagttttagtaccagtttttcaattttctgcagacaccaggtgagattttgataggtattgcgttgaatctgaattaatctgaggagtattgctatattagcaccattaaatcttccaatccatgaataggagaggtttttctatatagttcttctttactttctttcaataatgctttgcagttttcattgtataagactgcacttcttttgttaaatttattcctatgtattctttcttttcctatttaaatgtgatcattttcttaatttaactctcagattgttcattgctagtatatagaaacataattgatttttatatcctgcaacattgctgaacttatttattcattataaaaggtttttttttggtggattccttatgatttcctgtatatcacgttatatgatctgtgactagagatagttttacttctttctgatgcaatgtcttttatttctttttttgtccaattgctctggctagaaccttcagtataaggttgaataaaagtgatgaaagtgaatatccttgtcttgttcttgattgtaggatgaaagccttcagtctttcaccattaaatatgatattaactatggattttttataaatgttcattattatttggagaaaagttcccttctatttctagtttgtttagtattttttttttaatcatgaaagggtgttggattttgcaaatgccttttctgtgcctgttgagatgatcatgtgggattttgtaaccttatttcactcatatggtgtaatttacatggactgattttcatatgtgaagcaaccttccattcctggaatcgcatctggtaaggtgggcaatttgtttttaatatgttgctggatttggtttgctagtattttattgaggatttctatatttttgttatttggaagggtttgtgaaagattgatgttagttattttttaaatgtttggtagaattcaccagtgaagccatctagtcctgaggttttttttttttttttttttttttctcccatgtgggaagttttcaagattgaatgaaattatttattaaatctttttcttgttataggtcttctcagattttctacttcttcttgagtcagtttctgtaggttgtgtctttctaggactttatccatttcatcaggttatgtaatttattggcatacaattggtcataatattccctttaattcttatttctgtaagactggtagtaatatttcttctttcatccatgattttaataattttaatctattttttctattttaactttttgcaaggcaaatgtgttcttgtataatgtataattttaaaaatagaaaaaaaaatggaaggcacaaaataaaaatgcacattaaagatatgggtatattgctaactccctggctgtctctgtgggtatcagtttctttattacgaaattgagaggatggattactgttgctgaagtttttgaaagcctttggactatagtatttctatgtttgagcatgggattaaaggacatagatgagaatatttgtggacggaaaatagaccagtctgggaggaacccaatattcctaaaggaagtagtaggaagtaagagtggaaatacagattggagtcagattatggtaatattttaatgtcagggtgagggatttggacttgctttataatcagtggagagctattaaggattttgggtttatgggattagccagtcaatgtgatagtcaaggaaattggtctaatagtggtatgtgggaagggtaaaagctagaggatcacccagggacttgttcaggtataaaagtatgagagcaatgacagtgaaaatagaaaagggagtaataaagaccagagattgtctccaatttggaaagcactccgtggtttagaaggaggagggaggagtgagttgtcttgctcatcctcatgtccttcacagttagtggttaggcacagaataggtccaaagtatttgttaaattgaactgcattaatcagccttgcttcggagttcagtgaagttcaaaggctggtttccccagcctttaagcactctaagaggacttccaggacagcctttcaacctggcatgttccaggcattgtctatcttcttacttgtcacccaggcatctatatgtgctaattgcagcatcaatgaagaaaaggtacacattagcctgcacggattgttgggcagggttgataatggctctctggtctgatatttcaaccagggcagataagcatatgggctgacctgtgtcagtgcactctgacatacatgcagacaaagaccttcctctgtacagaacagataagctctcaagagcagaggacttagaggttagaccagaaagtcttatcattaggcccgggggatgttttgtgggaacctgggatcaggagaaaaacagttaggccttatatgccacctttttctaggctaagaaacatcttccctcaaatgtcagctctataaagggcagtgatttctgtcttttttatttgctgttgtatccctaatacctggcacattatccacacttggcatagatttaatgaatgaatgaatctgttagtagttctttgggatgaaagcagcatcttaacctaaggaatgggcttctggggttgttgcagtagagtagatgaaggtgtcttctcagaagctccttatgaaggaccctgctacacaggcctttagttataaccagaaggacttctctaccaaattctttataaggaatctgttttcacttggctgcagttgccttcgtcttttctcattgttatttggaacgacagtgtcatggtgtatagcttgaacctaaatgtggttctatttctgcctttacatctgcttcccctttccttcatatcctgtcttcattcccactagaattgttcaaaatattcatcttattccagctatccaaaagtgaacatttggacctgacttttcttaaactcctaagaagaaaagaaatgattcttattccttaaaggcctgcctatgttaccctttccatagcagagtttagcttgctttgtgagaagcagggaaaagctaatggattattaagagggtgaggttttcattggtacaaatagacagcatcatgtatatgagatgtttgtttcagtgccttaaatcactttttttttttgcccaggtctattcttttgaataattatctctcatattgcttactgattgcattaaaggacagctattagcatattgaagacacaaagctgaccttttagaagctggaaagatatttataatggagcacttgcagagggtgataggttttggatagagatacattttgcaaatttggctgtatatacaaaatacataaaaacagagtgagccctatttactttggcctgtgacaattcagtgagatatacgctggtgacatctctaagttcactgagtggtaatcatgccccctcacctcctgtgagaaaaagaaagaaggaagaatatacagagttgggaagtaactaccatccttctagttctatcccaaagcctcttccccccgagtgattacccactaaaaggcttttctgatggcagaaatagggatgcatctaaattgtgtgattttagcttcttgaggcaggaatgtggaaaaaactggggtttaaggagggaaaatatggaaaatatggagaattgattaaacctgttgagacaactggcaagctctttggctaattacccctgacagattttgtcactctgccaagcgggcccacccttcgtttccttcctgcccccatggtttccccacttcctaggactgtggggggtggcgggaagggctatcttcttgggccttcttgattttcagtcaaagtcatctagaatatccagagacatctcactcggccgtcccaaaggttttttttttttttttttttttttagcttcccactgccttcatgatttaggatggacagtctcaactgttagcgaatttatcagtttctgatgattctaataattgtctgcccaccttggcccaagccctttccttttcttttcctgtcttccttagaaccagaggcacaaagattctagcacagtgtttaaaagcataggctctagagacagactggctcctatcccagctcctctgcttcctgtgcgacttgggatagattacttaacttctctgagcctcagtctccttttctgtgaaatggtgataatagtggtacctatctagcagggctgaatacagtatattgcaagctcttagcacagtgaatggtgtatagttggtgccaattaatagctattgctagtatgtggtggggaagtattctcccatccctatcccagtcttgaagaggtagagatctttgcatgtccaaggcactttacagtcaaattttgatgattatttgtatatcccatcacagaaatcaacactaaactttgttttcaagacacccactctagtatttaactttggcctctatacttgcaggtgcataaatgctgtgttttgacagcaatccaaatgtggcactcaagatgtatagcttaacctttttaaaaatccagttgtgctacctagatgtgctccagcatgaatgaatttagtccctccactctatttacagataggtcaccagagacctagagaagattaaacccatgcccagggcaaaaagtcaccctagagccaggtttcgaattctacttgcacaggtctctggttgaaggttctctgaatacctgagaagttcagttcatcctttttctacttgcctggaaacctcccaaagaaggaagctaactcattatttttcttttgcctgcttccacagctctgggtgaaccaggaggatgaggtggaggaggggcccagcgatgtgcagaacggacacctggaccccaattcagactgcctctgtctggggcggccactacagaaccgggaccagatgcgggccaatgtcatcaatgagataatgagcactgagcgtcactacatcaagcacctcaaggatatttgtgaggtaaccatggtggttcatgtggaggcacttccacgaagaaccagcaaccctcctgggccctgcctgtgacagtcccaagatgttggaaagggcacatagcctcccagattctgttcagtgaggtgaaactgcttccttagggtcagtgaggtaaaactgcttccttagggtttctcaatctctgtttttcacatttttctctctgtctagttttaatatttattcatttatattcattgtctctctgtctttaccctttcttagtcttcctccttctctcccctgcatctctacctttatctttttggtatctgatccagttacagccatctcatgtaagggcttaacctcactcattaaagcaaaatgcatctcccgccaagccagtgattcacagacttcaatatgtaccagagtttctgggggagcttgttaagcagccctctcactcttgtcccccaagtcatgaattatcagtctcaggtaaggcatgagcatttttaggtttaatgagcatccctggtgattctgatgctgctggtcctactctctcacttggagaacaccggttgtgagtttaagcagaaaagagcttggagacaggactccacagaagatggaggctggatggacaaacctgggctccttcagtatgtcactttttttccccaagagctgtctctctacattccctaaccccattccttccatctctctgtcctaaatgaagatgagagccttcactctcgtactctcttaagcttagtagctgcaagttggcatttttaaagggcattttactgaacaggaagggaaaaccaatgggaaatgaaggcagcgttttaaaaggattaaacacacacacacacacacacacacacacacacacacacacacacattctctcttatatctttcttcttgactcggaaaactctgcattgaatctttttgtctccttccttccagaggaggggttaggttctattttctgtcccccagcctagggtccactgtggagtcagtagtacagctccaacatttttcaaagttcttatttctctacatcagtactgcccaatggaacttcctgcaatgatgaaaatgttccatgtctgcattctccaatatagtagctataagccaacaatttatggttgttgaagagttaaaatgtggctggtatgactgagaaatggaattttaaattgtatttacatttaattaactttaatttaggtaaccatatatctgtaatgacagccacattgaacagtatagctctggaaacaccaaggccaaggattttgtgcctgaactttctttatctcaactcattttctcacccctttcaggaagattaaaagttatcttttcccactgccccactccctgccctgccatgaggcagatagagtagaaagaacaagaggtctggggacatggaatgctggtttttcacattctaacttggtcattaattaaccctgtgggcttgaagataccccttaactcctctgacattcaattttcttatttttccaatgggcttcattatagcaatctcttaagtttgttgaggaaattaagtaaatagaatattgcaataacctatgctgtatttggaaaaaggtaattttcttttttgcctcctttttaaatttattcacccatccatccatatgtctttttcttcttcctcctcccttcacatcaatggctgatgctaaaaaaattccccctcggaatgtgctacatggcattcagcatcaaaccactgacatttcattcattcggcaaacttttagtggaattctgttctgtgccaggcctggacataacttctagcctcaaagtgtcgtactttagagcagcatctgcatcacctggaaacttgttataaatgcaaaatctttggctccaacccagacttactgaatcagattatgcattttaacaaagttactatttgatgtataatacatattaaagtttgaggagcattgctccaaaatgatacctatattacaatgtcatagtgtttttcataaaattaagtacaatctattcttcgcttggtagctgagggatgctgtcaagatctaagtcaggtcatatcactcctctgctcagaaccttccaatggctcaccatttctacctgagtaaaagtcaaagttattattgtttacaggggcctgtgtggtcaacccatccttgcctctatgactttcacctcctgctcctttctgctatgctttcgttactactccagctatactggcctcttgcttttccttcagcattactaatatattcctcccttagagcctttgcactggtttttccctctgcttaaagcattcccctccccaccccacatttacatggctcccatcctcagctccttcaagtctttgctcaaatatcatcttcttgagacttctctaagcattctattgaaacctgtaaccttgcactgcctctgcccctttcctgctttatttctatctgttacatttatctatctgacatattatatatttaacttatatattttgtttattgtctgtctcctctactggaatgtactttccatgaagggcagggattttcatctattgatttactgatatattcccccagcacagtgcctggtacatagtagatgctcgataaatattgcttaaagtcaaaattaaatataattgctcacatgtatgtactgctttgattggcaaagtacattcacatcatatgtcatttgatcttcaaacaggacaaaagttgttattgttattcctattttctagatcaacagatttaatctctaagaagcaaaattattttcccagagctctcaggtactagcccagtggaagtccttagaagtttctctcaactcccacacatcttggcctcttcctatgggacacagactcaggacagcaatggaagttatttgtctttccagaaagtagggggtgatatgatcctgctttaaggagtttccaatccagccaacccaatcaaaccttttgttgacaatttgctggttccttatttttcaacaattattggtgctgaaggtaagtatttaaatgggagctatctccttttctcaccctataatcacgggcatcaaagggaagtggagaaagctgcatctagctggatcagaagacagtagtttagcccaggattgtgtaatctttaaaccaaaagctgtgaggagcgaatggtttatcagaaagaataccagactcagaattgggagtgctgggttcaggacctaccttggtcactaactgactggggaatctcagatgagtcttttcaccctagggcttgtaccccatctctaaattgcataggttggaggagctctttaagttctgtttggctcttactttttctctagttctgtaagatgtagatatgccctcactagagaaaaactgtgatagcgagccaggctacttctgcattttctgcttcttccttcttggtaccattggaagcatgtcttactcaagcatggatgtgttaacatggcataaaccactctttctgtaggttatgggagagctctaaacacttcctacttttgtacttgttgaaggggaaagggggaaaattatattcaatataaaaaaagtcacactatttattagaggacattctttttccctcctgggagcagaaagtgctttacaaacatttaagttataacacccttattttacaaatgaagaagtaggaaataaaggggtttttaattgaagttattcaatgaggtcagtaagagacataatcttttcaaatgagttctctgcagattacattcttctttctaaacccagacagtggtataaaataccttcagtttagttctagatcaccttgaccaacaattggtgatattgcctcttataaccttagaactcaaagtacaatcaaggaaactgaggcaagagtaagcagagctaacgatgctttataaagctgtcttgtctgctttctcttgaggaagataatctcagccatctgatacctatgaaataccttctgtcttcaaatgcctccagagaagctggcctagctttcctcactcactctgtattagtgatcataccattcactatcaagaaattcttccttaggcatgctgtagcttcaagtcatttccatttggtatattttaagcctgaggttttcaaacgtattagccatttgggttttcccttctgcaaattgcctatctcaatacatcccaatagtctttacatcttggcacatagaaaatgataacacattgtataagatagtaatatttgtacagtatcctaggataaaaatatgagtcagctagtcagcctaaaatgccaagcccaggggtttctgcctgccataggccctacctgtccattctgtctggacattctgtgctgtgttcctatactttgcccattttcatggagtttcttatgtttttttcttgctgatttgtaagagttccttgtatattctagatatgaactccttgtcaactttccatgttgcaggtatcttctttattctcttgtttttgaataacttttttacttcatttgaagaaagggtttcctatctcaaagagaggaagaaggaaataaaagaaaaccaccaatttgaacattctgcttctaacttacctttgatcatcaccagcatgggaagaactaattagcatttagttgacaaataactgagcagcaactatatgccaggtattctgttaaactttgaggatacggctgtgaataacaaccatggtcattatctcctaattttcttaaaaatgtcttcaagatgtttgtcaggtcgcctatcaggcctcaggttccaggcaaaaaaaaaaagacatatgaaacccctagaatgtcagaactgaaaggatccatggacatctttttcgatgtcttcattttagagacagagacactgaggtctaaactttttgtgagggcccttccctaaagaatttcctaaaccccagatgatccaggggctgtttggttcatcctattttctggtagtttctaggatcttttctggagatcttgggtattgtttatatcccatatcaaggcattacttctagatcaatgcactaggtctcaactcgtagatcagccctggtgggtttaagaacaaagtgaaatagatgggcagctttccttgctgttaccataacaatgccagagctaatttatgccagttgtgactgatttgataatacccacatttatcttagctactctctggcctgccttcccacccatgcccactttactcctaggagacagagattaggctctaggaaactgcctcccttgagccatagtaccctgttccctgttaccattcagatggggcgttcaaagcatacctggcagtaagagccacagaccccttttgttccccctgccctgtgacaggccttcaatgggccctgagtgttatctaagacaaacaaattttatgtcttccatcattcttcatgatgttgcttttcaggcccctccctaccctgctcactcccctctggctgtgtgctattttcttggtgttcctctgaaaagagggtggactcaaaatttaattctgctctcctgcagtggtatgactaccttccaattgcctctcccatttttgcctctcaatatatttcttcttttttctaactgaaaatggtattaggctttttgacaatcacatttcactgccaactcattttaaacttacataccttcaaaaatgagtgaatgagagtagacaagtattgattgaccccctaatctaccctctgttcaccactgatgtggaaaatttgatagccatcaggccagccaaaagaaggggataaaaaaagcaagactccagggagctaatcatttctcctggcctttctttttccagaaacttgtgtggtatagaggtcgagggtgaccctttggggttatccagctactcccatattcttatgtctcatcgcttatttttttgataagggcagtttacatctattatttgtaatctttagcaagtgactatcttagatactatggctgcaggagatcttgagaagacattgggtcttccctcctctttccttgataatatttcattccaggcagccttcttatagctgcattttcttttctttacactctctggcaaagacttttatcccatttttgatcatgaagacaattaaaaaacagcattagaggaagtttaaaaataggaacaaaaaccagccagaatccatcaactataacagaattatttgcacttttgcataatcccttcaaatctgtccatatgtgtatatatttacagagttgtaatcacactgatataccattttatgtcctactttttaacattgtatcataaacaattttccatgtttctacatggtcttcctaattatcattttaactgctatgtaatatttcatcaagctaaatgtaccagaatatatttataatctatcattggctttaaaaataagagttgataaaacattctaaggtcctaccatcctgtgggcattcttcctaatatatcccctgccataacatacataatataatagaaagaaaatgatttccttgagagtggcaataaataacatatttagggacttaggaagttggactgaattctttattcattgtcttttcctaagatcactctcttagttttatttctgttatattttatgctgatgttgacttctagtatcattgttgaattctggtgattttatggtgttttgtttcttccctgagacttttcaaataggagcagtggacacaactattaaatattttctgaactggcttctcagcagataaatgagctatctacgctgccctcttctgtctctcattgtggtcactcatcagtacctattgcttacccagaagtaatatgttgaatgtgccactgttactgttttcccccagctgtgctcctcagcctgccttagggaaaaaaaagtgggagaaggggtaaggaagccttcactcccatttaatgttgagatgatatgctcactgctctccctgctccattgtagctaagacacgtccagagatggtagggtgaaagagacagatagacaggcacacaggcacagaccaacccagacatactaggctctgggaattacatattaggtagggaagggcctacaggagtttattgccattccttctggtagtcaatgtaaaactttctagggaggcagaatttggggagcaacctctgtaaaggtagtggagccaaaagggtgttctgggaattttcttcctgatcaaaaattgcatatgaaagaatgcaggaaattttcaacatgtcagtcaatgagggcacaaatcattagttaaacagatgtcaacacaggcatagactattaatttgccaactatttaaagacacctactaattaatggctaaattggagagtgagaacagatatgggaaggggaagtgagatttgttgtagaggtcagtaaaagacattgaagccagggatgaggatcttcttggagtgtgcccagatgacctcattggtagctgtgttaagggagacaaagcgaggatagggacagggctatatgtggtaaatcagtccctgtaaaactcttccttaggggttcaacccttaagaaaagtgttaagataatttcacttagctttttgatgaaagcaaatgactataatttcttctcaccaagaacatttttatgtgttactgatttctaatgaggacagtaactatcaagtgaaaacctatgatagtaggttccaaatggaagatgcaatttagattggggctgtttttgtcctgacttaagtatgccttgagtctggtttatgttaccccaatgctttcttactagaccaagaatctctttcatcctttttttctctttcatcagtggttatctttattaatgtgttttatgtgtttagggcacatttatgtgtttaagacacatgtgttaggtgttaggacatattaacgtgttaggacacatttatttataaatatatatatatatgatatatttataaatttatatatatatatataaatttataaatgtgtcctaaacacctgttctgttaaaaacaccatgtccaggcacacataggcttgttggctgagctcatctaaatgatcactcctggccagctacctcagatagttgagaaatttgctttgagaaatggtttgacagatatttgcataatgtgaatagtatgaatgcattttcttaaagtatgtgaagacatgaatgtctaagaaaatattgtatgtgtactttgatgtacacaacagggaaagtctaaaatgataaacaactattattcctggttatttcctgacattaaagttcatgaggaaacttttttttgaagaaatggttttgttttgtcaatttctgttcccttgtgggaagtttttctgttctggcctctgttcccaattttttgtcaatgttattaagacctttggtttggtcctataaggaatagaactttagagatgtgaatggatccagctaaaccagtagctaataagacctgtgaaaatgtgctcaaccagcttcttggaaagggatatttgactttgggggtcttcttcatagaggatggagggaaaagactttggagtctttgcactcttaagacttttgctggcaacccagctttcctaattactcactgggggagtgacttccttctgtaaacctcagtttcctcatatgaaaaatgaaaataattattccatgcctacttcttgggaccaaaatgaggctcttaagtgcttaggaagtgtaaagccttctggaagtcagggacttcctcagcctaggctttttctttgtctacagggctatctgaagcagtgccggaagagaagggacatgttcagtgacgagcaactgaaggtaatctttgggaacattgaagatatctacagatttcagatgggctttgtgagagacctggagaaacagtataacaatgatgacccccacctcagcgagataggaccctgcttcctagagcacgtaagtatcttatccatttggggagggttttgagaggtgttaggaaacaatggaaggagcgtttgagctgtctggttctgttcagctcctttttcctgcagtggggaatgggttcctcttgggccttcattttgacccctggtctctagccaggaaacaaggacttagaaaagtgctgtgatttgccctataaatgttaagcatgtgtatgacctgctggttccattcccgaatgtatattccagagaaactcacagaagtccacaagggagcacatacaaggctgttgttgattgcatggcagtgtcgtatgtggtggagtaccattagaagcaacctaggattctccttctttaccattcccctcccctctccctttccttcttggcagttaccagtagaatttttcttcatcttcccttttttgtttctgttaagtttccatgagactcagtattttgggaggaattcaaaatattcactgcacagagaatcaaggaatctgagaaataacaaggaccatggttagtaagaaagtggtccctgcaagacatttatgggaagggcactggagaaggtgaagtgacaaaaataggaaaagaacacatggacttcgaggatggagctctgggaaacaggatagtgacgatttgagtcctgtatctgtagtgtctgtctgggttactttgggcaagtccttcatgggctttggtttgttcatctggaatgtgaggttacactgtatgatctctctggttctttgacatcatctgagtctcattcacaggtgacctagttgttttgacagcatgtttccccttttaataaagtatttatttttaaagatttaatatgtgcacttaatataaaattcaaatgacacacaaaagcatgcagctaaaaataagccttcttggaaatattcctgttttacttctgagactctgtgttggggtgggttccctaagatcactcttatgtttagtgatttggactcagaatatggttatattgaatgtggtttaggactcagaacatgtttatactcatagctatgatttattatagcaaaatgattcgaagtaaaatcagcaaaaggaaaaggcacacagggcaaagtgcagaggaaaccaggcacaagctttcaggagtccatcccccaatggagtcacacaggatgcacataaatcccctaggaatgagttgggacaacacatataaaatgttgtctgccaagaaaactcattagagactcagtgtccaaggttcttattgtgggctcatcatgtagacaccttctgcctagtgtgtactaaaattacagactcccagaaggaaagcaggtatttagcataaaccacattgtttgtacaggcagtctggacacagtgagccactcttatcagggaatagtgggggaaccctcttgagaaccaagtttcaagatgccagtcaaggggaaatatttccagcaggtttttctgagaacagcaatttcaggcctgatacgataactcttttctgtatggtatgtaaactcattcaaccattctagaaagcacctgggtagtatttataaatgttaaggatgtgtatgaccttctggttccattcttgaatgtatattccagagaaactctcacagaagtccacaagggagcacatacaaggctgttgttgattgcatggcagtgtcgtatgtgttggaataccattagaagcaacctaggtatttatcaccagggagatatataagtggatggggtttgcttattgtgaggtattatgtagcaacaaaccgaagactagatgtatgtaccttatagcaacatatatcagaaacatagtattgaatggggaaagtagaatatagaatagtggttctcaaccgggggctgccctgtacattgtaggatgtttaacagcattcctggtctctagccactagatgtctgtagcaatgccttgctacccagttgtgacaaccaaaaatgtctccagacattgacaaatgtcccctggggaaaaaaaagaatcacttatgttttgaaatgataacatacttttacctttaatctgttaatgcagtgaatttggattgaatgattttcatatgtgaaatgaacattgtattactgggatagaccccacttaaacactgtgtgttatctcttttaatgtattattttaccttttaaaattaattgtttacccttttattagttctagaatttcatttttatcagctttacgtagatataatttacatacaataagattcattcattttaagtgattttaagtgtatactttaaggagttttaacaaatgtatatagttgtgtaaccaccataataatcaaaatataggacatttctataactccacaaagtcctcttatctagacattgcaaacaatctgtgcccctactcctggctactggcaaacattgatctcctttttatttgaaattttgctttttctagaatgtcatatatgtgaaatcatacagtatataatcttttatgtttagcttctttcatttaacatagtgcctttgatatccatccatgctgttgcatatatctttcgtttatccttttttattgcttagtagcactccattgcatggatataccacctattcacaaattaatggatatttgagttgtctccagttttgaactctaatgcataaagctgctatgaacattctagtacaatattttttgagaatatatgttttcatttttcttggttaaggacttccagggttagggttgctaggtggcatggtagattttttagcttattagataatgccaaactattttccaaagtttctataccattttgcattttcactactaatacgtaagagttgaagttactccacatggtcatcaacacttgatattatcagtatttttttttttttttggagacagagtcttgcttcgttacccaggctggagtgcagtggtgcaatcttggcttgtagcaacctctgcctcccaggttcaagcaattctcctgcctcactgtcccaagtagctgggattacaggcatgtgccattacacccagctaatttttgtctttttagtagagatggggtttcaccatgttggccaggctggtctcaaactccttacctcaagtgatcttcccacctcggcctcccaaagtgctgactgggattataagcgtgagccatcgtgcctggccagtcactatttttttttttaattttcgccattctaacatgtaggtgtgtagtggtatctcattgtaattttaatttacatttccaatgtatagtgatgttgagcattttttcatgtgtttatttgccatctatataaaaactggtgaagtgtctattcatgtatttttcccgttttaagtgtattgtttgtttttttattgtttagttttgagagttcttttattaaaaattaatatgtaatttacttatttatggggtacatgtggttttttttttttttttttgagatggaatctcactctgtgacgcaggctggagtgcagtggtgctatctcagctcactgcaacttctgactcccgggttccagcaattctcctgcctcaacctcctgagtagctgggattacaggcatgtgctaccacgcccagctaatttttgcatttttttagtagagacggggtttcaccatattagctaggctcgtctggaactcctgacctcgtgatccatccaccttggcctcccaaattgctgggactacatgtggtgttttgatacatgaatacaatgtgtaatgattaaatcagggtaattgggatagccatcatctcaaacatttatcatttatttgtgttgggggcattccaaatcttctagctattttgaaacaagcaattaattattgttaactacaattgtttttataactattttgaaatatgccattaattattgttaactgctgtgatatcaaacactagaacttatttcttctatataactgtagttttatacccattaaacaacctctcttcatccttctctccccacaaccttcctaacttctggtaactactactatactctccacctccatgagatcaactttgatagcccctactcacatatgagtgaaaacatatgatatttgtctttctgtgcctggcttatttcagttgacataatgtcttccagttccacccatgttgctgcaaatgacaggattttctttttatagctcaataatattccattgtgtatatatagcaacatgttcttcatccattgatccatcagtgggcacttaggttgattccatatcttggctattttgaatagtgctgtgataaacaagggagtgcaaatatctcttctgacatattgatttttcttcttttggctatatacaatatatacccagcagtgggattgctggatcatatggtacttctgtgtttagttttccataccattttccataatggctgtactaatttacattccgatcagcagtgtatgagagttctctgttctctgcatcctcttcagcatttgttattttttgtctttttgataataaccattctaactgcggtgagatgatatgtccttgtgattttgatttgcatttccctgatgattaatgatgttgggcatttttcatatgcctattggccatttgtatgtcttcttttaagaaatgtctgttcagagcatttgcccacttttaaatcagattatttgtgtttttttgctattgagttgtttgagtcacttacatattttggctattaatgttttgtcagatggatagtttgcagatattttctctcattctgtatgttgttgcttcactctgttgattgtttcccttgctgtgcagaagctttttagcttgatataatcccatttgggtatttctgcttttgttatctgtgctttagaggtattactcaatagagtctttgtgcatatcaatgacctgaggcatttttccagtgttttattctagtagttttatagtttcaagtcttacgtttaagtcgttcatctattttgattttattttttcatatggtgagagataggggtctagttttattcttttgcatatggacatccagtttgtccaagaacataagttgaagaggctgtcctttctccaatatgtgttcttggtgtctttactgaaaatgaattggctgtaaatgcatgggtatattttgggattctctattctgttcaattggtctatgtgtctgtttttacttcagtaccatgcttttttggttactatagctttacagtgtattttgaagttaggtagtgtgatgcctccagctttgttctttttgctcgggattgctttggctattctgggtcttttgtgggtccatatgaaccttaggatttttttcccatttctgtggtgaatgtcattggtattttgatagagattgcatttaatctgtagattgcttttggtagtatattttagcaatattaatttaacaatattaatttaatattaattaattgcatttaatctataggttgctttaggcagtacattttaacaatattaattcttcccatccatcaatatgggatatctttccctttttgtgtgtagttgtcaatttttttcagcagtgctttttatttttattttagagatctttcacttctgtggttaaatttattcctatttttttttaaatcctgttttaaatgggattgcttttttggtttctttttcagattgttcactattggcaaacagaagtgcacctgctttttgtatgttgattttgtatcctgcaactttactgaatttgttgatcatttccagcatttcgtgtgtgtaggtagtctttaggtttttctaaatataagattatatcatctgctaacaaggataatttgatttcttccttttcaatatggataccctttatttcattctcttgcctaaattgctctggctagaacatgcagtactacactgaacataagtggtaaaagtgggcattcttgtcttggtctagatcttggaggaaaggcttttgatttttttcctgttcagtatgatgatagctgtgggtttgtgatatatggcttttattattttgatgcatgttccttctgtacccagtttgttgtctttttctcatggagggatcttgaattttatgaaatgctttttcagcatctattgaagtgatcatacaggttttgtccttggttctgttaatgtaatgtatcacgtttatttatttgcatatgttgaaccaaacttttgtccctgggatgagacccacttgatcatcgtgagtgatctttttaatgtgttgtttaattcagtttgctagtattttgtttggaatttttgcatctatgtttgccagtaatattggcctgtagttttctttttttgatgtgtttttgtctggtttgggtaccagggtaatgctggcctcatagaatgagtttgaagtattcctcctctttacttttttgaaataatttgcatagaattattatcagttcttttttaaatgtttggtggaattcagcagtgaaaccgtaaggtccttggcttttctttgatgagacactttttattactgttttgatcttgttacttgttattggtttgttcaggttttctatttattcatggttcaatcttggtacgtcatatgtatccaggaatttatccatttcttctaggttttccaatttgtttgcctgtagttgttcatattctctgtaatgatcctttgtatttttgtggtatcagttatattctcccttttcacctctgatttcatttatttgagtattctttttttcttagtctagctaaagatttgttgattttgagtatcttttcaaaaaaaacaacttttcatttcattgatcttttgtatttttcagccttaatttcatttatttctgctctggtgtttgttatttatttccttctactagctttgggtttggtttgttcttgccttcctaattctttgaagtgacttggtagattatttatttgaagactttctttttcttttttgatgaaagcttttattgccataaattttcctctttgtactgcttttgctttatttcataggctttagtatcttgtgttttcattttcatttgttttgagaaatttctattttttaaaagaattttgttatttacccactgatcattcaggagcaatgtatttaatttcggtgtatttgtacagtttcttaagtgctcttcttactgatttctagtgttgtttcattgtggtcagaaaagacacttgatattaatttgactttttaaaatttgttgagatttgtttatggcctaacatatggcctgttttcaagaatgttctatatgctgatgaggaaaatgtgtagtctccagcagttggatgatatgttctgttattttcagttacgtacatttggtctatagtacaactgaaatccagtatttctttgttgatatcttgtctggataatctgttcattgctgaaagtgagtgttgaagttccctattattatggtgttgtagtctgtctctctgtttaaatctactaatatttgttgtgtatatttgggtgctccagtgttgggtgcatgcgaatttataattgttatatcctgtagctgaattgacccatttattattatataatgacattctttgtcttttcttacagtttttgacctgaagtctgtttcgtatgatatatgtgtagccactgctgctcttttgtggtttctatttgtacgcagtatctttttccatcccttcacttttagtctctatgtgtcttattcactagaaattcacttaaagaagtgaacttcttgaaggcagcatatagttggatgctgttttttttaatccattcagccactctcttttaattggagaatttagtcccatttacattcaatgttatttttgaaaggtaaggacttactactgccattttgttattattttctgattgttttgtaactcctgtcttccattattttactactatcttcctttgttgtttagtgatttttctctggtggcatgtattaattatttgcttttgttagtgtatcttttacaggtttttgctttgatgttactgtggggcttagaacatcttattataaactgatgacaacttaactttgatcaaaagaaaaattaaaaactaaaatctctaaaatttaagtccattacttccccattttaactttttgttttctcagtttacatctttttatattgcctatcccttaataaattgcctttttgttttgttttgtttttgagatggagtcttgctctgtctcccaggctggagtgcagtggcacgatctcggctcactgcaacctctgcctcccgagttcaagcgattctcctatctcagcttcctgagtaggtgggattataggcacgtgccatcacactcagctaatttttgtattttttagtacagatggagtttcaccatgttggccaggctgaccttaataaattgtcattatttttgatagatttttttcagtcttcatactaaagttgtgaacggtttacacaccacaattcagtatttgtctgcatagtttattctgaatttgtctatatacgtttaccagtttattttataacttcaggtgttttcttgatacatattagtgttcttttaagattgaacaactggcttcagcagttcatgtaagacaaatcttctgttgatgaattccctcagcttctgtctgggaaagtctgtatctctccttcatgtttgaaggatggctctgctgggcacagtatgggaggtttttttgttgttgttgttttgtttttttcattcagtactttgaatatgttgcccccctccctcctgccctgtaggacttacactgaaaactctgttaccacaggaattgaaactcctttatatgttatttgcttcttttctcttgctgcttttaagatttccctctttgtctgttaacctttgagagtttgattattatatgccttagggtaatcttatttagattgaacatgtttggttgtctttaaccctgtacctggatatttatatctttctctaggtttggaaaagtctctgttattattactttgaataagctttctaccttttgttctttctcaacatcctctttaaagccaatgaccctttgacttgctcttttgaggctatcccctagatcttgttggcgttcttcatttttctcattattttttctcttcttattgtgtattttcaaatagtcttagggctcaccggttctttcttctgcttgatcaattctgttgttgagaccatcccatgtatttttcagtttgactattgtatttcttagctctaggatttctgtttaattttttaaaatttcaatttcattgttaaatttctgtaatacatttctgaattgcttttctgtgttacattggcattttctgagtttcctgaaaattgctattctgcattcttgatctgagagctcacacaacatcatctcattagggtcagtcactggctccttattttgtctatttgggaatgtcatggtttcctgtttgctctttctatggatatatgtctgtgcatttgcattgaaggattagttctttattccagtcttcactgtctggcttggtttggtctttcagaagtatgtctgtctagaggttttgtgcagagtgactatttagttcccttagcctgagatcactgcctccttttcaacactagatggcaccctgaacccagatttgacatagtctttctcaatttcagagtgctactcatcctggatggggaggaatcccaaagataccccagctctgtgggaaagctggatggaggtttgttcccagaggactgatgaagtgtgcttcctgcaacgtgatgctgttaaacagcctttctgatttggtgtcttttttgaggtcagatgaagggaagctggagtttcatgcactgggtgttgctaaccccacccccaccctctaactctagctgcctttgggattttttactctgcaggcattcaagaggcttcttacaggttgaggcaggaataatttttctggaaaggaatctaagatggtggggaagctagctgtccacttttattttttccagtattataggaaccttgattttgagggtgcctttctacacagtgcctggcagcttggggaaggagctattttaccttttgcttgcagtttttcagttctctgtggcctctgggattgtcacaacttcagtcattgagttctggaatattccttttgataatctgggcagtggctagttctttttggttttctgtggaggagagtaaagctacatatactgtgctattttggtgacattctcagttatgagaattatatattttgttaacaagtcctttgtcagataagttatttgcagacattatatcccagtctgtggcttagcctttcattttcttaactgtgtcttttctaagttgtgcatatttatggagtatgtgagaaatttttaacatatgtataatgcatagtgatcaagtcgggttttagggtacaatgcattttttttaagtatagtcatcctactctgctattgaacattgaatgtattccttctatcttatgtttgtaccctttaacccacttatcttcatgttctcccttctcacctgctcacacttccgtctctgttatttttccaccctctacctccatgtgttcaaattttttagcacccccaaataaatgagaacatgtgatatttgtctttttgtgcctggcttatttcacttaagacaatgacctctagtttcatctacgttgatgcaaatgacataatttcattctttttatggctgaatactattccattgtgtagaagtaccatattttctttatccattcatttgttgatggacacttagattgattccttatctttgctattatgaatgttgctgcggtaaatatgcaagtgccagtattcctttgatataatgatttattttctttaagtcaatacacagtaatgggattgctggattgaatggtaattcgatttttagttttaagagtatcttaattttattgaaatccagtttatcgctttattttattttatgggtcatactttttgtttcctactttctttgcctatctcaaaatcataacggttttctacttttttaaaaatagaagttatatagttttattttttacatttaggcctatgatcccttttgtggtaatttttatatatggcacaaaatacagatcaaggttaattggtttctgtatggatatttgttaaaaaatactgattcccctattgaattgcctgggcacctttgtcaaaaatcaattaagcatatatgtgcagatctatttttaggtatactcttctgttctagtgatctatatgactattcttgtaatagtaacccactttcttgattaatataggttcatagcaagtctttaaatcagatagcataactcctccaacttagttctttttcaaaacaattttagctattttaggttatttgtatttctatataaatttaagaataatcttgccaaattttaccaaaaacaagcaaacaaaaaccctatcagtgttttggttgggattgcattaaatctgtggatcagttttgggaacattgatatgatgagtcttcaaatccatgaacatttaactgtttatttcgatttttttgtgatttctcccaggattgttttttagttttcattgtatgattttgaccttttaaaatttgattgttttaaaaaatatttaaggtataaatttaagatgtacaatgtgatgttttgatataaatgatgaagtgatgactacagtcaaacagattaacatatcatctcacatagttacttttttgtggtaatagtatctaaaatttactctcttagcaaatttccagtgtataatacaataatgttgactctagtccccatgctgtaggttagatctctagacttttcctgtgtaactacaactttgtgccctttgacttatatcttcccattttctcccaccccctcacctctggtcaccaccatcctaatctgtttctatgtattcattttttttttccttttgattccacatataagtgaaatcatgcagtagttttctttctgtgactggattatttcatgtagcataatgtcctctaggttcctccatgttgtgacaaatgacataatctccttccctccttctttttaaagtctgaataatattctattctgtgtctctgtatgtatatgtaatatatatataaataaattaaaaatagaggtaatttattaaaatataggcaacatattacatatacatatacacccgacagtttctttacccatttatccattaatggacactttgtttgcttccacatcttggctattgttaatagtactgcaatgaacatgggagtgcagatatctttacaaggtagtgagtgcatttcctttgggcatatactcaaaagagggattactggataatttgataattctatttttgatttctttgggaacatcttaaaggtattattttccacagtggctgctgtaccaatatatattcctactaacagtgtacaagggtctccttttctctaaacccttgtcaacacttgttatgtcttatctttttgataatacccatcctaatagatgctaggttatttctcattgtggttttgatatgcattttcctgatgattaatgatgttgagcatcatcgtatacctgttggctatttttatgtcttttttggaggaatgtctattcaaattctttgctcatttcttaattagtttatttgtttatttgtttttttttgctgtgaagtgatgtgagttccttatatattttgaatattaaccactttatatattttatatatattaaccactttatgtatattttgaatattaaccactttacagtttgcaaatattttcactcagtctataggctacctttgcatgttgttgactttttttttctgcatagcagctttttaatttgatgcagtcccacttgtttctttttgcttttgttgcctgtgcttttggtgtcatataaaaaagcacagcagtagtgcttttagtagttttattatttcagctcttatgtttcagtctcttatgcattttgagttgatttttgtgtatggtctaaaatatgggcccaattttgttcttttgcatatagatatccagtttttccaacaacatttattgaagagactatacgttccccattgtgtcctgttggtgctcttgtcaaaaattagttcactatatttgcttcggtttatttctggactctctattctattacattggtatatctgtttttatgctagtaccatactgttttgatttccatagttttctaatattgtttgaaatcaaagagtgtgatgcctccagatttatttttatttctcagagttgctttggctatcaagggtctagtttggttccatagaaattttatatatgtttttgtctatttccatgaaaaatgccattggaatttagataggggttgtgttgaatctctatatcactttgagtagtagggacattttaacaatattggttcttccaatccttgcacatgggaaatctttctatttctttgtgtcttcttcagtttctttcatcagggtgttttggttttctgtgcacagatctttcaccttcttgaataaatgtattccttaagtatttcattctttttgatggtatcataaatatgattttttaaaatttctttttttgatacatcattataggtataaagagtgcaactgatttttgtacactgattttttttttgtatcctgcatctttactgaattcactttttctaacaggtttttttctttttaatttttggagggagtcttttgggctttctacatatataatcatcttatctccaaatagggctagtttacttctgatccaatttggatgcattttatttatttttcttatctgattgccatggttagtatttctagtactattttgaataaaattggcaagggtgggcatccttgtcttataccagatcttagaggaaaagctttccatttttcaccattgattatgatgttacctgtgggcatctcataaatggcctttcttatgctgaggaaatttttaatattaatacctaatttgtgaagatattttatcctgaaaggatgttgaactttgtgaaagctttttccacatctattgaaataaccgtgtggtttttaaattattccttttgctaatgtaatgtatcataataattgatttggatttgttaagccatacttgcatcccagggataaatcccacttggtcatgatgtatgatctttttgatatgttactgaattgggttagctactattttattgagaatctttatacctatgatcattagtgatactggcttgtagttttcttttcttcttttttttttttgacagagtctcgctctgtcacccaggctggagtgcagtggcgcaatgtcggctcactgcaagctccacctcctgggttcacgccattctcctgcctcggcctcccaagtagctgggactacaggcgcccgccaccacgcctggctaatttttttgtatttttattagagacggggtttcaccatgttagccaggatggtctcgatctcctgaccttgtgatctgcccacctcggcctcccaaagtgctaggattataggcgtgagccacagcgcctggcccttttcttgtatttctgtctgactttagaatcatttgggagtattccctttagttcttttatttatttatttatttatttatttatttatttatttattgaagagtttaagagggattgctactaattcttatctgggtatttggtagaattcagctgtgaagccatctggtcctatgatcttttgttgttaggagattttaaatgactacttcaatctctttatttgttaatgttcaggctctctatttcttcttgattcaatcttggtaggttttatatttctaggaatatattcatttcctctggtgtttccaagttgttgtcatataattgttcataatagtcccttgtaatccttttcatctctgagacatcttttgtaatatcttcatgttcatttctaattttatttacctatattctttttctctaaaaaccaagtcttagttttgttgatttttttccctaagtttttctgttctctgatttatatctgctttgatcttttatttttttccttctgctatctttgagtttactttgttcttctttttctagttccttgaggtggaatatcagattgtttatttcagattttttttaatgctatcaacgcccctcttagaactttttttgctgcatcccaaaggatttggtatgttgtgctttcaatttcatttgtctcaagatattttttaatttcccttttgattttttctttgacccatttgttattcagggatatgttgtttaatttctactgatttaagaatgttctagttttcttcctgttactgacttgtagttttatatcatcatgaccagaaaagatacttgatatgatgttgatcttcttaaatttgctaagacttattttgtggtatagcatgtggtctattctggacagtattccatgtgtgctttagaagaatttgtgtgatagcctgtctgcgtgggtcagctttggtaacatgtggtagtgagactagaatccctagtttgggaccctagggctgtttgcaggtacatgcatggtagctgtgctgggtcactgggccagagcatccaaggaggtagtacttgcttaagtacctagagaatgcaaaggctcctgtgctgagtccctttgccaaggcacctgtggtaggagtagctcaggcagctctgggcatgggggagggaaagctctggtggatcagggatctggagaatgtgaaagctgttggcctacatcaccccttcccactgggctatagtaaccacagcagcagttgggcagctctgggtggctccaggaagtagagaagaagaagggacatggctcaggcatgttttttgttgttgttgttgttgttgttgttgtttgtttgtttgttttttctcctaaaactcaaaaggaagaaaaaacaacccatggacccttagcagtataagctgcagggcgtctgctgatactatactagcagttggttttctcagcaggaaaagctgaaaaagcttctggggtctgtgactgtgaacactgaagaatcttgagaggtaaaatctacaggaggtacccagtggctatgagggctattgaggtccttgacagagaggcctactggggccctgtgccaaagaggccacggcagatcactgcgactcctgctactttgctgatactgatataaccaatccctattctttgctctctgctgtttccagacatctaggctatatctgtcttttcagagatctgggtgggatgaaactgaagctggtcattagggcagtgtcccataaagctggggaagctggttgtacactcctgtctcctccctgtatgtaggacacaagatccaagatccaagttgctgtttcataatgagcagtaccagctatggggacggggtgatgcaagcaaaatgaaactgtttttcctactcgttttgtgtatttgttttctgactttttctttcactatattgctgtggcttcttaagtggacccctaagcttttccagaattattttttgttcatggatagctaccaaattgttgttgtttgctgaagaaaggaaggcgatatttcctactctgccatcttactgacatcctctcctaaaagttgatttctaagtatttaaaattttttcggctgccattgtaagtggtattttaaaatgtcaatttcctatagtctattactattacacaggaatacggttgatttttgtacattgactttgtgtcctgacacataaccaaattcactaattggttccagtattttttttgtagatttcttaggattttatgcatatacaattatgtcatctctgaaaaaaagagtttaatttcttcttttttcagtctatattctgtctatttccttttttatcttatttcactggccgggatatacagtacggtgttaactagaaatggtgagaacaggcatctttgtcttgttttgatcttaggggcaagcattcaatattttaccaagtaattagcttaacgtttttcatgggtgtcctttattacattgtggtagtgtctttctatttctagtttgctgatgtctttgtcataaatttattttctcaaatgcttattcagcattattgaaacgatcatgtaatttttctcctttaatctgtcaatgtggtaaattacattgggataagtctgtcctgatcatggtatattattctttttatgtgctattttgcttgtttttcaacccttatataacaactctatcttgattttttgttgatcagtttctattgcctattgtttctcttgggttttataaatattttctattctaatgtatcaggttatcttttattaagtacttgtcaatatataataaaaattatagagtttttttaaaactttacttggaattaatttcaaacttatggaaaggttgaaaaataagaaccatacaaaaaatacccagattcccctgttgttaacattttaccattttgtcttatcatttgagtgtgctctccctctctctcctgactctctcctcttcccctctctttatgtacatatttatatgtccatacatacatatacacacactcatacatttttttctcagccattagtgttttaacttgcatacatcttagattccttacctctaaacacttcatcacattgtgtttccttagggacattttatggagataatatcaggctctggattgtgtgattccttcaaacagatatttatttatatttttagcttttccagctactctcagtggcagggtttgcctgcaacaacttagtctgtcattgccagaagtagagtcactgatctcttgctttttgtgatccagtcccagagttttatttccatgctgtgttttactcttattagggccagtgttcccttattacccttcttttacagaatgtccctactattcctatgtactcatttttctataagaaatttacagtcagtttgtcttgttactgaataatttgttttgatatttattattaaattatgaatcaatttaagaataattgactcattatcattttaatatttctgcctaagaatatgatctgtctttccattacttcaagacttcttttggggtccttggtagacttttcctttcctttttttcttttcccacagcaagatggattctggatatactctgagtattgtaacaaccacctggatgcttgcatggagctctccaaactgatgaaggacagccgctaccagcacttctttgaggcctgtcgcctcttgcagcagatgattgacattgctatcgatggtttccttttgactccagtgcagaagatctgcaagtatcccttacagttggctgagctcctaaagtatactgcccaagaccacaggtaagggatcgagggagtcaggagtgaatgagggaacttcctctatctgttggttctcattgagaatacatgtccttttgccctttctgagcttctgttaacttatctgcaaaacaggatgatacattcttgattgcctcatagccaacagggtacagaaggcagagctatcactggctttgttactcacacaaaaggagggtcctttgccactatatttgggttaaaatctgaaatctgcctagggctccagaaccactaaagcatataagatatgatttgttagagaagcagcatcaatccaaaaacgaacccaaagatgtaaaccaaaccaactggcccacacccatggctcatgcatctgggtctgaaagttagccccaaggagaccaagcaatggagctaaatcatacttgtggactgataatattcactaggtaaattatatatggcataattcatcttaaaagttccagaaaaaagtttttaagcatagctcaaagctatgttagtttcttaggccaaaacaacctcagagctttttgggggtttggtgggcaccaaaaagataggacattcgcctgggatttgccatttctgtacactttcaccttgtgactggaactcctgcttcaaagtcctcttgccatctaggtccctgattccctctcctctcaccccttgcgctccagagtgacagtagagtagctcaggcagtgtcaggcgacatcaatttctgccctttctcagagtgacccgttgggcccagcacaactcccacgacatagacaaccccttttggcaggtctcaggaatctgtattaagatgatggctcctgccatgcatgtcaagagtagctcggatttgaaggcaactaaaggctgatgccagcttggaagcttagtaagataggtgttcagataggtagggctgaaatacaggcagtcagaatggcccctgagggagaagattagatgaagaatgataaatagagaagaatactgactttgcttacagatgattgatataattccctaccctaccttccttaagttgatgagaatgaagactgcatgtaagagggaggctagctgacatgtctggaagtagaaaatctttgttctgttgttctccccaataagaggctgggcccagacctcatctgagggctttgaccagggttaggctggaccacagctattcctttcttctcctgccgactgctaaaactagtaggacaggttagagatgggcacattccccctctagccattttgagaaaggcagccagctaaagatggcaaaaataggcagtatgggacactgacagtgaggaatccatgactgagtagtcttggtgtagaggaaatgaacattgtcatgccaggactgcccagtagaactttctgcaacaatgcaaatagtctatatttgtgttattcaatatagtagttacccaccacatgtgactacttgagtactaagaaacatagctagtgcaactgaggaactaaattttaaattttacttaattttgattaaatatggctaatagctaccatgttggacagtacagctctgtgctttacttccaagaaagtggtttagagcactgatctcctcaaatcagagaaaggaaaggtacaggggcagaaaatgggtccaaagagcaggagcacttacttatgttagcagcttctgtgctgcaatcttcccttctgtcaccactctacctccttctaagtgtcaggctcagacatcttgccaaggagaaacttcggtgatgtcacagagcccaaaagatccccatacattggagcaactaactgtaaaagaatgaaatgtaacagaaacaaatgtagagtgtttccattgggtctaagataagaaataaatagctcacggacaggctgagagagatacagcttctagagtgtgttttgaagagacttaggaagtgttagttggccataagctcaatatgggtcagcaatgggatccagaagaaaaactgataatagctaacattcactgaggctcagaataaagacttttctaacatatttgtcttgagacagaatagactggttaggaagtatagtgaaaagcctttcactggaggtgataatgtaacattgtttgagagccatggctctgacaggtgtgcagatcacagattggagtgagggatgtgaactaggaggaggtactacgtaggatctgccctggcaattagaagtccctttcctctgcctttctttggtccatcaacccactattcaatgttgtgggtgtgcagttgtgcagttgtgcaaagatgtgcggttgttgcacatctatttttttctccttccttttttaaaaaatggtactgagagattaagcagactagtgaccacaaggcattttcagtttctctaaagaaaggtgttaacactgaactgtaaggcatcctcttgtcttctcagtttatttttgcccccactgaatggctgagatctcactatcaatctgcctttcccaagagccatttgattgcaaatcagaaaagaacagcagaaaaaaactggataggatatgtaactctcaacacgtctgctatccagagtcccaggatgtggggccaagggttacacgtctgagactaggggttttaagaggcatcccatgtgatggctctactacggaaatgtttgatttgtaataatagtactgctaacatttgttatatgccaagagtaaaatagtttacatggatgattgtatttaatttatgaaaccttcaataaactatacttttccccattttacagatgaggaaattgagtcaatgagagagggagtgaggcttgccaaaggccatactgctagtcagtgagaaaaactggcatttgatcccacaaagtctggcttcagactttatgctcttacccactgtgctacattctgtttctatattgtgcaaaagcaaacgtgaggatatttcagagtgattttgggcagaagctccatagaaatagatgatggaagagatgataaggtggtctatactgtgtcatgtgtgaggctcccttcttggtccttggctggctgtatcagataggacacaaaaaaagtgatgtaacaaaatagtggtccatttgtctctcatgtaaaagaagtatgtattctgaagtttatgactggtatggtggcctcatggtcatcagaaacatgagcaccctacagctatctactatcctatacctagggtattgaccttgtccttatggtccaagatggctaccagaggttcggccatcacatcaacattccaagcatcaggattgagtaaaggctaaagaagcgtatgctctctaccttaaaggtgatttctcagaaggcctacctgatagagcaggagcaccgtcatcttggacaaacactgccacttcaagttccagctccctttctagcctcatgcatttcaaggaaatcacttcttttctaactacaagcagccagaaagagcagacagtaagagagctcaggcacagaaggaggtaggggggaaagtctcttgagtaactgccaaacttcaccctcatacaatgggccccagtaaaacagtgggcgttaataaacacattccttttccttcaggtgcactaagatagagaagatgaaagcagactcaggggatatgcctgcagctgcaaaaagatgtatgggaacagacacacaactctctcttcccagataagcacaacaaagaggcgcaaaagcagtctatgcctctgataaagtctcccaccctgaatccttaaaaactcttagtctgtaagaaagtgtggctctgacctaactcggccagccgctcctctcaggtttatttaaaatcaacctgtccctgttgactgaaaagccatccttcatgtttctctcctctttctttaattcttacactacgcaacacttctatttacatatcagtgtacaaaacttacttgcatagtcatttttgctgaaacaaaagatagaaaatgtagtctttaggtggtgtgggttcccatctgaaaatcaggactctgttactaaggaggtagaggagagtggatgttaagattggcacctagcacattggttctttggcacattggttggttcaacttgcactcttttgttttcacagtgactacaggtatgtggcagctgctttggctgtcatgagaaatgtgactcagcagatcaacgaacgcaagcgacgtttagagaatattgacaagattgctcagtggcaggcttctgtcctagactgggaggtaggaaacttaccaaccagggtattgggaaatctgaatagcttggcaaaagcttcccatcttagctaaggacaggtgaagagaaattacatttgaagagcaacagtaaggatttagattagactcaaggtaaaatttcttgctaatgagaagtgttggatacttgaataactttctaagaagcttggagaaatttttgtgatgatacctcattaagaaatgaaaggttcatttcttcaggtattgccaaggaacaattagggttgattcagtagcctttcaaagctctttctggatttatgaccaacagattcacacttagataagaaatagtatatactaatttacttccagacacagaatacgaggttggttctcctgttcccaaccatgcaggacagccaacatacttttttttttatcggtgataccacctcaccctagcacatctattaggtctctctattaggcctgtacactataggccacaaccatcatccctgccaaatccacagttttcacatctgtttttaaaataatccctgattatttcattgcagacagccatgacttctctgaattctgaaagaccttcccttcctagatgcccaccaaaagtatcaggagtaatgacatttcacatatgtcttgcaggcccaggttgtgcaatctgatagtctgctggctaaaataaccaagataggagaggctggacgtgctactagggagggattagcaatcttaagccttgtggtcacaatatagaggtagggtctgctccctattccactgacctcaactcaagtgtcattttcagtgattaagaggtagtatttctcttaatacttaaagtattttagcccgttccaagggaaccaagcatcatcctcacaaacagctgcttaaccaaggcccagaaaaaagtcactttccttttattctgctacctctgtcctaccttaatgtagattgctgaaaaagaccacaattctgatcagctgacatccttttgggctatatttgaaggataatgttcccatataagtagaacagcactttgatttgcagagaaaggaatttgtctagatgaagagaccctcattctcttaagcagaagccagcactgggccagacttactagaaaattgtgggtccttttttccttgtgttggcattgctttggccatttgcctgattaaaggcagagagctggaccaaatgacttctagcaagcccatcaactctaagacactctaaaattaaggtggattagctggccttattctctctcgttggcagggttttttgtaagagaaggtgcccagcagcagttgtcttcctattccctggagcatctccccaacttcccaatgcctagaagactttctgattcccctgtgtgctctgggacatcagtccttggagcaggagccatggggaaccaaaaatagcatgaaattacctggcctactcagggagcttcagtagcaccaagctcaataacactgagctatgatttaaacactcagcatctcagaaggaatttcctgcatgtatgtctgaatggggccacaaaaacacagttctaacagtgtctgcctcctttattagcctgattgattggtactctaatctcatgtaagcccacacatcccttgtacgctcctgcttggtgaagcctttcttcatctaaattgacatcctacttcattcaggctgctataacaaaataccatagactgggtggcttataaacaacagaaatttatttctcataattgtggaagctgggaagtccaagatcaaggaaccagtagattcagtgcctggtgagggccctcttcatagactgttgtcttctcattgtaacctcacatggcagaaaggatgagagaactctttggggtctcttttatgaatgctattcccatttaattcatgactgcctcattctcatgaccatcatcccccaaggccttacctccaaataccatcacagtagagattatgtttcaacatgtgaattttatggggatacaaacattcagcctatagcaatttgtaagaagaaaaattcttcatggtcttcttgtcagactgaggtcactgtggaacttgccagttccagcgaagttgtcctctaggaagtcttttctctagtaaagcctgatggatatatttcaaaggccaagcctaaagtttctgtcatatttgccatacctgtgttaaagacttctagaatgtcagaatcaccaaggctcttagaggactccccctacaaccctgacgattcttgtgtgtatacacatgcacatatgcacatgtacacatactctcacacacttactctcaaacaccttgcaatgatggtgaaagacagagaagcagagagaggtttatttcctaccaaggccacacagcaagtcagtgacaaagctggaacttgaatctagtcccctgattccttgtgtggtattgttttcagtaaggtaccacatattccttcaaccttctgcctctcacagcccaattgctgttctttgtgatatttcagcgacttgctttttgtatgtagtaaagagtttatatttaaataagacagtgagactaccttggggaggtcatccaaatcccagtcaggtggtgggtgagtgctggggagtctccccaagaaagcaatgagacatggatgctccatggcttgatgatggttaggattggtggcccaatttcacaggttccctggtataggttctttgtgcattccacctgcccaagaagttgtctaggcaaggagagacattctgccagattgccgaggactgctgtgaacagaccgtgcaaatcaagaaaaagatgccatattttgctgtctctgccaccccccttgtctcccagatgtttgaacaaacagagtggctgtcaaaagcatctgcatgataatttcagcttcatttgtcaaatgaaaaagaggagtcataggggaaaccttcagagcttaatctcccttgaagaggaatttggagggtagcatgcaggcaattagtgtctgctcaatagatcagagtgtctggctagagagcaggaagccctgcattatatcaaggcctgacccttctcttagcttattccgtgaacattcttggtctctttgcccaactctggttattatccctgccctctaccattctatagggactagagttcctgaagtaactttccttttaccccaccccccagggctcctgaaaatcaaatggatgagtaaaagtgtcagtcatctctctactaatcaatacattagagcagtatgcgggagcagcagggagaataatctgttcccagggactgcagtttctgggaaatttctatttctaatttccatgatgctgaggtttggttgagctgtcactttgccaccttgcacactcatttaatccacttgaaaacaagggaaaggtaacatatcctggatagcttctttttaatctttttttttttctggagatttgtagcaggaacctaacattgtagctcatatttgggagcttgattgtgtgtggttgtaatttcctctttgtgggatccctctcctcccagcctggttgtgtaatacccaaggacctgttccactttgctatttgatgactgaatccaaagaagttggaggaaacaagaaaacccaacatgatgaaggcagcaaaagcatctacttaaaagctaaagtggcttgatgaggcatactcctgggacaagaagatcaaatgtagggctagatggatttgttactcctctgccttcctgtcagtaggcagcattgaaaataaactagttaaaaagtatggcattccccttgtcctttccctggatctgctcagattacagccccacatcaattggcctataattagaatggggtgaaatcaggcagaatggggtgaattagaattagaatggggtgaggcctcttcgctcgggctctgaccccaaggaaggaaggtagataagctggcaagaaagctttgggtagtttttggtggccactgttcattccacacctattgatttagttgtcaaacagtatttattgagtatttaaatatcaagtactctgtgtcagaccttattctaggttctgcaaagacatcagtgaacatgacaaagtttccactctcattgatttatattccagtagggaaaagaggcaacaaacaaacatatatcatcaggtagatgggcctctgaagaaaaataaagtaggataacaggttagggagtaatgtggatactacctgaggaagtaacagttaagaacagacctgaaggagaggaaggagcaaaccatgtggttttcttggggcacagaattccagacagaggggaaaacaaacacgaagaccctgaaatataggagtgtgtgctaaaggaacaacacggaagccagtgttgttactctacccagagtagagtaagtgagtgagagagtgggagcaaatgaagttagggaggtgactggaggtcagatcctgtcttcataagactgactgttagtttgagtgagatgggagccactggagggtttttgagcaaatacgtgaaattatgagacttatgttttgaacatttcccctcatatgccaggccctatgctgggcaatgaggatattgagatcaatgagatgtggccttgaacatctagtgcggacaaacatattccagcagagggaacagtgtgagcaaaatcctggagggagtgaacagatccaaaggcccacggttggggatttttggaaggagttgtacttttgggggcaagacaaagagatgtgttatataagtggagcagaggaagcaagggtgagatctctaaacaatgagagggctgtctcctttccatgaactcatttgacgctctcaaacagccatgtgaagtgggtcaaacaggaactgttttaatattccccctctacaaatgaggaaacagatggcgagagtttaagctagtttctaactcaagagtgagttggtagcagcattggactcagagcccaggtcttttgagattctcaccttagaaatcttccatggcatctggttgttcccctgggttggtgacagtaggaggagattgggtgggggccatcattctaatgtggtttggtggataagagcataggctttggagggcttctgacctaggttctgcccctttgggcaaattacttccaatttctttgaccctggttttggggtaataacaaaacatcacttactgggttgctatattactaggagacaggataggtatggaaactggggcacacagtaatagtcaagaaaataagtatcacttatgttgagcttatagtgtgatgtgtaccttctaggcactttatatgttttaatttaaataatcctcacaacacccaaatgaagttggtactgttattatccccatgttaatgatgaggcaactgagttatagagagactacgtgtgttgctcaaggttagtcagcttggtgagcatagaggagtattattttaattttttttctaattggtggagttacatgttgcaagtaattaaaatataattgatgctgggcaccgtggctaacatctgtaattccagcactttgggaggctgaggtcggtggatcgcttgaggtcaggagtttgagaccagcctggccaacatagcaaaaaatcatctctactaaaaatataaaaattagctgggcatggtgtcacacacatgcctgtaatgccagctacttgggaggctgagacacaagtatcgcttgaggccaggaggcagagtttgcagtgagccgagatcgtgccactatactgcagcctgggcaacagagggagactctgtctcaaaaaagaaaaaaaaaaatgtagaattgagatgcccctggctggtggagtggatggaccagataatactgggtagccctcctggtcgtatcatccacatttagtaaattgtatatttaaaagtcattctgaccatcttcttatggcattggctctcttttatggctttattggacttcatacatattcaaagtggactgtagcacatcttcctagcctgcatcagggtgggaacctctctcagcttcccatccctccagcaggaaatcgctgtactgctccctaacctggtggctttctttcccagtatcaggcctccagaggttctgtgctagtatgtcagcccctctagaaggagtgtttacctagttcctggataatattgaggctaagtcgggagcctaaagttgaagcagtatttctaagctttttttcggcagtggggtggggggttctattattagaaaataattctactgagttccccctttccttcccatcctttagactggggaaaaaaatggtatgctcgaatacaccatttctagatgccccactctctggcctactaccctgcctgatttgtgtttgcctctgattatttctgggaggtataaaggtctccatctctaaccttgccttgaagcttttgggtgaaaggctgagatcttagcatcaaggtatcagccctatcatgaagatcatcctcatactacatctgggaaaactgacacctagagagagaggaaggaacgggttctccaatgcctttttggcctaaagacagtataatatagtacaaggagtgagcatattctatggagccccagaggttggagttgggtcatggacctgtagctaactagttgggcaactttggcttatcacttgatctttttgtacctctaactgtaaaatgggagcaagaatatctacttcccagggctatcgcgagtctcagataagatagattgaaaatatctggcgcactgtctgactcatataggtgctcaggaaatattaattcttctgtgtcttgggacactactctttgtccctatcttcacataggccctggaatactcacccctgtgcccacaacttcggtgttggtttgccttgtgtttcatgagttttgagcatacctgcattcgtctcctccatgaagacataagctccttgaggacaggggccaggtctaccttgacatctgacacacacctgcaacatacttctgacctatcagagttgccataaagaaggagtaggacttggaaactctgtagaattgaattagctaggacttaggtgtcttggtgcctatttgtgtcagactctttgtagcaaggaggataagtagttctaggctttctggataacagaccaaggaatcatgtggcagttaagtttcttattcaatcagtagattttagtgaactgagaggagaaggaaaaacaattataagaggggagtgggttctttttctctccctctgttatcatcttccttcttgtcctcccgtttccttctactcatgtgggaggcagtgagattaaggcctgttcttcaagtattagaaagagactgagggaccagagcagggattgagagactgggacagaaaaagagatttatagagaagagagatggagaaatatatatatgtgtgtgtgtgtgtgtgtgtgtgtgtgtgtgtgtatgtatatatatatgtgtgtatgtgtgtgtgtgtgtatatatatatatataaagaaaatctctctctctctctttctccacacacatatatatgtgtgtatgtagagagagagagagagagagagaggcagacacagagagagacagacagacagagaacttataggaccagagggtaactggtgtagaaaagctgtagcagtcccgggtggcagggcacatttggccttggggtgaataagaaaatgggtcttcctagctcacagagctgtaaagctttttgaggagtcccaggagtccctctctccctctgtctctaccaggccctttctggcctcttcctatcccagtctatgcccagccttgggtgcctccaggcaggtgatggtgccatccttctgcctggctgcctctcatcatcacatgtccttcccagggcgaggacatcctagacaggagctcggagctgatctacactggggagatggcctggatctaccagccctacggccgcaaccagcagcgggtcttcttcctgtttgaccaccagatggtcctctgcaagaaggtaaccctgcccccttcttccctgagggagatgggtacctaacagggtaccggaccctcctcttcatcatccccaggctcccaacaaagtgggcaaatactgatggggggaaaacagacaggagattggcagcaattctgtatcaggaacactaatgtggcatgaatgtcacaggcagggttggcttgtgggcagtgaaaaactctgaagtcggtgcattttgtcttggtattttttttaccctttgccctaatgaccctggggtgctccttctcactttcttctacccagagctgctggtctgcaccatttgtaaaaaatattgaaatatgtctatcttagttggtaaatagtagtttccctgagcactttccctcatttccactctaatggctctggccatgtggcccctctctgccctgggaaccaacgaggagcctcctacttttgccctgacaggtaggtacctttgtgatataggaattttttccatgcctctacctatttcctatacaaggtgcactggttccccacaacccccaaccgtgctcttctccactcttccttctttgtaatccattagaggagaggtcttactcttgtcactgactctggataactctgtgtatgttggtttctaggactcttctcctttgtgaggctgggaagggtagcatatgttctaagcgtcactcctccttatgggatactcttacccctacttcctcactcacagtagagagttcagaccagttttggctccaggggctaactgggaagaattggggaccaaggaaagtaaaaatggaagaagaaaccagaatgcttagagtgactttacaaattcaccatgctaccctttgctcttttgccatcatctagtccctttgtcctctccttcacccagtagtgaatgcctctgaagaggagtgctgagtcacaaaacaccagagtaaatagtgttacatttttctgggctggaacatgaaccacacagttttaagccccctgtcctctgtgtgtgtatgtgtgtgccatatcttgtattgaatctttatccatttgctttgacagtggattgaggggaaaaacactgagcttaggttcagactgcctcagtgtttggtgataagctctgaatgtccactctagaaccaatagccagtcagttaatggggataataacttacctcagtatggagctaaccctcaaacagagaacttttatgaatctgaaactcagccaaacactaatgcttctttttagctcccccaactcttctcaggactttcataaaatcaggaggtaggatttttgagggttaatttaggtggccatggaaattctcagcatatcagccatgtcaccaacactaatgtgcctgttcttcccactaaggtgtttacactcagaacaagtagccatagaggcagtaaacaaataggaacctggcttattttatagttctgcaccccctaggccctgttaattttggcatctgttagccaaggctgggattactttaactaaattgtgaaactaggctctagaaagcagtggctataagagatagaccaggatccagaacataaaacagtgagtcagaagccaggaataaaggggaagaaacaagataaacaatgggtttaacttagaactcaacgggcagtggaagaccaagatggagtaatgagccatgtctaagccagatagtgggagccaatgattaggaagaaactagaagtcaagccagggctggggattcaaaccagctaagctggcagggtaggggaagcatataacagggatggtgaaaacaagagaaacctcgaagcagtcatagcttcccacagaagggagctttcttgttttcacaagaaccataggctttcttcccaagacacagccagcctagagtctggagtataaaggctaccaactccatatacctgggtgttcttgacactggcttcccagaacacgagcagttatagcctaattgttcaaaggccattaaaactacctgatgtttgttttgaagatttccatttgttatctacaataagactttccattcaacaagtagggataaacttttgaaaaatgatcatgggaccaaaagaaggtatgcagagagacaaggtattttgtctgctgggttgtttagggaccttttgccattactacaaaagactctcttcttgagatagagctgggaggaatggactaggctctctggaggtgaaaattcctttgacaaagagaatccatggaggaaaggaagggaatgtctggattgggccaaggtgagtgaggctgtcaccttgttcacctcaggcacacaatttaattggatgtccgaaagttcagtaatcctttttaccaggaagaaaggaggtgaggatgctaaataatgaaatatggccacattaagctttctgatgatctcatatttaaaaaggaggaaacaaagacccctaggaagtggctaaataatatataatattttacatatgatataatatttaacaggggtgacaaaagagtttcatgaatcctagaatgagtcaaaattagtttttaaaaatgcttaattttaattacttttaaagctatgttcaaatgaagaaaaaagaagtgatagtctgacaaccccctgtttgaggcagatggtttactgataacaggggaatataaattccttctctatcaaggaaaagaagtcataaacttgtttcaaagggaattgaagcccaaaggatctgaggttgtaagagagtactttactgctctgaattctttcatgctatagatattgagcccctcttctgtgccaaccagctctactttcataaggattctagtctaacagaacttaagtatgatgttatttaaaaatatatacatcccagagcactgaaataattctatgatgtcccaagtggaattgctctaggtcatcttgacagaattatgggttccaggagatctgtgagaagactacacataggaaaatgtaccagttttcaaagcagaaaataatatgttctagaaagtagaaatcaacaataaagtattaatgaactagcatttattgagtgcttctatgattctgttctaagaactttacacttattaactcaatttaatcctcacaacaaacctatgaggtaggtactattattatattatttccatgttaaggatatgtaaagtgagacctagataagttatataattttcccaaggtgaaatagctaatgagtgatagagccaggaattacattcagatacgctggctccagattccacattggtaatatttatgtcattattaccattgagcttgtcaaaattctgtacttgattattaaacagcctgtgaacatttagaaagagatacagtggccacaggggtcatctttggctttctgagaacaagtcatatcctataaaactcagtttctattttgccagtaacttaattagttaataggaggattgcacaggacagagagtgtcctcctgcatttcagattttcccatggtttccttgcagacagaagtcatatggagtgatagataaaacataaagtttgtaatcagacaattctgggctcaaatcctgatttcaacactcgctaactatatgatttcaagcaagtgactttttccttcttgtacctccattatatcagttgtgaatggtgagaataactattctacaggattgtcatgaagattaaatggaatcaatgcatataaaatgcctgatagagtgcctggtactcattaatctcatcttacccaacctccaacaaagaaatagacagccttataaagtagtgaggtccccatcactagatgtacccaaatatgggctagattattatgtgccaaagatagtatagtaaacattgaaacactgatctctctccatgagcatgtggcctcaccactaagttctcatccaactgttaagattcccttaattcccagtcaattatgcaacaatgtgcctgttttgtacattgggaattgggattgactaatccactcagaacagcttaaacaacttatgcagcttgtagcttgtttcagagagagagagagagagagagagagaaaaggagagcaagagagtacgtgggcatgtgtgaaggtacctttaaaatggcaattatagtgtgtgggaaagtcaccagtggcttctaattatgtgaccccttctttaatttttgctgtcaccactcttttaacttttcttccaaaaaatccagataagactctgttctttttcttcgtattatctatactgtcagtctctgctcctctgtgtttcattgaatttttattttagtttttgatgtgttttattattttcttcgtgatataattatttgggaaattattttgatgctttgaggggatttttttctctttgactatttactgtggaaaggagcagatccgcttttcctgcaccctctgtcctattgtgccagtctggccatgttctgttgtcccttgtgtcataactgttctttattcctgttgctttcaccatattcaaggggatcagaactaaacaacgtgtaatgatgttgggcagaagacttctgttcagggaagtttctgcatttggacaatttcttcttgcactgaagggtcagacttggaggatgagctatttgggacagcttataaatccaataatagcaacagagatggggctggagcagaaagaagaaggggatttgaaaccagaactcctgagtacttaactttactctgtctcttaactaacttttctaaccattggccagttctttaactttgtccttattttcctcagtgtcaaatcaggctgatgatagaagtcatctcaagaggctttgggagagaaccacctgaggtagtggggaacagtggagtatggggttaagagcatgggtgctagggccagactagaaggcaatctcctttcgcccatgagctatatgaccttgggcaaactttctgtgcttataattatgcccttgtttgcaaaatgagaatgacagtgtatctacaaggaagggaagttgtgagggttaaatgagacaatgcagatgtagtacctggcacatagtaggtacttagtgaatgttggctattaatactattactatatatgcagtgttactaataattcattcagtacttttttatttagaggcaatatagcacattgtaaacaaaagcagagattttagagctggacagcctgaacccaaagccaagctctgccatttagtagcttttattcctggaaaaatttctgttttttcttccaatttttattttagctttagggggtgcatattcaaatttgttacgtaggtaaattgcatgttgccgggttttggtacacaaatgatttcatcacgcaggtaatgaacatagtaccaataggtggttttttattcccaccctcctcccaccttccaccctcaagtaaaccccagtgtctgttgtttccttctttgtgtccctgtgtactcaatatttagctccctcttgtaagcgagaacatgcggtatttggttttctgttcctgtgttaatttgcttaggataatggcctccagttccatccatgttgttgcaaaaggcatgatttcatttattttgatggctttgtggcattttatggtgtatatgtaccacattttctttatccagtctatcattgatcatcatttaggctgactccgtgtatttgctactgtgaaaagtgctgcagtgaacatacgcgtgcatgtgtctttgtggtagaacgatttatattcctttgggtacatacccgataatgggattgctgggtcaaaaggtagttcttttttaagttatttaagaaatatccaaactgctttctatcatggctgtactaatttacattcccaccagcagtgtataagcattctattcctgagaaagcttcttagctgctctatgtctatagttcctcatcagatggggttataacagtacctacattggaggattatttaggttaataaatgcagagcatttaggacagtacatggtacataatatatgctatttaaggggtcactgttgctattattgttgttcttattattttgatgtaattattaagcatgcattctaggatgctggaatatagtagtgagcgaaataaatccagtccaaaccccatgtaccttccctaggatctggagagaaaaggctagagaagagtaactagggtcccctctataaaggggcagggaggaccttatttacaaacaagtgaagcaggctacaatcctgaacagttacattccccagattgcagcatctgtcatttgtagagaatatcctgcaatgtcttactaaggaggaactagctcccttaatgtctcccaattcagacgagcacaaggaaaaaggaggaaggctggcattttattggaaatgataaacttcattaggcaggaaagttgtgatgatccaaatagcatctgttttgagcacctgctcaccgtgtccctgtgaaggcactcagactaccattaacaagtggcatatgggcagcctggttccaacaagaccacaggcaaccagggttcaagaggactttgtccccttgccatgtgcagaggacaaccagaggaaactctggggctttgtcagctgctcttctctggacaatccctaagtgaagcaagaccaaagaagatagagtgctgggcacagcctttaatgggcaggcaaactaaaagctgtgagcagcatggtggctaagtgccaagtgtgtggtatgtcagggccttcacaattggtgtcagaatttggagaaggggagccacatcagcttgagcagtcagagaaagtttatttcaggaataagaatgtgtaagtttgacctcgaaggctaagattggaataggaagcatagttgggccagagagcagctattagtgtgaccccaaatatatatctgttattttggtgacaaataccaccctgtcctgaaaggatgtatagaatttccagggacagtggggcagctatgtaaattgaaaaaatattcagagttacccttgctttgacttatttttactcacaatatttaaattatttggaaagtttaaatgagctaaaggaggtagtgagatgtttttcctttaagtttatcaaaagagggttttaaggactatgaaacactggcccaggagcaagaaagctcagggctgtatttggtggacaagtctggcctcatgtcctggaaatgacatgtttatattagagctttatagctattttacagagtaaggataactgtcttcatttcttagttgaggaaattggggctcagagaggttaactggcttgtccgtaaccatacagctggtaggttaggcagcaaggcatcaaactcagggcttcagactctacatcatgctctttcttttgttccatgctgcttactgcttatagtcttagctactctttctgattggagttcctcaactagtaggtcattcttaattattcctatcacatctttacatttggcttatgacaaatctagcgcctgaaaactcacatttaaccctctgggggaccagggagaacaggcaaagggataattttagtaacacatctctctagccctgtttccccaccacagaagcagaaattctctctagcttcttgtcatccttacatatctaaagaaacaataggagattcaattgatgcttttaatgtagctccaagatcatgcatattctttctatttttgggaactagcaaatgtgttgaaagctctcaatgactatgacacaccaactcggaatgggggcggagcggaaggaggctgcggactgaagttagcaacaaggaagttgaggctgcctgttttaggcaatgtggtccggtgagaatgtgtggttcagatctggctttccaggtttgtatgtattatattatgtatggtaaggcacaattcaaacctttctgagatcgagataaattacattcatacattctgcctagcttatcctgcttttgtacttagattagcctgatagggcccactttttatacatgtgtctcaaaaagtgttcctgagaattgtggaactcagtgtatgggaatcactctatccttttggccaggattgagcttgtgcacactgaacatggtaaaaggaacccaggttctgaaataggcttggggcaacattggccctctctgtatagctgaactcttcctctcctgtgaacttgatcctggggacaaccaatagatcagaatccatctatattcttttcttatttatatgaacaatcattatgggaggaaaaaagtaacatgattgttattttttcaaaagcaattcaacgacatctgtattttccagcctgggcctttgaggttgacagagctatgctgggaaaccttgctatgctgggaatcctgcaaggtagcctttcccagcccaactgaaaatctcagtataccgcacaatgtgaagagttaggattgggaatgtgagtgggcaaaagaagatccttcatagggagcacacagctgagaagtgagtcaagttaggcaattcagtagaatggaaatggtttaattgaactgtaaaatgctaataaaaattaatgagcatttctgactctgtccagctgactgaaagagcagataaagcagagaggagggagagctggcccgaagatatctgtcaggacaggactcataggggccttcctcaacctgactcagccataccacatctcccagcagtggatgtgttctcagaggaggctgagggcagcgccaagaggaggaggggctgaaaggccactccaagatatttataagatctgacattccataggcctatatgtcatttcttccatccctctattttcctttttaacttatgaaatatttgacattcaaaaagatataaaaataatataatgagtacccacgtgtttactatccgcattaagaaataattcattacaaatagttttccttcccaccctctcttctgcttctttttcttccccttcctctcttgcccctccccgttttctgctctgtactgtctggaacgtggcatatatcattgtcacttatttctttataattttctacatacatatgtatctttaaacattatgtggcatttttttgtatgtttttcaaggtaacagatacagatgaggtaaaactatatagaaaggaaaccatggaaatgatgaacataggatttaggatggaggatgccttggagttgtaactttgggattggtggcagattcaccagtactttatattattaaaataagtaagtaaatgaataaatagagaaataaaaatgccatgcatggaccaattatgagtgtctcatggactagggttaggattaatccaattttgtgtctatgagagcaaaacaacaataacaaataggcgacatactgtttgtatccatctacaacttctgtttttctccataagatttgtgacattcatctgtgttgatatgtgaacttctttatttaattttacctccatttctcttggcagactgggccttttctaaaaatccccagagtgctaagtgttagaccccccctaggtaatcctttgccagcagtctgtggcctcctagctactcttactactcagtccccctctgatgttcaggtctcactggcctgcacagatatttgaacacactccaggcaaccagccagctcatttcatacctctagtgggcttgctgatgttttcgaaaaggagaagcccttgctagccgtgtttatgtggcttactgtttcctacctcccatcagcagacttgcacacacgtccaaggattgattctggtgtctgaaatgatctttcgaggtgagacagaggctttttctttgggcatctagttaaccaacctgtcagtgtcagactactagtataacctggccaaatttagaacaaaccaacccccattggtacttcaaaacggtgacagtgttagcattctgctgtgcccctgtgccaactcttctagtactcgccgtgcacataccttcaagaaacctcttccttcccatctaggacctaatccggagagacatcctgtactacaaaggccgcattgacatggataaatatgaggtagttgacattgaggatggcagagatgatgacttcaatgtcagcatgaagaatgcctttaagcttcacaacaaggagactgaggagatacatctgttctttgccaagaagctggaggaaaaaatacgctggctcagggctttcagagaagagaggaaaatggtacaggaagatgaaaaaattggtaagtgacctgagagtagaaagaagaacatggctatgaagaacataggaggtttgaattggtttccattttcttggagtcagagggaagatttctgttgcaaactgacttaagctactttggtggttccttattattaggttctttttggtaagtaccaatagcttccattagtcagtggtaggtttgaactataggttgtcctcccctactagctaagaatatcacactgaaagccagcctcaggcttgattctcccaaacatacatttattagcaaataaacaaaaatcagttatacaacctgttctgtaatcttcataaagcctgagctctctgtcattaggtatatagtttgtactcctgattaggatacttcagatgttaactaaatccccctagactgtagattcaaataatatgcacatacacttcacactttctgtgtggaagtatttaaagtaaattatagaaaatataacaggacttaaaaccatgaccattttcatgatttcaaatcacactgaaacatacttttttgccttacaataagttgtttctcttttccagtggggatatagatagtagagatatttttcatgttgcttcccaactgtgggatttagacgccattggctatagctttgtgacttataaagtactgtctggtctcttgctcatggtcctgcctttctgtcataaaaaataccaagcaaccagacttgttaattccctgagaagacatacagtttctgtctttgccctattgcttatgggagtgaaattgtactttagaaggcctgaaagctcaagtttatggaaattgtctctagaaaaatgggcctactcattgaatcctggtgcaaaagggttctcttatccttccatgtgggcgattgaaattatccagaggtaagaaaggatggtcagaaagacaaatctaactccagtcttctcctcagaacttgggtagagtgcaaattaataactcactttgagtctcattggaatcagactgctttcagtatgtggacactccattgggacatgatgtggagtggcatataaatgttgctggctacttctctcaatagcaagcagcagcagccactgaccttgcctaggctgttagagttattaaaggaatggtcttagtgttcagaccctgaatcaattagaaggcccctgccattcccattggctctaacacaatgtctcccacacaatgccctaataaacctgtgactttatctgcttctaatagaaaagcttctagaaattactttctgaacaggcatatgttcatctttaaaaatgttgaggttttttttttttggtttgataataacagtaaatcacttccattgtaggaaatttagggaaaaagcaacagaaaagtacaagaaaaaaaaaaaacacatgaacatactcagtaataactttcataaacattttgatatatatttccagccttttttatgtgtctaattagaaaaatcaaggtgactgaatcttttttctttctctccccatacctgcctctctatagtggatagatataattttgtatcctcattttcactcatcattatatcattagcatttctatcagatcacttcatatttttaatcattattttatgagggtcatatagttttatcatagcttttttaaacttttactttttaattataaaattaatgcatgaccattataaccatttaaacaaatatggaaatatataaagaaaacttagcattccttccccttctctgtcacttccatactgaatgaaataaccagtgttaacagtgcagtatgcatctttccatacttatctcatgtccatataaacatatacaaacataatacttttatatttacaaaaattatattatatatattaccttgtaggttgcttttttaaacttaatttatcataagtaactccccagataaataatatagaatctaactataaccccttgtatcagttagggttcaaccaaagaggcataacctgtaggagatatatcataccactgctgaaaattgcattacaaggaattggcttatgtgattgtgaatgttgactaagtggctcagaattccatagagcaggcagtcagaaatggaggatcacaggcaggctcaaacccatggacataggccaaagctgtcatctacaggcagtcaggaagagaagctcatgagaaggatgaagtggcacagacatgggctaaagctgtggtgcacaggtagaatttctgccctttctgtgtgagacctaggctctacttttaaggtcttgcaacagattcagtcaggtccatccagattatctaggatattgtcccttatataaagtcaactgattagggcctgtattagcccatgttcacagtgctataaatacctgagactgggtaatttatgaagaaaagaggtttaattgactcacagttctgcaggcttaacaggaagcatcactgggaggcctcaggaaatttagaatcatagtagaaggcaaaggggaagcaagcatcttcttcacatagtggcaggagagagagagagcaagagggaagtgccacatacttttaaaccatcagatctcgtgagaactcacccactatcatgagaacagcatgggagaaattccccccatgatccaatcacctcccactaggcccctcccccaacacatggggattaccattccacatgagatttgggtggggacacagagccaaaccgtatcaggggctttgattatatctgtaaaataccttcatggcaacacctacattagtgaggactacagtctagtcgaatgggcacatcaataaattcatcacacttttcttataaacagctgtataacattccataatattatgtaataaccacagtcatctcttggtatgcacgggatattggttccaggactcccgtgcatatcaaaatccatggatgctcaaatcccttatataaaatgatatagtatttacatataacctatgtacatcctccatatactttcaatcatttctagattatttataatacctaacacaatgtaaatgctatgtaaataattgttatactgtattgtttagggaataaaaacaaggcaaaaatccatatgtgttcagtaaagaagcaaccagccgcttttttctgcatatttttgatccacagttgattgaatccagatgtggaacccatggttacagagggctgactgttcgttttttgctagacattcattttatatttagctttatttcccactacagatattgctgcaataaatatccatgtacgtatctgattgttacttactgatgcttttattcctgtaggatctgtaccctaaagtggaatgactgaatgttaggatgtgaacagttttaatacatacttgcatattaaattctgaaagatttgtagaatctatactcctagcataattttatgagtacccacttccgcatagcctcaccagcactggatagtatctatttgtttcagtttgccatttctcaactagtaaattgaaaaaaagtgttggaaccttttttttttcatatgcttaatggctattttcatttcttttgtgaattgcctcataccctttactcattcttttaacataaatttggaaggactctatattgttgatgtgacactttgtcagtcacgaatttcacgttttcaccagtctgttttttgtcttttgagtttgtttatattgcctacttctataaatatttaaatttttactttgaaaaatgtatctattattccttttttggcccctagtttcatcttgcttaagatctcttgccatccaaactataaaatttcctgattaaaaatatatttttggtttatttttagaacagtaatccatccggaatttacatttttatatgatgtgagaaaggggacctcatttttttcttcaaggtggatagtcagttgcatctgcatcatttattaaataaatcatttattttccacacagtttaaatgccatttttcatatatagtaactctgcatatatacttagatgtgtttttaaactttctattctgttccactcttctgtttgtcatttcttgtatcaagactatgctgtttcaattacagtagattttgagaaagatttaatgcctggtacaatcaattcttattcactcttatcattgcttcttagcagttcttagatgtttattctttgatatgaatatcaaatttatttattctaggtttaaaaacactgccgtaaaaactggcatagaaagcccatttggattctgattggcattatattaaattttttaatatgtaacggcttggcattgttattaagttttcacatttaagacaaggctctgctctcctttcatcaaaatcttgttctgtatgcttcaggaaaatggtagagttttctttagattctgtacatttctgcctctttgtacattacttttgataatttctatttttctgggaaattgttcatttcctctggatttttaatttaatgctatatatctacacataatattttctaattatcatatcttccataattgtagttatctctcttcttttgggttcataatatttcatatatttttattttctcactttaatcttttaatcaggcttatcagggagtattgatcttttttatgtatatataatcattatacatatttttaaggtacatgtgatattttgatacctgtatacaatgtgtaatgatcaaatcagggtaattgcgatattcatcacctcaaatgctcatcttttctttgtgttgggaacattccaaatattttttttagctattttgagatatacaataaattattattaactctaatttccctactgtcctatcacaaactaaatcttattccttctaactgtgtttttgtacctattaaccagcccctctccattgacctgagcctttctttctgagccactgataatcaccattctactctctatctttatgaaatccacctttcagctcccatgtatgagggaaaataatcttatttcacttaacataatatcctccagttccatccatgtttctgcagatgacaggatttcatttttttatggctgaataatataacatcgtgtatatatgccacatttcctttatacattaatccactgatgggcatttaggttgatttcatattttggttattgtgaataatgctgtgataaacatgagagcatagatatttcctcggtatattgatatcctttcttttggatacatacccagcagtggcattgctggattatatagtagttctatttttaatttttttaggaacttttctactgtttttctataatggctgtactaatttacatttggtcgtttcaaagaacgtgtttttggtttgtttatcccttctgcagtttatttctgtttcttcttaattttcacttttatttccttctttttcctactttcaggatttaaggaatattttagatcctttccactctttcattgactgaatacttactttgtttattttgatttttacaaaatcagaaaatcattttagacatgggagggtgtatgtgtcgaggaatttgtccatttcttctagattttctagtttatttgcgtagaggtgtttatagtattctctgatggtagtttgtatttctgtgggatcagtggtgatatcccctttatcattttttattgtgtctatttgattcttctctcttttcttctttattagtcttgctagtggtctatcaattttgttgttcttttcaaaaaaccagctcctggattcattgattttttgaagggttttttgtgtctctatttccttcagttctgctctgatcttagttatttcttgcattctgctaccttttgaatgtatttgctcttgcttctctagttcttttaattgtgatgttagggtgtcaatttaagatctttcctgctttctcttgtgggcatttagtgctataaatttccctctacacactgctttgaatgtgtcccagagattctggtatgttgtgtctttgttctcattggtttcaaagaacatctttatttctgccttcatttcgttatgtacccagtagtcattcaggagcaggttgttcagtttccatgtagttgagcggttttgagtgagtttcttaatcctgagttctagtttgatttcactgtggtctgagagacagtttgttataatttctgttcttttacatttgctgaggagtgctttactatgtggtcaattttggaataggtgtggtgctgagaagaatgtatattctgttgatttggggtggagagttctgtagatgtctattaggtctgcttggtgcagagctgagttcaattcctggatatccttgttaactttttgtctcgttgatctgtctaatgttgacagtggggtgttaaagtctcccattattattgtgtgggagtctaagtctctttgtagatctctaaggacttgttttatgaatctgggtactcctgtattgggtgcatatatatttaggagagttagctcttcttgttgaattgatgcccttaccattatgtaatggccttctttgtctcttttgatctttgttggtttaaagtctgttttaaccaagactaggattgcaacccctgcctttttttgttttccatttgcttggtagatcttcctccatccctttattttgagcctatgtgtgtctctgcatgtgagatgggtttcctgaatacagcacactgatgggtcttgactctttatccaatgtgccagtctgtgtcttttagttggagcatttagccaatttacatttaaggttagtattgttatgtgtgaatctgatcctgtcattatgatcttagctggttattttgctcgttagttgatgcagtttcttcctagcctcgatggtctttacaatttggcgtgcttttgcagtggctggtacaggttgttcctttctgtgtttagtgcttccttcaggagctcttttagggcaggcctgctggtgacaaaatctctcagcatttgcttgtctgtaaaggattttatttctccttcacttatgaagcttagtttggctggatatgaaattctgggttgaaaattattttctttaagaatgttcaatattgacccccactctcttctggcttgtagagtttctgccgagagatccgctgttagtctgatgggcttccttttgtgggtgacccgacctttctctctggttgcccttaacattttttccttcatttcaactttggtgaatctgacaattatgtgtcttggagttgctcttttcgaggaatatctttgtggtgttctctgtatttcctgaatttgaatgttgacctgccttgctagattggggaagttctcctggatactatcctgcagagtgttttccaacttggttccgttctccctgtcactttcaggtacaccaatcagacatagatttggtcttttcacatagtcccatatttcttggaggctttgttcgtttacaggctctaaaattgaggcaataattaatagcctactaaccaaaaaaagtccaggaccagacggattcacagccaaattctaccagaggtacaaggaggagctggtaccattccttctgaaactattccaatcaatagaaaaagagggaatcctccctaactcattttatgaggcaagcatcatcctgataccaaagcctggcagagacaccacaaaaaaagagaattttagaccaatatccctgatgaacattgatgcaaaaatcctcaataaaatactggcaaaccgaatccagcagcacatcaaaaagcttatccaccatgatcaagtgggcttcatccctgggttgcaaggctggttcaacatatgcaaatcaataaatgtaatccagcatataaacagaaccaatgacaaaaaccacatgattatctcaatagatgcagaaaaggcctttgacaaaattcaacaacccttcatgctaaaaactctcaataaattacatactgatgggacgtatttcaaaataataagagctgtctatgacaaacccacagccgatatcataccgaatgggcaaaaactggaagcattccctttgaaaactggcacaagacagggatgccctctgtcaccattcctattcaacatagtgttggaagttctggccagggcaatcaggcaggggaaggaaataaagggtattcaattaggaaaagaggaagtcaaattgtccctgtttgcagatgacatgattatatatctagaaaaccccatcgtctcaggccaaaatctccttaaactgataagcaacttcagcaaagtctcaggatacaaaatcaatgtgcaaaaatcacaagcattcttatacaccaataatagacaaacagagagccaaatcatgagtgaactcccattcacaattgcttcaaagagaataaaatacctaggaatccaacttacaagggacgtgaaggaactcttcaaggacaactacaaaccactgctcaatgaaataaaagaggatacaaacaagtggaagaacattccatgctcatgggtaggaagaatcaatattgtgaaaatggccatactgcccaaggtaatttatagattcaatgccatccccatcaagctaccaatgactttcttcacataattggaaaaaactactttaaagttcatatggaaccaaaaaagagcccgcattgccaagtcaatcctaagccaaaagaacaaagctggagctatcacgctacctgacttcaaactatactacaaggctacagtaaccaaaacagcatgatagtggtaccaaaacagagatataaaccaatggaacagaacagagccctcagaaataatgatgcatatctacaaccatctgatctttgacaaacctgagaaaaacaagcaatggggaaacaattccctatttaataaatggtgctgggaaaactggctagccatatggagaaagctgaaactggatcccttccttacaccttatacaaaaattaattcaagatggattaaagacttaaatgttagacctaaaaccataaaaaccccagaagaaaacctaggcagtatcattcgggacatacgcatgggcaaggacttcatgtctaaaacactaaaagcaatggcaacaaaagccaaaattgacaaatgagatctaatgaaactaaagagcttctgcacagcaaaagaaactaccatcagagtgaacaggcaacctacagaatgggagaaaatttttgcaatctactcatctgacaaaggcctaatatccagaatctacaatgaactcaaacaaatttacaagaaaaaaacaaacaaccccatcaacaagtgggtgaaggatatgaacagacacttctcaaaagaagacatttatgcagccaaaagacacatgaaaaaatgctcatcatcactggccatcagagaaatgcagatcaaaacgacaatgaggtaccatctcactccagttggaatggcgatcattaaaaagtcaggaaacaacaggtggtggagaggatgtggagaaataggaacacttttacactgttggtgggactgtaaactagttcaaccattgtggaagtcagtgtggtgattcctcagggatctagaactagaaatcccatttgacccagccatcccattactgggtatatacccaaagggttataaatcatgctactataaagacacatgcacacgtatgtttattgcggcactattcacaatagcaaagacttggaaccaacccaaatgtccaacaatgatagactggattaagaaaatgtggcacatatgcaccatggaatactatgcagccataagaaacgatgagttcatgtcctttgtaggaacatggatgaagctggaaaccatcattctcagcaaactatctcaaggacaaaaaaccaaacgccgcacgttctcgctcataggtaggaattgaacaatgagaacacatggacacaggaaggggaacatcacacactggggcctgttgtggggttgggggaatggagagggaaagcattaggagatatacctaatgttaaatgacgagttaatgggtgcagcacaccaacatggcacatgtatacatatgtaacaaacctgtacattgtgcacatgtgccctaaaacttaaagtatattaaaaaaagtgaaaaaaaaatcattttagagtatattttcctttgaataaagtctcaactgtatctcagaggttttaatataaaatttcctttttatttatttttagatattttataacttcagttatggtttccttttgatccagggtttattcagaagactattacactgggtacagtggctcattcctgtaatcctagcattttgggaggctgaggtgggaggatcgtttgagcccaggaattcaacaccagcctggtaaacacagggagacctcgtgtctacaaaaaataacaattaaaaaacaattagccaggtgtggtggcatgagcctgtggccccagatactcaggaggctaaggttggaggattgcttaagcttgagagatcaaggctgcagtgagccatgatcatgatcatgccactacactccagcctgagtgacaaagcaaaaccttgcctccaaaaaaaaaaaaaataataataataatagaaggcgattccttccaatatttcagattaggattctagtaatattatgatgtctgttttttgttaagtgagctgtcctttctgttgtgaagcttgtcagattttttttttatcctgaagtttgggaattatactagtcaatatgtagatgtgcatctatgtatgctcatcctgcctgggacttagcaagaccttttattctttccacagtaagtatatcctttttttccccttaaccgagtgttttgttacttatttgttactattttccatttgattttttcctccttcttaaacttttataatctatatatacatttgctgtttgaattatcttttgcctcattatgtccttttctttataattttgcttttggttacaaaatattttttccctatgtcatgctttatttaacgattctccattaacagactcttagcccatgttcataattctttttttggctctctattctgtgttgtgcattttgtagctaagtttttgttcaagtttgtgacaaatttccttagtgaaattcctagaaattactgggttaaagggaatgattttttttttttttgtatttcaagattttttatatgtcttagcaaatctttcttacagaaaagtttactcatttatacactcagtaagggtgtgtgtttctcatttaaaaaatcatatatttttcttttttaggctttgaaatttctgaaaaccagaagaggcaggctgcaatgactgtgagaaaagtccctaagcaaaaaggtaaagctgccccactcagtctctgtgaaagactatggaatcataagctatatgcttacatattcttaggcccatttctgtgctgaggtttacttgggggtggtggaggagtatccaggtccctaggtgtccttgatgacaggtagcaaatggttttaaatgcttaaggctaaggagtgaatagtatagggtattggtatccaaagatagctcattgagtatagcaaaaaatataacctctgttcctcttttttttttttttacttaaaaataagggaaactttactaacaatttatagatcaatggacaacatgatctttatttaataagtatagtttgggcatgatggctcacgcctgtaatcccagcactttgggaggccgaggcaggcggatcacaaggtcaggagattgagaccagcctggccaacttggtgaaaccccgcctctactaaaaatacaaaaatcagctgagtgcctgtagtcccagctactggggagattgaggcaggagaatcgcttgaacctgggaggcggaggttgcagtgagccgagattgtgccactgcactccagtctggcaacagagtgagactacatctcaaaaaaaaaaaaaaaaagtataaagatattgctcagctttctgtcaccggtctggaggcatgtgccaaatcaggagacccaaatcacaataaagaatctcaaactaagccaagacaaaagattcagatattctctttctcttaactacaagccaaagtacttaagaaaaaataccttgcaaatcaatttaaatctgaagttaagctttagtttctcttttctcatgaaccagaacaaaactatcatgctcagccaaacaaagggaaggaactaccttctgcttattggaatacctattcagtgtcagtcactttatatgttatttcatttcatctttatggtaatcctgagaagctggacactattaactctatttctcagatgaggtagctgagggtctttgagtgaagtaactgaacttaatttgacttgactcagagtccactgctttctcctctccatctcagggtcctgatgaagccccatgcttggaaagaagagtttggttttctgtcttgcctcaattactgacagctgcttctattactgatagccatgttcactgtccccaggtgtgggcaatcttaatgagaccttactttccccaggcctttccttctgctttctcagtgggctttgtggttctgaatgagtcaccatccaaaatgatcagattcaagtctcctgaaatttccagcagccatgtaaagcactattttttttccattgaagcttcttttgattgaggctgaatgcctgtgaacatctgatttccagttaagcagtgcacctagctccgctgactagacatgcctccccttcaactgcttattacttcttgctcttgggaggcccttattgtctcttttcctcatcatgcgaatgtgattccccttatatagggaatgaggccagccttaattagccaccaaaaagttgggagttaatttaaggtggggaattaactcctaaccttttgattgctataataacatgtgagagatggtgttagaaagcaatctggagttaatgtcagtaaggatatgacctgtattaacagaacttggtaagattttgctccagttcctcagacagaaatgtgagcagaaaagagcccagccaactgaagttttcaggctgcaaaagggatactgtcctaacagcttgtctcctggacgctctcaactcctgaactttctcactctgatttcctctacttcccccactgtattcttcagcgttctctagagggacagaactaataggagacatatatatatatatgagtttatatgagtttattaaggagtattaactcacacaatcgccaggtcccacaataggccatctgcaagctgaggagcaaggaagtcagtccgagtctcaaagctgaagaatttggagtctgatgtttgagggcaggaagcatccagcatggaagaaaggtgtaggcttggaggctaagccagtctagtgtttctaggttcttctgcctgctttttattctggccatgctggcagctgtttaaatggtgcccatccagattgagcatgggtctgcctctcccagtccactgactcaaatgttaatctctagcaacaccctcacagacacacccagcaacaatactttgcatccttcaatccagtcaagttgacactattaaccatcacatccaccatactgacctttatggtactcctttatccaagcctgggttcctcaagcatatctgagactgaattgtcttttcactgagaacacttcaaacaaaggaatatctataaagcaaccaggagttggttaaccagaagatagccctgctaactcatgccaagcattttggtcaaggtccttccccaccctatgtatctccaggccattccttttagggcctttcttgtctcccagtgtctaaatactgattcacttgaacagttttctttctttaacagcaattctaaagtcttcaaagaaattcatttagtttctgtctttctttctttttttttttttttttccctgagatggagtttcactctcatcgtgcaggctggagtgcaatggtgtgatcttagctcactgcaacctctgcctcctggtttcaagcgattctcctgcctcaccctcccgagtagctgggattacaggcacctgccaccacacccgactaatgtttgtatttttagtagagacggggtttcaccatgttggccaggctgatcttgaactcctgacctcaggtgatcccctcgcctcgtcctcccaaagttctgggattacagatgtgagccactgcgcccagcttcatttagtttcaaacctcccaggattactacaaatctcctcccttatttctatttttggtcttcaagactcctagtccagggctgtagtaactgatatgttttgagactcaagagtgccatacatgtggaagtggttctcaaatgtaggaattcagtagttacaatatgtacatgggaagagcaagaagggattatttaagataaccatgaaagctggcttccttgagcttttcaatgacccatcacaggaagtgaggggcattgttaagaggtctccaatgcggatgtcattagataggtaactactctaatgtccctttccaacaccatctgtaacactgggacattatcaactcagtctactgctctgggagagggggaacctggctgaaataacagtagagaataccagatctagctccaagaaaggccttttcacttgacctttgtctttcacgctgctttcattttaagtattgatatataacttcttgaaagttttatgctaattcctggtacataaacctaattaactagatcagtatagagctccccatggctatgagcacagactccatctccagaggccttggggccagcacaaaatcaaatgagtgccctagaatagcaaaaatgatctcgaaaaagaataaaatgtgagtaatcaatctacccagtttcaacactcattatatagttacagtaaccaagacagcgtaattttggcagaagggtggacatatcagatcaatgccacagaacccagaaataaatgtacacaaatatgcccaattgatttttaaatttattttgtattgatatgtaataattgtaaatctttactgagtacatgtgatattttgatatgcatacaatgtgtaatgatcaaattagggtaattaggatatctatcaccttaaacgtgtatcatttttttgtgttgggaacatttcaagtcttctgttttatgtattttgaaatatgcaataaattattgttaactactgttaccctgctgtgctactgaacactagaacttattccatctatcaaactgtatttttgaatccattaaccaacctctcttcatttccctaacaccatccttccaagcctctagtaaccatcattgtactctctacctccatggaatccacttttttagctcctacatttgagtgagatcatttgatatttgtctttctgtgcctggcttatttcacttaacattatgagctccagttccatccatgttgctgaaaatgataggatttcattctttttgtggctgaataatattccactgtgtatgtatactacattctcttcatccattcatctattgacagatactttggttgattccatatcttggttattgtgaatagtgctgtgataaacataggagtgcaaatatctcttcaacgtactgatttcctttattttagatatatacccagaagagattgtgattataaaagtgtaacaacagggatccttgtgatgatggaaatgttctatatcttgactgtatcctgttataatgtcaatatcctggctgtgatattgtactattgtactattgttttgcaaaatgttaccattgggaaaactgggtaaagagtacacaggatctctattatttcttaaaactgcatgtgaatctgtaatgatttcaaataaatgcttttaaaaaaaatcaaattagtaacaaaattccctctctaatatctgcgtattgtctgttggcattcagtaccctcatacttctgacacttaccaccttgcaaaactagctcttagaaaagattctgatctttctcactgaagtgccagtggctgatgatggcttaaatgatactacttccaggcaaagggacttagtcatcaagcaaaggcaaaaaaagtaactgtaatgttggaatttcagaccctgagtagcagatgaggaaggtatttgggagcagcagagaagccttcctgacatgtctgaattatatgctgtatgtcttgtcctattctgctctgaatgtagatcaggattaaactttcactttaggcctccaggttcctggaatcctccattaatgtggattttgctttgatggttgcaaacctacctacaaatgttgagaaggtttttaatattagtatcatttaagctattccgtttgaaaagacacacacatattccgtcttccttgctccccatgaattataccttctggtagtaagtttactttctccttcacctactaatgtcaattctctattaagtgcaggttcatcactctcaacccaggacagaacactaaatcacttgcaccttatgcttttagaaaatttctcctagaaacctgtcctgaagtcaatagttcttaaccaggctcttttaaaacttccaggggggactggagaaggcgaaatagagtttgttgggttctttgcaggaccaacccctgcataagggattctggtgtcttggaaagagctctgaactgagtagtcaaagaatgtaggttctaacccttgctttgtcgctaacttaccatgtgaccttgggtataacatttcttttcagatatcagtgttctcacctgtaaaacagattatagcaataccccaaatttctttgatacctgactagatgtggaagtgtgtagggttgcaatagtagccatggtattccaaaatctgtttgaaagaggaattctccccttggatgatttgtaaaaccagttcacactctctaaaccagtctgccttgagttgtctgcccagagtggtcactgggtaatttgagaagccctttgttacataacttataccctttccctttgatctctcatctactctaggtgtcaactctgcccgctcagttcctccttcctacccaccaccgcaggacccgttaaaccacggccagtacctggtccccgacggcatcgctcagtcgcaggtctttgagttcaccgaacccaagcgcagccagtcaccattctggcaaaacttcagcaggttaacccccttcaaaaaatgatacctacagggaggcagataattttaaaataaagtaaataaaattatatttatagatggaccttttttcggagaagcactgttgaaatttatacacacacacacacacagagacccttgagtacacatacacacacacacacacagacacacacacacacacacacacacacacacacacagagagataaggaacaaaagtgttttctgttgttttggggaagtgaaatatgtggttggtaggaagaggtaccaatgacttccaaacatgtgattccgtcttaaaagttttccatttttaccctgtcccccttccctttgctttcagaagttgacatttctattcattgcttttcttgttaagataatctctttactcccctgtgagtgattcactgccttgtcattattacgatagatgtgtttgtattgttttttttctgatgatactgatgttgatgaatttttaattttatttgatgtggtagagttgggaggtttcagggttttttcccctcttttactttccattgaggaagggaatgagctcctttctcctctccttcagccaatcattatcaaatgttccttcagccctgcagttgccccaaataaccttttttcagcatcctctgtcctcagtcatgccagtctggacatgctctgttgtgccctgtgacaaaactgctcagtattcctattgcttttactgtgttttaggtactgtgaagggatcaaaaaaccaaacagaagcaagggagtatcagactatgatgatgctggagtggacttctgttcagggaacattttgcattcaggctgtttcttctatcactggggtttcccatgttgcagcacttctgggtcgttgcaattttgcatctaggagttagtttgatcgagttattctcttttttcaagtcacttttgttataggtctccccctaggcctgtctctcccttagcccaaaagatctgaactggaagcagaggttgagattctgcctcccaggagagggatttacctgccccctagtaccagataggtttagggcagtgatctctacagcaatcagttcagtgtcctggttgtccctgctcccatttacagatgtttgggcagcattgatagaagtatggaggggttcaagacagagcccacctgatcaagatcatcagctaccttcaaattattgacctggacagggtccaagtctgatagtaaccttttacaagaaagaacagggatgggaatggaaagagatagccttgatccacagtattgtacctgcattttctaccaccctaaaattgtgtgagacttctcccattgttaacagattgcatggacaatcttccctggcttctttctttccctctctctttcttctttctcctgccatcctagcacaggaggatttttggtattgatatagttaaagctgttctggcactcaaagaaggccgtgtttccaacatcctctcatcccaggacatttggggcaagtgagttaggggcccaggggcaattttccctctgaataacgtgtctgaggcagggatgctaccctcaggctcgcttttggccagctttttgcttgggaaaatctaacttctttcacaaggaggcaggcttcctatggatgttggagtacctgtttttcctccacacatagcccttttcatggatagaccttgaacaacaaaaagggtataagggaataaggatgaactctgctgtgaagagcaagccactgtagtgaggaatgtggagactgggagtctgtcctaaaccccatgggagaagacttcatcatgacaggacttcagcttaccaagcagcagccatagctgtgtggaggcttcagcatagctagcatgtttactgctctatgcctcctgatccagaccaggcattgcccagcctgggaatcttttctttgtgggaatcaaattacaagctatttaagtttatattccatcacaaccaagtcagacttgtattataagtcaaggatgagcctgatctggggagagggccggggctcgggactggccaccactgttcagcacatgacctaactacgtaagcctctttggcaagggtcctggtgcccagcacccaggctaaaatatcctgtctggcagagtgttttggtagctatgcaggcctcccttcagtgtacctctttttccaacttctcactcctccttactaggcttggccttgacatgcttcttcgagggttggcagcacaccgggaggggatgcttggacaagtttctgggcctacatttcttgactaggccctctcatttcctccctccttggggcttctgcccagggctccaggatcagggatattacttctcaacccgcacttctcctctactgaacccactggcatcacctgatgccactaatttgtgaacaacaagaaatcatttccccattggttggagtattccctcagcctatagcatcaaagcagaccagtggccaacagccccaaggggagcccaattaaatacctgggttcagtatcctaacctgttatgtcctgacagcaatggtaaccccagtaattctgtaatgttgtaatttccgcatggccctgagctcccttttcctcaactcagtgaggccaggatttgctctccaaaaggctttgctagtgtgttcaatgggacctgctgtggggagtcctaagacagacatctaattattctctctttttccccccctctctatgtgtatatttctaatggatctataagaacagcaacaagagagttctaacaattctagtgtgaagccaaatagtgatcttttagtgctttggggatggggtgggctggggtggatggatgggcaacagtgactttgattacccttgctgctctgcatttgccagtttattcttttgtttcttttatctgactgactctgtcaaacaagtgtcaaagttgtgtgttaaaaaatgtttaacaaaaaaaatgttgtaatgacacaaagccttatgaaaatatttatggagttcaataaaagaagtaaaaagac

SEQ ID NO: 4641 - DNA, 117131 bp, human
agagggatagggccagcaaggcagggatcgaacgagtgtctggcagccgggagcccagcgaagagagcgagcaagcttaggaaaacgagcgaagtaaagggagtaggggagactgagactgaccggtagccaggcaggcggacggacgcacgcccggacagactgagcaggcgccggagaaccactcacaggttccccccgcctttccctttgaaagctaggattttgcctttcccgtggcgcccgagagagaatgctggactctgccgacttcagcgcaagctaagatttctcagctagggacaaacgatcagcccaatcctgagaaggggggaaccaagcaccccgtccccatccccctcccctcccccgactaaactcgggcgccaaacccagcccttctctaaccaccctacttcctcctctcctttctagcatggtggctgtatggacagtctgacagaacagagactgacatctcccaatctgccggccccccacctggaacactacagtgttctgcattgcaccatgaccctggatgtgcaaactgtagtcgtttttgccgtgattgtagtcctcctgcttgtcaatgtcatactcatgtttttcctgggaacgcgctgaatggagtccagccacctgagctgtcgcgaactctcgctttgatttcatcccgagagccaccgagaaaaaaaaaaaatcacagacagagacagggaaagagagagaaagaacaagctttcttactcaggggggaaaacgttttgagcttcaacatggcctcgctgtgatatgtatgacgttggtatattatctctccctaaatcttttgtcgtgtcttgtcttttaagaatgcctgcgcgtatagttgcctattgcttgagtgaaattgttgatgaagaaatgctttctatttaagtgtgcatgcgtgtgtgcatttttaatctatgtggcgttcatggagcaagctctgcgtccttaaacagtggctttgctgtctgtggtgtcttaactcatttccttgaagactacctttaaactccatcagggaattttagtcaaaatttctctcttgccatcaggagtgcatttgggtttgtttgaggggaaaagggtttgtggaagagcatgatgaatatttgacatcataggaaagacagtctttgcagtggatatttagagggaaaataatcgatgcaaggaatggatttagggaaaatgcttctttagtgtctaaggagaagcaagaatttgggaagtgacacgggtgtgttgtgctggcagttggtgactgtgtcctttgaatctcaatttgctctccagggttcacaattttcaattttgaaagaagccacatttaaaacacttcttgaaccttaaagctttaagatatttaaaatgtcaatttccttggaatcatgaaatagtatgtgaaagcattctctgattttttgaactggcaagagaggactttgacaggagctatttgggctccctttcccaaagattgtacccctggatttgagtttggggattttgtttgtctcatcaaaaaaaaaaaaaaaccccacaagaaagaaaaaacagctctttatccaccttgggaataatagtatttggatatggctcctttgggataatctcgtttgcaatgatgttcttgaactacattttaaatgtaacttgataaggctgatgagaaagtggtgatgctattgtttgctcccgtttgttactttaagatcagaggtctctgtaattgaaacattcccataacaaactgaaagtctgtaatgtgctaaattaagagttatcaaattttggtgctaaatttgaccaccaaaacccaaaaacgtctagaaggaaagggatgagagcatggaaaacatgagctggaagcaacattccagtttgagatatgactgcttgtctgtatcagatggtggtggtggtttctgttgttattgctattgctattatttttatatttctgtttcctctgagaaagctcttggcagagccaggaaaaaaaatgtctcatgccagtctgtataatacttgtttttttgcgttttgattttctttctcccctgttaatgtaggcaggctttccccattccattgcttacctggcttgaaataatgccatttatggctcatgtattatagcagtgaatcaggacacatacacatctacacacatgctccccctccacccatgtgggtggctgttcatgtctgatgtgcaaatctgctggcattatgctgtcaagttccatgtccggttgttcagtctctttggaaatgattatgaaaggagaggggctgtgaagggggcctttgaaattgtcttggccacaggacccagagagtattatttaatggcgtcagagggtgttttgggcctcaaagcatgctatccttgacttggtgtgggtgagaagctgaggtttttgtgagattagtaccatggtgtaaacatgatctgggaggtttgctggcattggttcttattaattactctttggtccgtttgtggagaccccctggatggaactgagaacctatttctttgcaaagataatttagtgagtttttttccccccttagcttcattgtattatttaaagtaagcttatatcttttctgggcactttgttttgatacagtgttggagagtggggaatggctctatgctgggcagctgcagacctgtttttttgttttgttttgttttgttttttgttttttccattcagcagctgtttgaccttggacaatttttttcctcctcggtgggtttgggattcccagtaacattggcattttttgatggctccactaggtgacttccaagttcttgcattttatgattttatgacccctagacacttgaagttgtggggggtgggggggatgagctggaaagacaagtgaaaaggaaaagaaaatgttaatcaaagggtgatgggaggaggggaaggatatctggtactacagcctggataacaagtttaagcgaaggggttttttttgcctagttatttgggaaggaaactgggacagcaataagggaatgctttttgactttttttcccccaaggggagaaggggtctctgagactagtctttgatctaggtttatgacttaaatagtgtcacgaaatgccttctcctctgtgagcctgacagacctttggcagaaagcctctgggaatgtatgtgtgtgtgtagggtgtgtggcagtatgttcatgggggtgtgtgggggggagcacactcctgagtgtggatgcggggtgtggtggtaggaatgaagaaagacagtattgagttccacagttctgaatagcctccttgtgctaggacctataaggatttcacaaatgctgggatggatgggtatcacccatgccattcctcttttcaccacctaaaacccctcaggctaaggaggtgtcttgaatgagcccttccattagtaatttagctgttgaaatgggttagcgcttttaaaattgtctccaggcaaataaagggatgttgctagccagatggcaggccaccatctagcaaccagaagggaatttgagagtagagaacaaaaggtagcagtgtgactttttacttgtgtgaatcctaaaggtttggcatttctgcttcagacttgtgaggatatttttctctagcaaaaagagaaaagagtgggagaaaatgagaaatgcagcccagagaagcggaaccctatgcattttgacttgtcttcttttttccttcctcctctgccttctctcttaatctttctccttcttcctttcttcccacccctgacaccacctcctcctcccacctccccactgtaaatgggtgagaagtaaaaaagagaagaggacttttcctctctgatttgtcccaacttttcccaataaagctcctccattcccttccctcctctctggcccctttgagtagaggataagcttttgccatgtaggaggggcaaaatcccagcttagggattttcgctcctggatccccatcaaagaattaaagaaaatgccctctactggtatcctagcaacccctgtatcactgagcacccactgagctccagagcccaccctttaaaggcccaggcaccaataactctagaaaaaggggactagagcctagtgggacttggagagatgcttttggggagggaacaaagaaagaacagaatcccaatttcctgcaaatgcctcggaaacatgtccacagcagacatgtagagcctagcctcgtccagctatgagattatttattagaaaactcctggtttcaaattcctttctagtcagtcccatctccttaagattaactgtgccattttactgcctagctttagtgccagaagctctgccggtcctgaaaaaacaatttttttcaccctaacttttggctgcatcagggagggggtgaagtgatatcttggtgggaacaaactgaacagcattcttcttccattgagacagcctccatctgtcagaacctgcagtgtgcttgtgcagtgtgccccaattttgtctgtggcttggggaatcctgatcagcctagctttatagaatttgggaatttttctttctgtggttttggtgtagtagtttctgacgggggaggctggacaagttgaaagagcaagtttgataatggagctggtaaacagggcttggaccctggctcagagactctcacccaccggtgtgtgtgtgattcagctactagggagctgaaagatcccaaaaaggctgtaggtgaggtgctcttctgcccttgaggtaaggcccagattgagagcaaccagagggcacagtctggtggtttgaaggatggtaacaaagcatgtcttcctctttagcctttgtctgccatctcagtttctggtcccttgacctgcagagtgcttgctctgggcagggatataagaattgagccttttctcccaaaataactgcctcctcagaagacctcctacaaggcatctggatcttgctccagtggctttgccccaagaaatgggatggaggaggggaatcttggactctctagctcttatttccagctctgcaacttgttctaggccaactgagtctctggctttccaagaatccttgatgaaggtttagcttctccagtatctgctcagagtgtctccttctgtcttaggtggatctagctccatagagtatttagtttattgtactttgctctagcacgaaagtacaaagaggaaaaactagaaggggaagaacatagaggggagagaaggctcaggaagcagtccagtaatgacaatactaataactccttatcagtgcacgggcctatagcgtttatgaaggaatttcacatcctttctaacttgagcatcacatcagccttgtgaagtgggtagagatgattgtaattcccagtgttacagatgaggaaagtaaaggtcagcaagattgttgggatgggagtgggtctgcctttcaaatagagaggagagtcagagttggtcattcctaactagtgtgatgttgaatgtagggagggagggcctgacgtggtggctcacgcctgtaatcccagcactttgggaggctgaggccggtggatcacctgaggtcaggatttcgagaccagcctggccaacatggtgaaaccctgtctctactaaaaatacaaaaattagccgggcgtggtggcacacgcctgtagtccagctacttgggaggctgaggcaggagagtcacttgaacccaggaggcggaggatgcagtgagccgagatcatgccactgcactccagcctgggtgacagagcgagagtccgtcccaaaaaaaaagaaagaaaaggaaacaaaagaaagaaaggagatttgggagtcatccctgaagtcatactagcttcctcagctactcacatttttaataactttcatttgtatagcacttttgctcagaattttcattctataaaatgcctttttgtcttgaatatgcatcaaagagttctgtttagttttatgaaaactcactatttgggatcttcaaggtgagaggccagtgtgaattgctgaagcctaaaatacagaatgttttcaaggaactgtagttttaatacaattgttcttctctttgaagcacacttatttttctatatttctttaaaaatctgctgcctagaactgttcatgctactctaggtgccacctgactgagatcaagtgcaaaagaactttgttttgtctgtgaaatgtctaataatgcagccttctactgattctcaaccctcactgaacattcagatcacttgggaagcttttttttaaatacccatgccaggtcccctatctgaaagattctgatttaattttcatgggctagatcccagggagctttatttatttatttttttaatttaaagttccctaaggtgattcaaatgtgcagccagggttaagagttagccttttgagcatgtaggtccaaaccatttactgtctagtccagtcctctactctcttgtgaagttggccacttcagggttttttgaaccaaacttgctacattttatcttgacatgttggtccattattctagctttctgtggattttaaaattttttcttcatgctgtgctacaaattagcagtcccttctagcactgcatcagttaaattctatttgtttggttggactattgttctagcctttgggaggtttttattttttttcttcatgtcacacaacaggttagcagcctcttctagtgttgcattatttgaacaccaaataaatggcattcgagtcgttgattcaaagaaatgtttactatgatatgattaatgctagctcttctgtcacctcaccagagcccctcttggagttgggacttgttaatttttgtatgtatctggtcaaccagtgcagactgcacctggttgtgccagcatttatcctaccagggtgttaatgtgaataacatagcacgatagatttgttgtatgctttgtgggcatcaagatatgctaggttcatagcaagcatctgccaaactgatagccccatcagaaaaagcagtataagttacttggcctcttactcatggtaaatctggttgcaggctccagagcttcttgttttctttctgtgcctacaatgcaaatgtttctaaactgggttcagaacttggctgagggtcagtactacaactgtagtttctgtgtattactttctcctctttgaaaaagcaggacataatggatttagctttaaaacagaatatattttgtgctcaaagagttccggaaattctttgtgtatgtttctcttgttgttttgcttaattgtttccattaacccagtggttctcagcactggctgcacatcggaatcacctggaatattaagagtaacaacaattcctagaatctttgggagagatctgattgagttgatcatagtggtttcctggcatcaatatttttctaagagttccctgaggtgatgggaatgttcagccaggggtgagaatgactgctatggaatgcttcataggaaatgttagctcagcctgtctgacttatcacacatgtgactaggcaagcttcacagatggtgaaattttattctaggactgtgggagcctcgataagtcccaggggcttgtgctcactctaaaaaggaggaatcaaccctagggaatgagtagtctggagacctaattgtatttaaaataatcagctgtgagatggtttgaacacttcaggaataaaaaaaaagtcagttcctacacatttgctgtaatgatggggaagattctgctcatttgctagtgacctcaggcaaattacttctctcctctgaaatttggttttcttcatcagcaaaataaggataggtggatttgatgacttcaaagatttcttctagctccaacaatatgtgcttattttgtgattaatattaatgatcaacacgagtacagatattatttaaatctagcaggtaatccagagatccattttagcaggtttagaatacacagagtggttttaaggatagcagttttgccttcttaattatacttggcttaggtttcttttagaacaagtgaacttaggttgtattctttgagcacacactggccgccaagcaggaaaggagactgtatgaacacgcattggctgccaaacagggaaggaagtggtacagtgaattgagtagctagggtatgccagtttgggattctgtttattaaagagatatgtcatggataattgagaattgcctctcatagatataataccagtctcataggtctgaaaaagatggattgctttgacagctcagagccccttcctgcagtattttaagtagccattcacttggttaataatactacttctattaataagaatttcaacaaataaggtttcctatgtatttcatgggcttcttcctcaaacctaaaagtagttaagaaagtgaggctcataaagattaagcagcttactcagtgtcaaacaggtagtggtagtgactagtggtagtggtagttctagtggcctagaacctaggcgtcttgataccacatcctgcagtgcttctggtatagcctgcatagtggactctgtggtcaggatgcagtcatgactctgagaattaaaggggttttactgacatagagcagtattcaggaggaagctttgaagaaaggagcaaaaggggcaatgtggaggaagaaaaaaggtttagagagggatgtgttcaggccagtttttctcttgcccttatcactcttatgtgctagttccaggcccctgatgggaattggccattgatctttgagcaccaaggttgagtgttggtagcagagaagaaggaaagttgtacatgcatggcagaaggatagcatagggaaggcagacttgcagtaggagaaaaaacaagaaaaggccttaggagccctaggattaagccctggctctgtacctaccttgctgccagatcttgatcaaggcccttcccacctaggcgtcagcttccacgtcactaaaatgagagtggtttcagtagaagaactatgttctcaaatggaatgttagccagaagcttctatataaaacaggaaaaagcacagatggtctggttgaaatgggcatgggacaggtatggaggacagagtctaaagttccagggaaccatcttgcgtatgcagattttggtcattaggggaactggaattagaagagtggagatggctctgccaagcccagccatagtgcttggggagatagagcatccttggatagagttgtgtgatgggggtgggtatttcatttaagtggccaggatttacagagaatcacttaggggcagatattaaagtgcctagtacaacacactgcccccattcctttttttacaagtgagaaaactaaggcacaggaggggaaagggatgggtccaaggttgcagtgatagttctggaattctgattctttagatagggctcttgcctgctgtaacttgctacctcccctataggtttctggctctatgctcccttggctggatcagagacctgaatgctctttcaggtttggttggagaaagcaagctgacgagaggctgggagaacaagagctttatataacctcctggagagggagcaggcctgttagtagtccttggagttccagggagtaggatggggatgaggggaacacagagtctcctgaaggccacattagctctcctgaggcagagcagtagatgcagccctgtgagtggccatctaccctcagggcccagaggaggccagcactgcacatccatagccagctctgggaatggctttggcagctgatttctccgcctgcctgccttcattagagaaaggaaagccatgtacctccgtgcccagctggctgcaggaaggatgtactaagagcccaccccccaccccctcagagtgtggtgcctaaaggcagtagctacttttagctgaacctcccacagcctctcctccacccactctctccctcctccctctgtgaattgtgcaggatggcaagaaggctggggagtaggtgccttggcattgggatagaggcagaggaggagctaggcatctctaggaggggctctgataagccctgcatggcaggagggcttagaacaaaagcaaaatgatgagattgctttgtgcttaggacccaaagggagttgagggatttattaatttcctttggagcatgcaaccagctgaagttcatgtcttgtaaatttagactgaactgcatgggaagacttacactctacttggattaagaggaaagcaactggggctagtgggtactcacttgattcttaactactcctcttgaacagtcttacacttttcagtggattttgtacatcgtctcacttgattttctctgtggccctgtgaagtgggtagggcagagattatctccatttcacaggtgagaaaaagaatgttcaaagacttattgtcacatagctgcttctagcctggccttctgggcttcagctctggaagttacagtgccacttaaagtcactgcagacagctatattttctagaaaaataggtgctggagctgtcctgattctaatctcctcattgtggaagctggggaactaggtccagagaagaaaaggacttgccccaggaaatgtagtacatctgtagtagtgctggaattagaacattgccatgcaaggatgtgaattcctggacctgcaagatgtgcaagccactgtggtctttcaagggttgtttgggaaacctgtgtggtgtgatggaaagcaaagtgtcacagaactaggagtttgttatttttcagttcaggcagaactgtgggtgactgccccagtggaggcctgacactcagtaagccctctataaagatttggttgaatggaagatgtacacatgagtaaaaaggaggtgcaaatgtgaagtcagttgctgtgtgaccttgaacaaatcccattgtctctgtccctcatttctgtctgtcatttttggaggactctttttacttctctcccttggaagaagaaaggccctgtgacccggcccatgtcttgggtgcttggtggaaagctgttttgttttctgatttttgttgttgttgttgtttttaaataagctttcttttatttatcccaagctccatttcccatgcagtcacacactcgctgctatgaagagcagactaactttgtctctcctcatctcctgcaaagttaaaagaggaacttggaagaaagccaaaattaattgtgtttttatttagcaccttcttaagtccatcaagccataaaccacttaggcacatggcaattaaaaaacaattcttggcccctagatccttggctaggatttgtgatggattactgggttttcatgatatgatcaaaaactgttttagaaattgcaggttcttgcccaatgagctgtgtagaacaaatcaacactcttcacttatactcgcattattttgtttggaaacatctcactgatctgggggcaggacaagaagataaagactactgtatagccttctgctcctgacacatgttcttttctccattacactattaggtggccaaagccaagattattttcccaattttatggctaaggaaattgaagctcagagaattgctttgattgactcaggtcagtactgcatcttaaagtcagtggtgagctaggaagaacatagtatatagcgttaggtattatcaactcaccagtaccaagtgtctctaggcaagccatttaagattccctctgtagtttgcttctgtctaagtattttgttgttgttgtttgtttattttttgagatggagtcttgctctgtctcccaggctggagtgcagtggtacaatctcagctcactgcaacctccgcctcccaggttcaagcaattctcctgcacgccaccatgcccagctaatttttgtatttctagtagagacggggttttgccatggtggccaggctagtcttgaattcctgacctcaagtgatccacccacctcagcctcccaaaatgctgggattacaggagtgagccaccacacctggctctaagcatttttacaaaagttaatcaagatagaagaaagaagtaggcatatgctactggataattggataggttggcattgaaccattaattggtattttggtgcatctactggatctacaataaattcatctggatatcacattgtccagggatacatgagaggcctttcaaaatgaagaaaagtggccccagattctgtagtctttggtgacctacttagtttggacgctttctctctgtgggtttatctggccatgttcttaaagactgggccttgatcctaaaagcaggctctttaccattaccagtttctatggtcatcccaaaggatggggaagaatgatttggataaactacatgtcattttgcctgggctttggtggagattgtatgccattccttttactccagttggttcaggccactgggaaaatgagtgtggaatgacaagaatagggagacaaccaatagcttgctgagggttagagggggcctagctgggatgagacatctgcaggtgctaatccacgtgcacatatctacacactgattctttgtggtgttggggggagcaagcagagtttgtccatagtacttcagctgagaagtgactgggtaacagtgagaggaacccaagcattgagctcgttccttcagtgtacttctggggaaactgaggtctaaggagaggcaggaacttgcccagagtctcagaatttgtccgtgatctttgcctattctctctagtcagccaatggctaatttaccttacatttgtgaggctctttagatgaatgaggggtggctaagcctcttgggaaaagcacctgtgattaccacattcaggaagtgacagagatgaaatctgaacccaggtcttttgtcctgcttaagagcagattgacccagacttgaaggaaggctgttagaaacaaattgatggggaagaaaattggttcagctttgctgtctatccatgctctatgcccgtaccttcacatacacatacatgatagatcatatgtgatgcacacttacacatactcagacacatgggatgtatttgggacacacatgggacacacagctggaacatattttcacattaacacacttggaacacacattcagttaaacatgggaggaatattcacacttgcacattctcagcacaggcaggatacacacacaggaacacacatgagggatacttgtacgcatctgcatgtgtgaatgcacatggatgcatataaggcacaattgtgcacccacatacatatggggcatgctgagatgcactctcagatatactgttacccaggacatgcactcctatacctgagatacacactcctaaagactacttgggcaaacaacactccacacttgagtgttgagtcacacttgaacacacctatgggacatatccacatgctccacacagccatgtgggacatattttgatgcagaacacgtccttcccttagggccagccagctgtcactttttcctaagtgggcatgacagggaactggtcccagctggtgggcctccataagtttgctctggctctcctttaaccttgaaattagacttgagagggcagtatgctcagtaataaaatggatgttcaagatggcatgttttgtagcaggctctgtaaggtaaacagggttcagagcagagccctcagatgtgagttaacaggcagatgcagaagaatggaaaacacaaattgggattgatcaatgcagaaagcttgagcctgctccttcatcccccagttcacttacaaaccattgtggagtgatatggttatgaagcaatgtcaaagaaggcctaaagtcactggatattaaagtttatctttcttgggaatgaaataacagtctggactagagcaaagatatctaaattgtgggtgttagggtgtgaggggaagtggtaggatgcataagcgggagatccctttgggcagtggcccatcctctcctgggttagtggtggtctgagaccagcctcatccttaatgaccacaacctagcccctaggcacagcagcttgggtcatctggccccactaatgaatacctgctatttttagagttcctcaagctggaaaccaggtcatggtgtcctggggaagcctttgtggtccttggtacctaaggctgaagctggaaagacagggccctagattgggtctgagtgaagggtgggaagcagggggacacgtagctggggaataccaggctttcctgggagcagcatcctcagagcctcagttgggttactattaactataacagcctcatgcccatttctcagctttggctttgaggtcaagaaacatgagtttcagttgctactctgcctcttacagtgtgtctcagtcacgttcccctctgctgtctgagtcttacttgctttatttataaaacatccagtattgcccttagatgatggaaaggctcagctaggctaagagttgagaaaatgttttgaagatacacttttctccatgcataaagctgcatcatcattgtccctaagctggattcaattcctgccaacaattggacctgactcctattggagtagctgtagacagcaaaggccaaaaaaaaggagccaagagaagacaccctcatggagtcaggttggtcaaagtcatgctgagattacccccacatatacagatgcttttcaatgccaggtcagtcattctgggaaagaaaacagatttgcagcatttaggtggtcatgtagctttggctcctcaggaatctcctaggtaatgagagaaggggaggcatcaggagcagggatttcttcctaaactaggaaatgcaagaccaggtcacctgtacctgccacctgccagaggaggcagcctagagtgccagctctggctctaagagaatcctctttgtgtttgtgctcatggccattttatctggtttgctgagagggagaaggtcagaaactagactatgtagttcaagtttccccctgctgcagacattgtgggcaaagttctcctgaccctcagttttctggtctgtggaatgggcttaactgtagtctctcataagagttttaagtgcaagacttcattgtgacataggatgtgaaaagtgtcttgtaaaatgttgaacatgtgttcctgctgtttggattgttaagatttcatccaggttgtaattacacatagtttggaggtaattgagaaacttcactttatttctctacccctttcccataccgttcttttaaggcattattatatccattttacaaatggggatactgaggctcagagaaaagagaaacaagtctgaggtggcaggattaggtggtggtagattcaggactagaagccatgctttcagattcccaacccaatgtactctggccctgggctgccaccaatgaattccagtgctaaaggaatctgccagaggttacttaagtaaatatatataaagagttagatttttctctgacaagcagtacagggggttctctggggcacagctttacccagcactctccctgcttgcccaagagagacacgctgattgtcccttcatccctcctacagcagctcatgtcctgctgtctcctgcatgttggaagcagtgaagaattggagatgttaggctgttgtgagaagcaatccttctgccggtttaagccacttcaagacaataggaggattcttggaggcacaaaatccaccttggtcacccgcacctcctcacagttttttgggtacccctgacctgcctaaggggttggctgaaagggatctaaggaaatatatttgagggccttgatctctggaggattgtgctaatagttgagggataagattatggaaataatccaagaaccaaaactgggagtgtctctggagaccatttgggctgaatttcacctggcctcaatgaggacattaaaacccagctgggcttaccttttctcccttagtgtggttttcctttgtacaccacagattctcgtgttcagtcagatttcctggagtctttctagcttgcttgtttttgctattctgagcccagaagagggaaggggtgacacattgagtggagtggtgagaggaaagagatggaggaatctgatgagctcaggccttgaggggcaggcattggaggaaaagggcttttgtgtctctcttcatttgtattgctgctgatgcattattttcctatcttccactgattggctgtgggagcctaatccaatctgttgttatcttcacttttgctgctcaaacctccaaaatgactacagtattcattttgagggatgtcttctgtgggattggataagcagtggggcagggaagtggggtggggggaatgcggtgcttcaggaaaaatggggagaggaactttcttttcttcaaatttgagagcccagagaagtgaataggaaaaggttagctggcacagccctgccaagaagtagccatgcagtttcctaatctcttttgaccatagataccttatttttaaaattttatttttggataggaaatatattcacatgtttcaaaattcaaaaggtccaagagagtgcacagtgaaaagtctcccttccactccctgccctctgcagaggccaccaatgagtccttccagaaaaatgttatgtggatgtataaacaaatatgaatatattcctctttctcttttttatggtaatatacaacacatattgttctgtaccttgctatgctttggagattctttgatacttcattgaatttcaccttttggggatgtgaagatgtgctgtggaaagtagaggttaagagcactgattctagagggaaactgtctgggttcaggtttggattctggctctatgaacttcaacagttacttcattgtttttctgaactttggtttccttatctttaaactagggatcaaatgagttattatatgtaaaaacttagatttgtctctgacacatagtaaacattcaataaatgttagccattttttattattaggaaaaaaaccccactggaccagcgccagtagatctaggttttctcctggcctctgtgctcctgggatagctgggtaacttcctttgttcacaaattagtttccttacctttaaaatggaacaactcatccccactctgcttatccccaggatttctgggtgggtccagtgagctcatgaatatgaaggcaacttagcaattgtgatgttctgagcagatggaagaagtgcaacttaatattttcatagacactactttgggtggcttgaacccagtggtctgaactgggtggaaaaggcagtgtttttccttctgccagtggaacccaaaagccatccctgtactggtgttgtattttgagtgggagatagcccatggcaaaattttgaaatactcaggttttgtcttctgaccttttttattccaccccatccctctcctgacttccttgtttcattttttttggggggccaccccacccctgtcaaaacctgcttttagaagcaaagcagcagcatatgtcaaagatgacctcaactttccatttgaaataatttaatacagctggctcagagaggcgctggatctgcccaagttcatacagcaagtccagaatcaagctacacctagagctcattcttcccatcccagtttttattactgacatttgcattttagtgtgaatttgaatttgagattccttagcaaaaatcatctggtcgtgggggagattctggaagtatctttactaatccttcatactgaagtgttcttatcttttaatcttcagggtcagacctgtttgggaccctgagcagggagggaaagtcaggttctggttttagtactgaagggatgatgtctatagagcagtgggagagaagagcaccagaaaatgttgaaagcggtaacctccaaggtgagacttagggagaaaatattagttctttatatattaaattgttaatctcattgttatttaatttctattttgtggagtttttttttataaaacacatactacattaatatttaaatattgggataggtgtttcttgttttgttttttgtaaaataaattttattgtgtatatttgaggtttacaacatgatattgtaatatagatagatagtaaaatggttactgtagtgaagcatatctgtcatttcacagaattacttttttgtgacaagaatagctaaatgtttgtatttttgtttttaacattagaggtacatgatccaaaaactattggctaccattcttctaagactataggcttggtttctaatcttggcagctctgctgctaactaacttgatgccttaggaagcttttctcattggagcctcatttttcttacctgtaagaaagggaggactgagctaggtgtgctaactagttacttggaaatctccaatcctgaccacctctgagtataagaatccactgcctttggggctcttgagctgagacagttaaaaggagttcaagccctgacaccttactagatgctttatccctctatcagctgccttggtttccttcccttctctacccccaccactttcacctagcccagactggtagatgcttccttacataagtttagcgaacctacttgacattgttttgttacaagcacaaccacttttcctgtagacacagacctggtgccatcccttctgagctttgagggtgtgtctgattttgcttctattttgtcctctctggcagcctaggtttagtcgttgtatccctctggctaagtctttggtttcaaggtctgaggggaagccagctcagccagtttgagtcccttggggcctgacccaatggctgctcactgaatccctctgccacttcctcatccaggactgggctagacttttttaggagaacatagtccattcctgagcataaaaggcttctgacatggactagaggcattgctaggtgccttggccttggctggatgtcttttctctcacagtgagccaataggtagagggaaatcattgcaccactggaaactatcttccactttttgatgggctgtttaaatgcagatgtcctctctgggctgtaaaaactccctgggagatacttacattctctttggaaacgtatgccaaggtctagagtttttgcaagcctgtgtccttgctgggcatgctcagtagacgtaaaggtggtttcagttaattgaaatatattcatttttcctgcttcatctctagatataggagcaggtcacagtgctcctaactaaatgttgtttctgttcttgtcactgtaaaccagatggtcacatttaacgacgttaggacccttagttccaacctatctcctcccctgctcctcccgctaccttcagctctcctttctctacaagattttaacacgacatctgacaaatggataaaaaatgaatttccctttttctctctgccttgcccacccaccctctgcctgtggtgttgagtatagaaccatgcatgtgggagtcatggaggacagattcttcttgtagttctagccccctcctcctaccttctggaaacaaaggaaccccacccctgcccagaaaactccaaggcctggcttcaagtcgtagtccaggaaaagttaaagctcccaggactggtcctaaggcgactacatgaagaaattcaggaacccagatgcagaccttaagatgagtttaggtcgcctaagggatctgtggctcttagagcatccctgcatattccctaggtttgtcctggtcagctcccatatctcagggtagtaaggcaacaaaagtctccagtgggtagctggagctcggcattcacaccaagtccaagaagacgagcatggctcccagggcagggacattttgggtataagacccacgctggctcaacagatgggtgaaggtcagggtaacctcaagcttgagatggcatgttctgactcaggaactcatggagagggcattgctgagtccattattattatttttactaaccatctgtctcttagaatattggaggttgccttggggagatttaatacagctctaggaaatttcttccagattatagcatagagagatgctgctaggacttgctgttagaactagtggtagcttcagtgcctgaaggttgggacgggaatgagggtggaacagagcagaagcaaatagtctctcaaggcaggctgggagaaatcctctccgacaggccaccgtaattcctcagcctttctggaatctgacacaagaaggataagcctagagttggagttccagagattctggtttcttttgagtggcccagtgcagtaagaggaaattcctgcaatataaactctctggtcccagaaagattaagacagttggtttcagtgtggcacgtgattcagaatcactctggttgcttgttattaataaatatggtacggtggttctgagcaggggtctgtggacctcacattaagaaacagtgttgtaatgcgtcagaagtgccaaaatatcccagaataacttgacaattactcctgtttccaagatattttgtagatacaagctaatgtttatcagattgggagctgttgtagtatataggaccttctctagccaacatcatctaggttggccattcagaaacatgtcttctctctgatctgtgcaatccttggcccatttggctgcattttctttaaaggggatcattctctaaacaagaccaagttcttaacattgtgaactttgaggcagcagctgggtctcacttcagaaactcctgggcccatttggctgagctactggcttgggtttcttaccatctattgctaaggtccagacaagcaagcaacaacccttttctcatctgttgggtcaccattagagcagagatcaccttttaacttcctttggaagaagtgcaggaagaagctgttctttgttattagcctcagtgagaaaatattctggatggcatcatgccctaaggggcttctctgggttttccaagctaaaatgtcctaaaaggtcctggaaagtgtgaatcggcttatgaccactgttcatattgggctctagatcaggtggtctgtcttgctcaaggctgaccccatctaggcctaccttttgtgtctgccaggtgtggctgaacagtagatctttcattttattaaagtgaaaactggatagtataatgggatattgaaggaaactgatgtgtaatgactcacaaatcacacacccaaattaggaaaaagatgattttgtgtcatgaaaaaatatatgtacatacttccattcagcatatttagagtcattatcacttgagtgcattaattattctgccaagaaatgaaattatttacttgtgggcaatagcaacacccacattgaaactggaaacaatcaagtgcaaaatgttaaaacctgaggaaaagaaaaagcaactcttgggatgtttttgatattcacagtgggatttttcttacctagcatctatctctgcctctttccctggtgatcactgggcaccagtgcagatctttagcaaaaactggcctgccatagaagccacctagcaataaatcctggcaacaatggactggcatatagggcagctgggtacatattatgtaaacaatttccttggccccataaattgttctgccacctgacagagatgcttactctattgctgtgttctgcctcagagtttgcttgcttttagaactcaagtcagaactttaagtggagtatacacattgttcattatggattaagcttatgttttagacctatcattcagaagtatatactctggttatttgaagaataacactctggtcagcaacttgaatagctcttccaaatttttgttttctgcttatcctaggtagataaggttactgaaagaggcagagagagagagaggatgcagcctggagtcatcagagaagggattacggagtaggtcggccacaatcacacagctaggaagaagcagcctggccccagtgtcgctacgtgtaaccattggctaaggatatggccaaatcagaggcacagaagtaggattgatcattattttattggaggcagtagcaggccatccagtgaaatgttgagcaggcagtaggaaatgtgggactggaggtgagtgacagctgatgtcatgagaaggatgcaagagactcattttgacaagagtggtggaaagcccctgccttgttagaggtaaaggttggatccagagatgaggctagattaaggagagctttgagatagtggggagttactgaagcttcttgagcttgaggagtgatactagcaaaaatgctttaagattcgcatcattaaggcatagcttgaggaagggacagacctgtaagggccaaggaagccggttgggagacagtttgagctgatgaggaccaggataagacagtgggaatgaagagaatgcgttgtatctgagagggagagacatgaagaagaaagaaatagcagggccagaagattttccttaaatgggaaaaattgagaaggagggagaatgggggaatatgatgaattttgcattttattggaggtggtagcaggccatccagtgaaatgtggagcaggcagtaggaaatatgggactggaggtgagcgagaactgatgtcatgagaaggatgattcatctgaagaactaagtggagagaacaaaaagcaaaggtccctattgacttttgaatgcggcagtcaagggtttaagtgggaagcccacttctcaattttcccaggtagtctgactgtgttgccagcaatgcttgagtgagttatcttcaggaaaaagttctcatttttttgagcagaaagcagtaaaagcatcctatcaagcacaaagaagggtgaggagaattaagctgcaataatgacatccccgtcctttgcagagtaagtgttagcctcagtagaataccagagctggaagggacttgagaggtcatctgtatggttccagtctgtcacttgacatgtaaaaaaactgagacgggctgggtgcggtggctcacgcctgtagtcccagcactttgggaggccaaggcaggcggatcacctgaggtcaggagttcaagaccagcctggccaacatggtgaaaccctgtctctacgaaaaatacaaaaaattagccaggtgtggtggaagatgcctgtaatcccagctgctttagaggctgaggcaggagaatcacttgaacccgggaggtggaggttgcagtgaaccgagattgcaccactgcgctccagcctgggcaacagagcaagactctatctaaaaaaaaaaaaaaaaaaaaaaaaaactgagacagggaaagggacctgtccaagatcatttggtgagttactggcagattttcttccaatagccaatctgagtctttactgtacaccatggtacctcatagctattgttggggcagcctggttcacaccttcccaaaaatagggaggatgattatccttcaacactttgggcaagatagccagagcgttttcaaggctgtattaaaaggaatctagctttttcaggagagagcataaaatctcagcttgttttagatatgcttaagggagcaagggaaaataatttgctcttgcccaagtttagctgttcaggagaagggggccttctgagaggatacgggcagacaccaacctgagaaaacctcataggcaaacccctgtcatgtccctccttttcctcctacggagcttcttggaaggcaggtccagctcatctaccttcatggcaattggcatatttgctattccatacatgtgaggttcacattttttaacccattctcccttctgctgcttcttattaaaacactaatatttctgacagccaccaaggctaattaaatgtctattttgggggtggtgctgttgaactagaggggaagaacaagaagttgtagataagtggcatggctctaaaagactgggtgacagccataatcccaagttttttcctgtgttaacacagcctgacattgggcatgctgcttacatgaccccaaatacccttttgcagacatttaccaacaactgaggaaggccttgtagataggaagggagtgctggaggcagggagcacaacatatggtgtggcatggggaaatctgtgaagaatgaggcatcagaagaggcaagggtagggcctacactaggacagtccattagggcagtggttctccagatgtgattcccagaccagcagcatcagtatcacctggggatctatttgaaatgcaggttctcaagctgcacttcagacctacctaatcaatactcaaggcctatgtggcccagcaacctgtgttttaacaagacctctgaggaactgagaatcactgctgtaggtcattcacagggtgagctggtccccctccctgccatttgactggttccatgggggactggcaaatagcaaagctgtagagtaaggccaactggagatttaaatctgctccaccacctactaactgggtaactgtgggttacttgttttatctcacaagtcatcttcagtaaaaatggagatgttaatgcttacattggagaattatagaggttgaaatcacaaaagaaagccctttatccagtttgcagcatatgttttctacaagtataagcttctcttgcttcgtccttccctttataactcttttactttccttctgtctttcccatttcttcttctgttcccactgaaagggtccactggccaccccaagctcactgcaaacacacatgccttttttggtcacagagaccagccttagatctcagactcccagtgcctccagggtatagcaatcatatttctaggttaaaaatcaaggcacatgacagctgataaacagatatatctactttggggagcaattagatagaatatttgatattaggattgtcttcggaaatctggatacaaagaaataatatcctattctgtctttaagcataatgcaggactcttaaccctccccatcctcttattcatgtccaaaagttttgttgatgtgggagtgggaaacactatgtgtcccactcacttgtaagtctgagcaagagcttccctatatttagtgcttcctctgaaatgtcctggggattgggaattattttgttagaagccacagtagtgctgtcctaaggctcagagctctttgagtaccttgctagaatgatgctgctccatcttctggctttatgataggcttgcaagatgaaggatggtaacagttggattttggcagggagggaatataaaccagtttgggaatagagaatataatctctgctatagctactcccaaatggccttttcttggttttcttttttatagctctgtaccatttgataatgttgatgagctcttgctgcttgaaactcttgtctttgacttttgagagatcatgctcctttgtatcctaatgatgtgctaacagcttcttttagttttatttatgtagctctttttctgttccttacctcacattccatctttaagcataaatcttgatttcccaaggcttctggccttagcacttttttccagggcaaactctgattttcacaatttcttctgggccattgattcccaaccctgtatatataccctaatctctcttgagcttcccacccacctgcatgtcctgctggccccccatatttaacaccttaaagagaaaatttgtcatcacttcttttgcaaagccaagccaatatttcctcctaatttgtcctatgctttaattgacgtttgcacccaaaaattaactttgacctttttcttttcctcagactagattcaaggtccttcaaacatgacttcactcacctttttagccatcactccctccactcccctttcccaaccctaacctctccaaactccactacttgttcaccatcacatttcccagtcttcttctctgagacttggcttaatctcatttctctgcttcaaatgcccctccctttcctcctgtatctggtaccatcctacccatcctttaagggctatcttcattgccacacaaaacctttctatagcccaatacccatgtgtaatcaacctcctttctctgaagtcttgtactaggccagcacatgccaggcactgtatatccaccatctgagttcaccctctctataaccctgcctgtgaggcaaacattattacccccattttgcagatgaaaaaactgagacccaaggttgtatagttagaaactctttggcttttgtgaaattatactcctagatgtcataattacatgctgacaattacatttaagtttgtgtttctgactcctcttctattcctcacctcctattgtcattgctactttctaaagtagtaaagcccagaatcgaaggtaggtatgcgtgcccataaaaccacctttgcgtcctgctggaaagatatgcattgttggtacctggaaaccctttgttcttcaggtaaggactgcagctgagtcacagtgagcagatccctgcacacagtaggagctcaatgaatgaatgttggatggaagatggatgagcagagcaaagtgcattttaacaaaaattgtagcaagttaaaagttaattctgtacacaaatggaagatttggaaccaatttccaggttaagtttagtttacattttcaaaacaactcagaagatgagggaggaacatccctttgctccggcttgtgtttgtgaggagagaacacagaagccccacacagctgttaacgccttctggattagcgttcctctcacctccatgcacatacctgtcagctctcagttcagtgttttataccctacaaagcagatggtagagtagaattatccccattttataggtgaagaaactgggacccagaggcagaatagtttataagttaagagcagagtctctagagccagactgtgcctctactggaataatggcttcagtagttattggctgtgtgaactgcaaattatttaacttctttgagcttcagctacctcatctgtaagatatgaatagtaatagtttttccttaaagggctgctgtgaggcttgaatgaattaatgtatataacgtgtttagaatagtgcctgacataatagcgctctttattagctaacatcatcataattatcattacacctttagctagtagtataacaaggtcttaaattcagattattttttctacctgtattccctctctgtggtgttatgttagaaaaaacactagtccagaaggctgaccatttgatgactgtaggcaagttacttttgttaaacctcatctataaaatgagggcatgaaggtgatgatctttaaaattctgtccaattctgacagtcattgattctaagtaggccctgacaacaggcttgcaagttggttagttgtttttgtgaccactaggtcctagattggctttgtccagggtatagctgagccttgtgacctgagggcccaggtatatcagctggactaaatgggggacaaaagtcagcgatctgcttctgggaaaagccaggcatggagttcctgaaaagaagactgcaaagtaaaaaagtatagacagtggaatcagccagatctgggcctgggagacctcaaagagcaccacagatagtgtcctgagcagaaggttggtaattgatactgagatactctttgacccttgataaaaagctatggatatagctttaaactacaggtcttaatggtgctctgggttggggctgtatgtgcttactgagttctaacaatgcccacttgggacccatcttttccaggagaggggagacttctctataaaaatttactttagtaagccagtgaccagcttttctttttcttcactgaggccaaaacaaggagaaattgacttttagtacaattggaagaaagcaagttcaacataaaaatgaatgtcctcagcatcaggggcacctatgattaaaggtggctgtgtacatctcctgtagggttctttaagaataggagccaactggcttatgatatcatagatggagttcagtatagataatgagtagacattggtagtacagtttgataattgtaagagcacacaaagttagaagacccagcttcataatgtattacttgtgttattggctgaaggactaggtcacctttctgagcctcagtttcctcatctttaaaatataggtaaatggccaggtgcagttgctcacacctgtaatcctagcactttgggaggctgaggtgggcagatcacttgaggtcaggagtttgagaccaccctggccaacatggaaaaacccccatctctactaaaaatacaaaaattagctgggcatggtggcgtgcgcctgtagtcccagctacttgggaggccgagacaccagaatcgcttgaacccaggaggtggaggttgcagtgagccaagactgcgccactgcactccaacctgggcaacagagagagattccgtcccaaaaaataaaaatgaatgaatgaatgaatgaatggtaatagtgaggcccagttgattccgtaaggatcaagtgatgtagtagatgtgaaaacacttagcaaagcgtaaagcatgaggtatttgaaaggtggtgttgtgaaaggtcctgctggaaatttattttttatctatcctgaagagctcaccctatgccttaccttctgtggaaggcacaaagatgaatcctgagccatgacagatgcatctggcaggacctgaacaaaacatgttaacttaagtcaaagatcagcatgtgtgtatgtgtgtgtgtgttcatatatatgtgttcgtatgtgttgtgcatttattttgagaacctagggttattctgtggctagcatgttggagggtagatatatgagacaggatgtatattctatagactatttctattgtcttaaagttgttttagttttggtcttatggagccattattgccttgagcaaagtaggctgatggaaaagctgacttctagaggacttgttcagaaattcaatgcttgggagagagtgcttgagtctctttgcctgataggccatgtgttctctattctggaatctgttaccccaaatgctgagaagactgatggcccatacaagctggaacagttgagggaaaaagaacaaataacacagtgagcaggatggtaaagagaggcagactacctccccacccccaccccatccctatcaccgtgcttagatgagtttcatgaatgtctgtttgctggtatggcagtggaatagatgtctgcctgctcttgtgtggagcccagtcctgctagccgtgaagtctagtgagcagggttagcgtgcattccatgcacaggtcctgccttgccagctgatctccagctcatcacttgcttgttcagttttgccatccatcaaatgcagaattcaacccagacctctccccctactgtatctcacaggatggttgtacaaatcactgagagaatgtgtgctaaagttgagtttcttgggtacaaggcatcacagaaagccatattctttcctacccatgacctctctggatggcatcatgtgtgagtgagaggaggaggctgcaggactggggtccattatgcgtgaggaatgttatggtctgttaccccaggaggagggtcacggtggggttaaataatgtaccaccaactctcaattggtcagttccaaggaggaggaggaaagggggaggagcacagggaattgaaagcaaataagcttgagtctcattttagccattgctgtcagcctctccacccattcctgacctagagctgccttgaagcaccaaggagagatggactggagctttctttgttctgcacaggagaagttcatgattagggataaaaagcatgaggcatatgtagtacatattcatattctgggtcattccatgcactggctaacagagagttgacagtattgtttgtcttgcggtctaatggaacttttgttccagtgccatccccctcacccctatctctcaccacttgagtatatgagtttctctgtaagtagtagagctctgtgggtgggggaaggggcaagcaaggtagctgtgtggactgaacacattctcattttgtctcctaagctgatcactggagattccatcgttagtgctgaggcagtatgggatcacgtcaccatggccaaccgggagttggcatttaaagctggcgacgtcatcaaagtcttggatgcttccaacaaggattggtggtggggccagatcgacgatgaggagggatggtttcctgccagctttgtgagggtgagtgtcagtcttcactctcctctcctatttccttggctgcctgtacctggcttccccttcaccagcctctgttctcctgtttatttctctcctggtggcttttctcatatttttttcctttttttaaaattgtctcatacagagaacctgggcttcctttaatctgtgcccttttaatttttagacttttcatttgtctcttgtttaacacccccgccccaccacctcccacctttgtacaaatcacttaccttgtctgggtcttggtttcctcttttggggttggccttggtggtttttgaataagactttttaaccctatattgctgtgaacttttgtctttcttatctctcttttttctgctttctatttctcatcttttttttattctttcttctcgtagtttcttcccatctcctcctcttgctcctctgctcttctctccttcctgtctacttctttgcctctcacacccctgtgtgttgtcactgtgtattcagatgttaatataagagtgtgagctccctgccccccaggcgctagagcttactgatatcaaattttacttttttcaagagaatcaagtggctgggatctaaatgtgctgggggtgggaagcaagtggcatgtaaggtcttgcaagccttctgcctctttgacattgtaccatgaagaacctggcccttaacagagaggctcttgggaggaatttctcagcagtttttgctttttctgggtcactgtaaaggaagtgatcccaatgtgcttatgacctcagggtgctatgggagaataacattggttaggtgtctcagctcttattttttcttggaattgtgagctggaatcagctatttgactattttgagctctgattttcctcatctgcacaatggtcttgacagttctttaatgccagggcatgtcacagtgaatgagataaaacatgcgaaaactgctttgtggcaagacaagtactgaagctacatgagggtgtcttataactatccttacgacagcctatcacgttttgttagtttctcctgtaaaattaggctgaagtcttctagaccccaaacaaaaggtcagaagggctagctagggctcctagaggttgaagggccccaatattagaattatggcaatgtgatataaagaaaggaacagggcatttggagttagaaaactctagatacagttttactaccttctagctctatagcttttggtaagatttttaacttccctgagccctgatttcctcatctgaaaaatagggataacagactttttataaggaattagatcatacatgccaataaggtgtctagcacagtgctagacagatattaggaacttagcaaatggtaacttattttatgattatcatcataattataatcatcaccactacctttttagctccaagaaggtccatgtatcaaggcttcccttgaggttgatagaggcctccttcctcaaggtaaaaaatccagaaagtattgttacctggttgggacagtttaggtgagggcactgcctagaagcagaggaatggacaaaattacctctcattcccttctatcatgagaatcttctaatgaaatatccaatcttttcttctcttcagtcagagtctgcaaatgccatctgtgtcccatctcatctttgctggttaaagaatcagtcccagggatagtcagaaaaagcgtatcaataaccacagaccttcaggactaatgtgaggccctgtacgcatacagctggtatgtcttgtgcttacagacctccctctttaaaagaaggattaaactgtaccaaatgatgatgtcacccaaatccaaatgcatttcattttcaaggaaatgttacttttataataaatagtaaatccaaggatggggggaaatgattgagcaagccaggatggctcagggaagcaaatgacagagccagacttcagaatatcagtgggcagccattaatgcccctaagtccaaggccgggaggagtgttcctacaggaacaaagccccagcagccagagtctagctcaagtggttctcaaccctggctatacaacagaatcacttcagtagcacaaaaaaaaaaaaaaaacaaaaaacaacaagaagaacccaaacaaacaaaaacactaacacccagcctccaggctagtaaaataagatcatttgactaaattggtaactgacatggtgaggtatcttcattccctacctggaagtctcattgctgacatttgaaccctaggatggataatcaagggtggttagtgtggttctgttcaagttagccctacctgttgttacacattaaaacccaacctgcagtctgggaaacccagatgcttgcctcagttctattattagaaatgcaacttgagcagcttcctatgcatcttcaaatatcagttttcttccttgtaaaatggggacaattcagtcttgtaaaaatgctttgttacctgtgatatgctggatacttgtaaagaggaattataataccatttagccactgtacaggaacttaccaggtatatgtgtcttgacctattcacacctgtctcctctgttgttcagaatttcatacttgtatgtgcttatgtgtgtgtatatgtgtgtgtgtgtgttctcaggttctttcctttctgtactggggatatggcttcacaagagcaatgtaggagctgatataccttcccagtagttggtaaggttaaatgaattaaacttgctgaacatcagtcctcatatctagttgtcgacatcgtcagctgttttcctgggctggtttccctgctaggagctaagggtagactgctaggatatgattgtgtctctaagtagcaaatcccacctctgtggtgggcctccttttgtctaatagaccctaacttcaagtcattcaggctcttttcctttgtcactgtgcacaaaatgaaccttttttttctgactttgggccatggcctgaggagagcttgctgcctaattaagggtaggttgtggacaggacacatgacaacctgttactgatgggaggtgaggctcgtgtgacaaggcatgggtttggtcagaaagtaaagagcttgctgaggtgtcatcaggagctggatatatacttttcttgttctttcaaattctttatttctctggtttctggcctgcttggaagtatggagatgaaaggatcacctaagccaatcattaccatcatttcttggctttctacagaccagatgtcatggaaacccaacttttccttttcaaaggaaagcccattgttccagagtgtgacctggcttttatttatgtattatctctttttggctgcaaaaagagatacttgggaaaagcttttcacctctatgaaaccctagattcactgtagatttagaactgaaaataaccatcttagccaagagtggccaacttagatgcttacaggggccaattaagtgagtgaaacaaattgagacaaggggtaagtgggcacctgtgtccaactgggagatccatgccccatctaaagacagcaaaagtgacttggatggttcccatcattagagtgggatatagtggagaggaaagcccagaggggccagatcttctagtatttcaagaaaagccgggaattggatttttatgtaaaactctttatatttaaaaaaatgttaatgaggaattcatatttttaaagaagcacagtgagagtcaaacaaaacacatctgtaggataaattatctcccaaggacccagcttgttgccattggtcaccctacctccacgttgtataaatactgaggcaacatgggcccagaaaatggaaatgacttgctttctcatgtagggaattagtggcaaagccaggacttgaacccaggcctcctgaatcttaagacaattttactagacagtctttgtctaataagtttaatgtcttggcttcctttggtatgttttctgccaaattatttttttcctgtgaataggtcacatgttcctgttttcttgtaggccttgcaattttttgttgaaaacttggcattttcaatattataatgtggtaactctagaaatcagattttcttctctccccagggttttctactgttgattgttgagggctgtggttgtccatttgtttagtgactttttccaactatttttgcaagaccgtattcttgttatatatggtcactgaagtctctgttcttttatctcattggtcagccaataacctgacatttctttaaacatctggatccaagaagaaacaaacaatactactttcctggtttttgtagcttgactctgagctggagtacccacttgagactgtgccaggtcatcaactcttctgtctcagccttctcctcctgtttgtatgtagatcacacatcctccagaaatataagcctatggtcctctgaggtttttttctgagcatgcatctggtcctgggcatgcgtgttatagtgtgacttccctggtatgcatggtggcccttatgaatccttattccccaaagaaacttcctttttagcttcctccttcctgtgctattgcatgtgtttgctatttgtcctgtccacaatcccttgtcccaagtgggcatgagcagtgtatgtctttaaatctttcaacaaaggcagccacagcctggaaagcctctccagccagaggtcaacctctgtgctagtccctcagtgccaaaaaggtcaaaatgcacagctacaatattgtaaagaacaaggtcattatctcctggcaccagcaagccacaccaggaatgtgggccactgtcacctcagccactggggaatggggaatggtaagaggataagcaaaagtgcttcaatgctctcttaccaaatttttgctgcccttttctgcattacacagtcccctgtaagttgctgcaagttttggattagattctagagttccaaaacaatgtgttctgtcattcattgccagtttaaggttgtttcagtggaagaactgattctttgtgtgccctgctccaccacttttagtgatgttgtccccttctgaatcttaatcctgtgctttctggcctatagcataatcaagaaagggcaggcttgggctgctaacaagactgttaacacttgaggacttaccttccattccagactaaaggcaatagtgtttttgcgttcttgagaggagtttcactataccaacccttgtttatccattcaagcttcaaagtgttcataagtctctagtcttaaacatttatatcatttatgtagaaggtcttgcttgtggccctagaggtaacacattataggttgtgagtttaggctgacattaacagggagagtctttctccctggattatggctatttctctcccctgtactagaatttcaaatgacattattataactcatttgcattcacataatccatcttaatggcttctcactatgcacattttttggattacatcatctagtacatcatttggctaattggaggttttttatttttttcttttaatatggagacctcttcagctcagagagaatcttaaatgtagctgttacatcacccagatgattcctccaaattaggtagcacaggtcaccctcatagaaatcccaagttgaaagcaaccttgagagtcatatagcctatccctcagcctccaggcaggaccagagctaaaattaccctgggcttttgagaacctggccagcatctgtaaaccaagcttgaactactctgttatttccagctactagcccttatgctgtagtctgagccaatttcttgaaacatgttgcttttttcaataggaagatggtatttaagagttgacaccagtaggagacattctgaatggttttcttggctctggggctttccaaggccctattgttgacccatagcatggatttgtaacctggttggctgcctgagttgaggctatgatcttgggcctggcacctgtttttctctgtgtaatcaacccccgggtttatttggggattagcttagaccttcctagcatcgtgtatatactgccttggtggtgtgatgacttgaggagaggaggaccatgactgagtacctggagatgaggtctgtttctgtggctctttgtaaagtacaacatttttggaaaatcatcatacttgtatatatatattttcttttttcatcagtatatttatcattatgagtaagagtgaaaccacttatctttacatggctctagtgctattaatatcttctcaccagtatttactaagtcctgaacaaaagtgactgtctagcacttagcaacagccacctcctggagtggtctagacaagtactaagggtatctggcatcttgagaggtctgttgtcctctatattagagggtcactagagaaacaatactcagaagtgggttggtctctttttttagttttcagaagtgaaaactgacagctccatacctcttcaggccaccagttatacctcaggacagatctgaaatagtttgtccttaagttgaactagaatctgtctttctggagcttctactcatgggaagggtgtaaatgtccaagagaactggctctggagataatctttctggattagaatcagagcctttccatttattagcaaagtggccattgtatgcttcagtgatctcatcattaaattgaggatataacaacacctatctcattaagttgtcaggagaactaaacaaaatacaggaagagcactgacaatgggatctgacacataggaaacactcaataataatactggtaatacttgcagcaaactcttaatgtaaatggtagaaataatgtcctcatttttccctgctcctctctcaaaccctcttggaatatactgactctccactctgtctatagcccatcagagatctgaaacctcagaccaggtcagccaagcctctcctgtcctccaggcttctgagctttcaccttttagccattatttggatgaatcagtttcttgttgctgctatgtgtgagtggctagactgaggccatccgggcatgcaaggcccactccattcagccacttgtatgagaacatgggctacatggaggcctggacatgctgacactgccaggctttcaagactaataggaatgatattacaactaatgaccctgctgaacatgtaattggacaatgttctttcttggctgttctgacctctaccaagaggcataataatgttactggggccatacatcagcagttagcttccatttaggaacaaataaatggtggaacattgtgttatatgtaggaacccaagaatggattgaaaaacttctttttaaaatatactggggaaaaaagccataataatagacctgaacattctgcccattggtccaactctttgttttgataagcttattaaggtagtacagttattgacattgctgctcagtagagcttggccctgaatgccatgtgccatgtgtgcgatggactcattcccatatttatataaagtaagcatagcttactgttaagcgtacatttaataaagatgctatatacgggacagggccagcagtagccctgaaaaacagtgcagccagatgaacttgaatttggggcaggtcctagaggttcactttcccttgtgggttgggataggctgagagtgtgtgcgcagtgggtaaggtccctcccaactgaaaatattgggagaaagtccagcccagtaggtagagtgtagcatcagtaggcagcagacagagggtggtttgttgtcatgacaagtgactggtattattggtccaacgtcaggttgtttagtgtgcttcaataagcaggtaaagcatggtgaccaggtatccagaggcagggagtatgcagtgaaaatggtttcttaatttgtagaatgaaggacttaataaaaattcattcacccaacagatgatcatcaaatggctactgagaagatacagaggtactctagaacttcagcccatcctctaagagtctgatagtagatgtgaaaacttatgcataagggaggtgatttgccaaagctctgtcactttagtcaagttctttacctttgccaaatctcacttttctcccctgaaagatggaggggttggaacagatatactccaagaacttttctagcccattctccataatttcttcttctttttttttttttctttgagacaggatcttatgcttttgccctggctggaagtgtagtggtgtgatcatggctcgctgtagccccaaactcttgggcccaggcagtcctgccacctcagcctcctgagtagctgggactacaggcacctgccaccacacccagctaattttttgtattttttgtagatgcaggatttcaccatgttgcccagactggtcttgaactcctagactcaagcaatccacctgcttcagcctcccaaagtgctgggattataggtgtgagccaccaccctggctaatcttgttttagttgaggtaaaataaacataacatcaccttccccatttcaatcattttaaagtatacaattcaatgcatttgcaatgttgtacaaccatcaccactatctcattccagaacttttttatcaccacaaaaagaactccatacccattcacactcattcctcactcctctctcctctcagtctgtagatggtataatgttttgtacaaatgttagcaggtagaaaatacaggatagttagggaagggattaaattcataggaactgaggtcaggaagaggcatatgacttcagtagctataggagactacatcagcctggatacaggctaaaaggagtaaaaaacataagacagatgttgcgggaaaagcctcaatagggaacaggtgtcatctaaggcattggtactatcctggaggatcagaaagtaaatgagaccctgccagacttgcctttaacttgttagtaaatggcatagcccaaacaagatcacattccaactccaaagccagtgtttgccacatcaccatcctgaagtgttttttttttttcttttctaaatgtctgtcaaataattgcaagctttctgtgagatgggtaactcaggtcagcttgatttcagcattctgcttagcgtggctttcatcatgaaatcggtacttccatatctgaatagcttaaatggaagtcttctcttcattttagctcaaatagaaagaaaatcaaaggaaatacagaataaatgaacttctaaaggtcctggcagagcactccttttttggctacttaactaattaacctaaattctatcaacgtctaagcaggataattccatgaaaaccaatgaaaggagaagacttaggggtagagtggagtgtagttcttattagaggcatctagttttcttgactgggaaggaagctatgttatctgtgaagggtttccctacactccaatccacccccattctagcttgagttctcactttaagaagccttgtcatgggcagaaatcatcaatacctccagcctcgactaagtaagtctccattcgttgggaagggtttttgagtctggttgtcaaggaggtggcatttggggtataagaaatttgggacaattgcaaagcaattacaaaagtacttcctaaaactcttccctgactagagaggacaatgtttctcatatgttgcttcattgttctaggggcagatgatgccaacctaggggataataacaagaacagctaatatttgactctgtgctagaaactgttttacatgcacagtttaataaggattaaataaactaccttatttaatcctcacaacagccccatgagatagatagatattatttctatttcagaggtaaggaaactgaggatcagaaaacttaaagttgcttactctgtgttactcagaggtagttgtagagccaggatttgaaatcaggatcccgagtcttcaccctttaccactgtcacagactgtctctcctaattttggcctaagagtccagagactttgcttcaatcctgactgccactttgatgcatccccctgtctggccttggatttctcatctgggaaatggaaataaaaaggtttgcttgcctgccttgcagggctgttttgaagtccaagtaagagagttcgtgggaagacactgttcttgaactaggttttcagagaagccagggacaaaagaagaatgatagaaaagagtagggaaggccttcctgaagaaggagtagggggcaggctttagaaggatacaaggtacagaggtgtgaataaacagaatgtgttggaatgaatgggaagggtagcttgcctgaggtcacacgtctgtgttgaagagcagtgaaactcggtgggtcggtcccattttaatgtgctgatgggaagccatgaatgcaaaaacagtatattcacacaggtcttttctttttctctttttgtctgttatataacaaaaattttcattgctctggttgaagctccttatttctcattgtgttggtgctggagagggagaacaatttgttagcagccttcttattatgatacttcatataattagtgagagttattaaatcttcccttgaggggtagaggagtagtttctgtgtctgactgtacataccgtgctgattgtctttgtgccaggcaggaatgctaagtgcttcctggcatgcacattcaggaatccctaagcacttctgatcctcctgaaagctgagactggggctccaaaactgggtgtgtgtgtgtgtgtgtgtgtgtgtgtgtgtatgtgaagtgggagctctgcttgcaactaaccaggttcctctcagtccctcacattcacctttgtatccacacttcaccattgcttcactgtggtggcagagaaaaggccttttggtgacctttgttattgaagagttcacgttccctccaatctctcctttatctgtgttttgcccttttgtagtgtttgctgagatttttggctggcaactttattcagacagagacagagctcatgattagaatgattagaattatctgaaaaaggaaagggctgccttgggagacagtaatctcatcattcgttgtgttcaagcagataggctgtgcaattgctggcagggtatgttgtcaagggagtttatgtattgattggggagcaaggggtggcatggactagtccaccttccatttcctttataaactgattctatagctctgagagtctattgttcaataagactggcaataacccctcaccttctcaaaggatgtcttgctttttactcctctctggttgattagatttggcctttgaaaatatcaaggtgagatttagacaataccgcttacccattctcttctcagaaatattacactgctggagacaggggccggctggctttctaagacactccttgagcctttattgactttatgaaggaattactggctggatattatggtagttttcttttagaactactgatccatttgcagggaggggctactaaagatgttgaagaggttgtaccaagggctgggtaatcatcactttatcatatggaacaatggtgagtctattggaatatgcatataggtatataaatgcaaggagagaggttgacaaggatttcacacaaaatccataaccatggtttcctcaggagaggtagaatatggttaggatgaggaacaatcaggggaaatttcaccttatctagacagttttagctttttatgtatttattttaatagagatataatttccataccataaaatttaccattttaaagtatacagtttagtgggttttagtatattcacaaagttgtataaccatcaccattgtctaattctggaacatatttttaaaatcatttttaatagataaaactgtatatatttgggggatgtaatgttttgatatatatatatgtatacacatattgtggaatgattaacatatcatcatctcgcatacttatcattttttgtagtgagaacatttaaaactgtactttcttagcaattttccaataataatagtattctattacataactatgccatattttggtttatccattcatcaattaatgaacatttgggttgtttctacttttggttgttatgtataatgctactatgaacatttgtgtacaagaatttgtgtgagcatgtgtttttatttctcttgagtacgcacctacgagtggaattgttgaatcatatggtaactatatgcttaactttttgaggaactgccaaaatattttccacagcagctctaccattttacattcctgccagcagtgcgtgggagttccaatttcttcacatgctcgtcaatacttgttattgaccttttaaattattacagccattctaggacgtgtgaagtggtatctttttatggttttggtttgcatttctcagatggctaatgatattgagcatcttttcatgtatttattggccatttatatgtcttctttggagaaatgtctattcagatattttgcccatttttaagcgagttgttactttattgttaagttacatatattctgaatactacatctttatcagatatatgatatgcagatatttttcccattactgggttgccttttcactttattgatggtatcatttgtagcacaaagtttttaattttgttgaagtccactttatttttgcttggttgcttgtgttctaggtgtcatatctaagaaactattgtctaatgttacagattttcctctatgttttctttaatgacttttataatctgattccattcagatatttcatccattttgatttaatttttgtgtatagtgtaaagtaggagccaaagttcattctcctgcatgtggatatccagttgtaccagcaccatttgttgaaaaaactatattttcccccttgaataatcctggcacctttgacaaatatcaattcagcatgaatgtaggatatatttctggactcctggttttatttcattgatctttatatctattcttgtgccagtcccccattctcttgattactgtaggtttgtagtaagttttgaaatcagaaagtgtgagtcctccaactttattctcctttttcaaaattgttttggttatcctaggtcccttgaaattccatacgagttttagtaccagtttttcaattttctgcagacaccaggtgagattttgataggtattgcgttgaatctgaattaatctgaggagtattgctatattagcaccattaaatcttccaatccatgaataggagaggtttttctatatagttcttctttactttctttcaataatgctttgcagttttcattgtataagactgcacttcttttgttaaatttattcctatgtattctttcttttcctatttaaatgtgatcattttcttaatttaactctcagattgttcattgctagtatatagaaacataattgatttttatatcctgcaacattgctgaacttatttattcattataaaaggtttttttttggtggattccttatgatttcctgtatatcacgttatatgatctgtgactagagatagttttacttctttctgatgcaatgtcttttatttctttttttgtccaattgctctggctagaaccttcagtataaggttgaataaaagtgatgaaagtgaatatccttgtcttgttcttgattgtaggatgaaagccttcagtctttcaccattaaatatgatattaactatggattttttataaatgttcattattatttggagaaaagttcccttctatttctagtttgtttagtattttttttttaatcatgaaagggtgttggattttgcaaatgccttttctgtgcctgttgagatgatcatgtgggattttgtaaccttatttcactcatatggtgtaatttacatggactgattttcatatgtgaagcaaccttccattcctggaatcgcatctggtaaggtgggcaatttgtttttaatatgttgctggatttggtttgctagtattttattgaggatttctatatttttgttatttggaagggtttgtgaaagattgatgttagttattttttaaatgtttggtagaattcaccagtgaagccatctagtcctgaggttttttttttttttttttttttttctcccatgtgggaagttttcaagattgaatgaaattatttattaaatctttttcttgttataggtcttctcagattttctacttcttcttgagtcagtttctgtaggttgtgtctttctaggactttatccatttcatcaggttatgtaatttattggcatacaattggtcataatattccctttaattcttatttctgtaagactggtagtaatatttcttctttcatccatgattttaataattttaatctattttttctattttaactttttgcaaggcaaatgtgttcttgtataatgtataattttaaaaatagaaaaaaaaatggaaggcacaaaataaaaatgcacattaaagatatgggtatattgctaactccctggctgtctctgtgggtatcagtttctttattacgaaattgagaggatggattactgttgctgaagtttttgaaagcctttggactatagtatttctatgtttgagcatgggattaaaggacatagatgagaatatttgtggacggaaaatagaccagtctgggaggaacccaatattcctaaaggaagtagtaggaagtaagagtggaaatacagattggagtcagattatggtaatattttaatgtcagggtgagggatttggacttgctttataatcagtggagagctattaaggattttgggtttatgggattagccagtcaatgtgatagtcaaggaaattggtctaatagtggtatgtgggaagggtaaaagctagaggatcacccagggacttgttcaggtataaaagtatgagagcaatgacagtgaaaatagaaaagggagtaataaagaccagagattgtctccaatttggaaagcactccgtggtttagaaggaggagggaggagtgagttgtcttgctcatcctcatgtccttcacagttagtggttaggcacagaataggtccaaagtatttgttaaattgaactgcattaatcagccttgcttcggagttcagtgaagttcaaaggctggtttccccagcctttaagcactctaagaggacttccaggacagcctttcaacctggcatgttccaggcattgtctatcttcttacttgtcacccaggcatctatatgtgctaattgcagcatcaatgaagaaaaggtacacattagcctgcacggattgttgggcagggttgataatggctctctggtctgatatttcaaccagggcagataagcatatgggctgacctgtgtcagtgcactctgacatacatgcagacaaagaccttcctctgtacagaacagataagctctcaagagcagaggacttagaggttagaccagaaagtcttatcattaggcccgggggatgttttgtgggaacctgggatcaggagaaaaacagttaggccttatatgccacctttttctaggctaagaaacatcttccctcaaatgtcagctctataaagggcagtgatttctgtcttttttatttgctgttgtatccctaatacctggcacattatccacacttggcatagatttaatgaatgaatgaatctgttagtagttctttgggatgaaagcagcatcttaacctaaggaatgggcttctggggttgttgcagtagagtagatgaaggtgtcttctcagaagctccttatgaaggaccctgctacacaggcctttagttataaccagaaggacttctctaccaaattctttataaggaatctgttttcacttggctgcagttgccttcgtcttttctcattgttatttggaacgacagtgtcatggtgtatagcttgaacctaaatgtggttctatttctgcctttacatctgcttcccctttccttcatatcctgtcttcattcccactagaattgttcaaaatattcatcttattccagctatccaaaagtgaacatttggacctgacttttcttaaactcctaagaagaaaagaaatgattcttattccttaaaggcctgcctatgttaccctttccatagcagagtttagcttgctttgtgagaagcagggaaaagctaatggattattaagagggtgaggttttcattggtacaaatagacagcatcatgtatatgagatgtttgtttcagtgccttaaatcactttttttttttgcccaggtctattcttttgaataattatctctcatattgcttactgattgcattaaaggacagctattagcatattgaagacacaaagctgaccttttagaagctggaaagatatttataatggagcacttgcagagggtgataggttttggatagagatacattttgcaaatttggctgtatatacaaaatacataaaaacagagtgagccctatttactttggcctgtgacaattcagtgagatatacgctggtgacatctctaagttcactgagtggtaatcatgccccctcacctcctgtgagaaaaagaaagaaggaagaatatacagagttgggaagtaactaccatccttctagttctatcccaaagcctcttccccccgagtgattacccactaaaaggcttttctgatggcagaaatagggatgcatctaaattgtgtgattttagcttcttgaggcaggaatgtggaaaaaactggggtttaaggagggaaaatatggaaaatatggagaattgattaaacctgttgagacaactggcaagctctttggctaattacccctgacagattttgtcactctgccaagcgggcccacccttcgtttccttcctgcccccatggtttccccacttcctaggactgtggggggtggcgggaagggctatcttcttgggccttcttgattttcagtcaaagtcatctagaatatccagagacatctcactcggccgtcccaaaggttttttttttttttttttttttttagcttcccactgccttcatgatttaggatggacagtctcaactgttagcgaatttatcagtttctgatgattctaataattgtctgcccaccttggcccaagccctttccttttcttttcctgtcttccttagaaccagaggcacaaagattctagcacagtgtttaaaagcataggctctagagacagactggctcctatcccagctcctctgcttcctgtgcgacttgggatagattacttaacttctctgagcctcagtctccttttctgtgaaatggtgataatagtggtacctatctagcagggctgaatacagtatattgcaagctcttagcacagtgaatggtgtatagttggtgccaattaatagctattgctagtatgtggtggggaagtattctcccatccctatcccagtcttgaagaggtagagatctttgcatgtccaaggcactttacagtcaaattttgatgattatttgtatatcccatcacagaaatcaacactaaactttgttttcaagacacccactctagtatttaactttggcctctatacttgcaggtgcataaatgctgtgttttgacagcaatccaaatgtggcactcaagatgtatagcttaacctttttaaaaatccagttgtgctacctagatgtgctccagcatgaatgaatttagtccctccactctatttacagataggtcaccagagacctagagaagattaaacccatgcccagggcaaaaagtcaccctagagccaggtttcgaattctacttgcacaggtctctggttgaaggttctctgaatacctgagaagttcagttcatcctttttctacttgcctggaaacctcccaaagaaggaagctaactcattatttttcttttgcctgcttccacagctctgggtgaaccaggaggatgaggtggaggaggggcccagcgatgtgcagaacggacacctggaccccaattcagactgcctctgtctggggcggccactacagaaccgggaccagatgcgggccaatgtcatcaatgagataatgagcactgagcgtcactacatcaagcacctcaaggatatttgtgaggtaaccatggtggttcatgtggaggcacttccacgaagaaccagcaaccctcctgggccctgcctgtgacagtcccaagatgttggaaagggcacatagcctcccagattctgttcagtgaggtgaaactgcttccttagggtcagtgaggtaaaactgcttccttagggtttctcaatctctgtttttcacatttttctctctgtctagttttaatatttattcatttatattcattgtctctctgtctttaccctttcttagtcttcctccttctctcccctgcatctctacctttatctttttggtatctgatccagttacagccatctcatgtaagggcttaacctcactcattaaagcaaaatgcatctcccgccaagccagtgattcacagacttcaatatgtaccagagtttctgggggagcttgttaagcagccctctcactcttgtcccccaagtcatgaattatcagtctcaggtaaggcatgagcatttttaggtttaatgagcatccctggtgattctgatgctgctggtcctactctctcacttggagaacaccggttgtgagtttaagcagaaaagagcttggagacaggactccacagaagatggaggctggatggacaaacctgggctccttcagtatgtcactttttttccccaagagctgtctctctacattccctaaccccattccttccatctctctgtcctaaatgaagatgagagccttcactctcgtactctcttaagcttagtagctgcaagttggcatttttaaagggcattttactgaacaggaagggaaaaccaatgggaaatgaaggcagcgttttaaaaggattaaacacacacacacacacacacacacacacacacacacacacacacattctctcttatatctttcttcttgactcggaaaactctgcattgaatctttttgtctccttccttccagaggaggggttaggttctattttctgtcccccagcctagggtccactgtggagtcagtagtacagctccaacatttttcaaagttcttatttctctacatcagtactgcccaatggaacttcctgcaatgatgaaaatgttccatgtctgcattctccaatatagtagctataagccaacaatttatggttgttgaagagttaaaatgtggctggtatgactgagaaatggaattttaaattgtatttacatttaattaactttaatttaggtaaccatatatctgtaatgacagccacattgaacagtatagctctggaaacaccaaggccaaggattttgtgcctgaactttctttatctcaactcattttctcacccctttcaggaagattaaaagttatcttttcccactgccccactccctgccctgccatgaggcagatagagtagaaagaacaagaggtctggggacatggaatgctggtttttcacattctaacttggtcattaattaaccctgtgggcttgaagataccccttaactcctctgacattcaattttcttatttttccaatgggcttcattatagcaatctcttaagtttgttgaggaaattaagtaaatagaatattgcaataacctatgctgtatttggaaaaaggtaattttcttttttgcctcctttttaaatttattcacccatccatccatatgtctttttcttcttcctcctcccttcacatcaatggctgatgctaaaaaaattccccctcggaatgtgctacatggcattcagcatcaaaccactgacatttcattcattcggcaaacttttagtggaattctgttctgtgccaggcctggacataacttctagcctcaaagtgtcgtactttagagcagcatctgcatcacctggaaacttgttataaatgcaaaatctttggctccaacccagacttactgaatcagattatgcattttaacaaagttactatttgatgtataatacatattaaagtttgaggagcattgctccaaaatgatacctatattacaatgtcatagtgtttttcataaaattaagtacaatctattcttcgcttggtagctgagggatgctgtcaagatctaagtcaggtcatatcactcctctgctcagaaccttccaatggctcaccatttctacctgagtaaaagtcaaagttattattgtttacaggggcctgtgtggtcaacccatccttgcctctatgactttcacctcctgctcctttctgctatgctttcgttactactccagctatactggcctcttgcttttccttcagcattactaatatattcctcccttagagcctttgcactggtttttccctctgcttaaagcattcccctccccaccccacatttacatggctcccatcctcagctccttcaagtctttgctcaaatatcatcttcttgagacttctctaagcattctattgaaacctgtaaccttgcactgcctctgcccctttcctgctttatttctatctgttacatttatctatctgacatattatatatttaacttatatattttgtttattgtctgtctcctctactggaatgtactttccatgaagggcagggattttcatctattgatttactgatatattcccccagcacagtgcctggtacatagtagatgctcgataaatattgcttaaagtcaaaattaaatataattgctcacatgtatgtactgctttgattggcaaagtacattcacatcatatgtcatttgatcttcaaacaggacaaaagttgttattgttattcctattttctagatcaacagatttaatctctaagaagcaaaattattttcccagagctctcaggtactagcccagtggaagtccttagaagtttctctcaactcccacacatcttggcctcttcctatgggacacagactcaggacagcaatggaagttatttgtctttccagaaagtagggggtgatatgatcctgctttaaggagtttccaatccagccaacccaatcaaaccttttgttgacaatttgctggttccttatttttcaacaattattggtgctgaaggtaagtatttaaatgggagctatctccttttctcaccctataatcacgggcatcaaagggaagtggagaaagctgcatctagctggatcagaagacagtagtttagcccaggattgtgtaatctttaaaccaaaagctgtgaggagcgaatggtttatcagaaagaataccagactcagaattgggagtgctgggttcaggacctaccttggtcactaactgactggggaatctcagatgagtcttttcaccctagggcttgtaccccatctctaaattgcataggttggaggagctctttaagttctgtttggctcttactttttctctagttctgtaagatgtagatatgccctcactagagaaaaactgtgatagcgagccaggctacttctgcattttctgcttcttccttcttggtaccattggaagcatgtcttactcaagcatggatgtgttaacatggcataaaccactctttctgtaggttatgggagagctctaaacacttcctacttttgtacttgttgaaggggaaagggggaaaattatattcaatataaaaaaagtcacactatttattagaggacattctttttccctcctgggagcagaaagtgctttacaaacatttaagttataacacccttattttacaaatgaagaagtaggaaataaaggggtttttaattgaagttattcaatgaggtcagtaagagacataatcttttcaaatgagttctctgcagattacattcttctttctaaacccagacagtggtataaaataccttcagtttagttctagatcaccttgaccaacaattggtgatattgcctcttataaccttagaactcaaagtacaatcaaggaaactgaggcaagagtaagcagagctaacgatgctttataaagctgtcttgtctgctttctcttgaggaagataatctcagccatctgatacctatgaaataccttctgtcttcaaatgcctccagagaagctggcctagctttcctcactcactctgtattagtgatcataccattcactatcaagaaattcttccttaggcatgctgtagcttcaagtcatttccatttggtatattttaagcctgaggttttcaaacgtattagccatttgggttttcccttctgcaaattgcctatctcaatacatcccaatagtctttacatcttggcacatagaaaatgataacacattgtataagatagtaatatttgtacagtatcctaggataaaaatatgagtcagctagtcagcctaaaatgccaagcccaggggtttctgcctgccataggccctacctgtccattctgtctggacattctgtgctgtgttcctatactttgcccattttcatggagtttcttatgtttttttcttgctgatttgtaagagttccttgtatattctagatatgaactccttgtcaactttccatgttgcaggtatcttctttattctcttgtttttgaataacttttttacttcatttgaagaaagggtttcctatctcaaagagaggaagaaggaaataaaagaaaaccaccaatttgaacattctgcttctaacttacctttgatcatcaccagcatgggaagaactaattagcatttagttgacaaataactgagcagcaactatatgccaggtattctgttaaactttgaggatacggctgtgaataacaaccatggtcattatctcctaattttcttaaaaatgtcttcaagatgtttgtcaggtcgcctatcaggcctcaggttccaggcaaaaaaaaaaagacatatgaaacccctagaatgtcagaactgaaaggatccatggacatctttttcgatgtcttcattttagagacagagacactgaggtctaaactttttgtgagggcccttccctaaagaatttcctaaaccccagatgatccaggggctgtttggttcatcctattttctggtagtttctaggatcttttctggagatcttgggtattgtttatatcccatatcaaggcattacttctagatcaatgcactaggtctcaactcgtagatcagccctggtgggtttaagaacaaagtgaaatagatgggcagctttccttgctgttaccataacaatgccagagctaatttatgccagttgtgactgatttgataatacccacatttatcttagctactctctggcctgccttcccacccatgcccactttactcctaggagacagagattaggctctaggaaactgcctcccttgagccatagtaccctgttccctgttaccattcagatggggcgttcaaagcatacctggcagtaagagccacagaccccttttgttccccctgccctgtgacaggccttcaatgggccctgagtgttatctaagacaaacaaattttatgtcttccatcattcttcatgatgttgcttttcaggcccctccctaccctgctcactcccctctggctgtgtgctattttcttggtgttcctctgaaaagagggtggactcaaaatttaattctgctctcctgcagtggtatgactaccttccaattgcctctcccatttttgcctctcaatatatttcttcttttttctaactgaaaatggtattaggctttttgacaatcacatttcactgccaactcattttaaacttacataccttcaaaaatgagtgaatgagagtagacaagtattgattgaccccctaatctaccctctgttcaccactgatgtggaaaatttgatagccatcaggccagccaaaagaaggggataaaaaaagcaagactccagggagctaatcatttctcctggcctttctttttccagaaacttgtgtggtatagaggtcgagggtgaccctttggggttatccagctactcccatattcttatgtctcatcgcttatttttttgataagggcagtttacatctattatttgtaatctttagcaagtgactatcttagatactatggctgcaggagatcttgagaagacattgggtcttccctcctctttccttgataatatttcattccaggcagccttcttatagctgcattttcttttctttacactctctggcaaagacttttatcccatttttgatcatgaagacaattaaaaaacagcattagaggaagtttaaaaataggaacaaaaaccagccagaatccatcaactataacagaattatttgcacttttgcataatcccttcaaatctgtccatatgtgtatatatttacagagttgtaatcacactgatataccattttatgtcctactttttaacattgtatcataaacaattttccatgtttctacatggtcttcctaattatcattttaactgctatgtaatatttcatcaagctaaatgtaccagaatatatttataatctatcattggctttaaaaataagagttgataaaacattctaaggtcctaccatcctgtgggcattcttcctaatatatcccctgccataacatacataatataatagaaagaaaatgatttccttgagagtggcaataaataacatatttagggacttaggaagttggactgaattctttattcattgtcttttcctaagatcactctcttagttttatttctgttatattttatgctgatgttgacttctagtatcattgttgaattctggtgattttatggtgttttgtttcttccctgagacttttcaaataggagcagtggacacaactattaaatattttctgaactggcttctcagcagataaatgagctatctacgctgccctcttctgtctctcattgtggtcactcatcagtacctattgcttacccagaagtaatatgttgaatgtgccactgttactgttttcccccagctgtgctcctcagcctgccttagggaaaaaaaagtgggagaaggggtaaggaagccttcactcccatttaatgttgagatgatatgctcactgctctccctgctccattgtagctaagacacgtccagagatggtagggtgaaagagacagatagacaggcacacaggcacagaccaacccagacatactaggctctgggaattacatattaggtagggaagggcctacaggagtttattgccattccttctggtagtcaatgtaaaactttctagggaggcagaatttggggagcaacctctgtaaaggtagtggagccaaaagggtgttctgggaattttcttcctgatcaaaaattgcatatgaaagaatgcaggaaattttcaacatgtcagtcaatgagggcacaaatcattagttaaacagatgtcaacacaggcatagactattaatttgccaactatttaaagacacctactaattaatggctaaattggagagtgagaacagatatgggaaggggaagtgagatttgttgtagaggtcagtaaaagacattgaagccagggatgaggatcttcttggagtgtgcccagatgacctcattggtagctgtgttaagggagacaaagcgaggatagggacagggctatatgtggtaaatcagtccctgtaaaactcttccttaggggttcaacccttaagaaaagtgttaagataatttcacttagctttttgatgaaagcaaatgactataatttcttctcaccaagaacatttttatgtgttactgatttctaatgaggacagtaactatcaagtgaaaacctatgatagtaggttccaaatggaagatgcaatttagattggggctgtttttgtcctgacttaagtatgccttgagtctggtttatgttaccccaatgctttcttactagaccaagaatctctttcatcctttttttctctttcatcagtggttatctttattaatgtgttttatgtgtttagggcacatttatgtgtttaagacacatgtgttaggtgttaggacatattaacgtgttaggacacatttatttataaatatatatatatatgatatatttataaatttatatatatatatataaatttataaatgtgtcctaaacacctgttctgttaaaaacaccatgtccaggcacacataggcttgttggctgagctcatctaaatgatcactcctggccagctacctcagatagttgagaaatttgctttgagaaatggtttgacagatatttgcataatgtgaatagtatgaatgcattttcttaaagtatgtgaagacatgaatgtctaagaaaatattgtatgtgtactttgatgtacacaacagggaaagtctaaaatgataaacaactattattcctggttatttcctgacattaaagttcatgaggaaacttttttttgaagaaatggttttgttttgtcaatttctgttcccttgtgggaagtttttctgttctggcctctgttcccaattttttgtcaatgttattaagacctttggtttggtcctataaggaatagaactttagagatgtgaatggatccagctaaaccagtagctaataagacctgtgaaaatgtgctcaaccagcttcttggaaagggatatttgactttgggggtcttcttcatagaggatggagggaaaagactttggagtctttgcactcttaagacttttgctggcaacccagctttcctaattactcactgggggagtgacttccttctgtaaacctcagtttcctcatatgaaaaatgaaaataattattccatgcctacttcttgggaccaaaatgaggctcttaagtgcttaggaagtgtaaagccttctggaagtcagggacttcctcagcctaggctttttctttgtctacagggctatctgaagcagtgccggaagagaagggacatgttcagtgacgagcaactgaaggtaatctttgggaacattgaagatatctacagatttcagatgggctttgtgagagacctggagaaacagtataacaatgatgacccccacctcagcgagataggaccctgcttcctagagcacgtaagtatcttatccatttggggagggttttgagaggtgttaggaaacaatggaaggagcgtttgagctgtctggttctgttcagctcctttttcctgcagtggggaatgggttcctcttgggccttcattttgacccctggtctctagccaggaaacaaggacttagaaaagtgctgtgatttgccctataaatgttaagcatgtgtatgacctgctggttccattcccgaatgtatattccagagaaactcacagaagtccacaagggagcacatacaaggctgttgttgattgcatggcagtgtcgtatgtggtggagtaccattagaagcaacctaggattctccttctttaccattcccctcccctctccctttccttcttggcagttaccagtagaatttttcttcatcttcccttttttgtttctgttaagtttccatgagactcagtattttgggaggaattcaaaatattcactgcacagagaatcaaggaatctgagaaataacaaggaccatggttagtaagaaagtggtccctgcaagacatttatgggaagggcactggagaaggtgaagtgacaaaaataggaaaagaacacatggacttcgaggatggagctctgggaaacaggatagtgacgatttgagtcctgtatctgtagtgtctgtctgggttactttgggcaagtccttcatgggctttggtttgttcatctggaatgtgaggttacactgtatgatctctctggttctttgacatcatctgagtctcattcacaggtgacctagttgttttgacagcatgtttccccttttaataaagtatttatttttaaagatttaatatgtgcacttaatataaaattcaaatgacacacaaaagcatgcagctaaaaataagccttcttggaaatattcctgttttacttctgagactctgtgttggggtgggttccctaagatcactcttatgtttagtgatttggactcagaatatggttatattgaatgtggtttaggactcagaacatgtttatactcatagctatgatttattatagcaaaatgattcgaagtaaaatcagcaaaaggaaaaggcacacagggcaaagtgcagaggaaaccaggcacaagctttcaggagtccatcccccaatggagtcacacaggatgcacataaatcccctaggaatgagttgggacaacacatataaaatgttgtctgccaagaaaactcattagagactcagtgtccaaggttcttattgtgggctcatcatgtagacaccttctgcctagtgtgtactaaaattacagactcccagaaggaaagcaggtatttagcataaaccacattgtttgtacaggcagtctggacacagtgagccactcttatcagggaatagtgggggaaccctcttgagaaccaagtttcaagatgccagtcaaggggaaatatttccagcaggtttttctgagaacagcaatttcaggcctgatacgataactcttttctgtatggtatgtaaactcattcaaccattctagaaagcacctgggtagtatttataaatgttaaggatgtgtatgaccttctggttccattcttgaatgtatattccagagaaactctcacagaagtccacaagggagcacatacaaggctgttgttgattgcatggcagtgtcgtatgtgttggaataccattagaagcaacctaggtatttatcaccagggagatatataagtggatggggtttgcttattgtgaggtattatgtagcaacaaaccgaagactagatgtatgtaccttatagcaacatatatcagaaacatagtattgaatggggaaagtagaatatagaatagtggttctcaaccgggggctgccctgtacattgtaggatgtttaacagcattcctggtctctagccactagatgtctgtagcaatgccttgctacccagttgtgacaaccaaaaatgtctccagacattgacaaatgtcccctggggaaaaaaaagaatcacttatgttttgaaatgataacatacttttacctttaatctgttaatgcagtgaatttggattgaatgattttcatatgtgaaatgaacattgtattactgggatagaccccacttaaacactgtgtgttatctcttttaatgtattattttaccttttaaaattaattgtttacccttttattagttctagaatttcatttttatcagctttacgtagatataatttacatacaataagattcattcattttaagtgattttaagtgtatactttaaggagttttaacaaatgtatatagttgtgtaaccaccataataatcaaaatataggacatttctataactccacaaagtcctcttatctagacattgcaaacaatctgtgcccctactcctggctactggcaaacattgatctcctttttatttgaaattttgctttttctagaatgtcatatatgtgaaatcatacagtatataatcttttatgtttagcttctttcatttaacatagtgcctttgatatccatccatgctgttgcatatatctttcgtttatccttttttattgcttagtagcactccattgcatggatataccacctattcacaaattaatggatatttgagttgtctccagttttgaactctaatgcataaagctgctatgaacattctagtacaatattttttgagaatatatgttttcatttttcttggttaaggacttccagggttagggttgctaggtggcatggtagattttttagcttattagataatgccaaactattttccaaagtttctataccattttgcattttcactactaatacgtaagagttgaagttactccacatggtcatcaacacttgatattatcagtatttttttttttttttggagacagagtcttgcttcgttacccaggctggagtgcagtggtgcaatcttggcttgtagcaacctctgcctcccaggttcaagcaattctcctgcctcactgtcccaagtagctgggattacaggcatgtgccattacacccagctaatttttgtctttttagtagagatggggtttcaccatgttggccaggctggtctcaaactccttacctcaagtgatcttcccacctcggcctcccaaagtgctgactgggattataagcgtgagccatcgtgcctggccagtcactatttttttttttaattttcgccattctaacatgtaggtgtgtagtggtatctcattgtaattttaatttacatttccaatgtatagtgatgttgagcattttttcatgtgtttatttgccatctatataaaaactggtgaagtgtctattcatgtatttttcccgttttaagtgtattgtttgtttttttattgtttagttttgagagttcttttattaaaaattaatatgtaatttacttatttatggggtacatgtggttttttttttttttttttgagatggaatctcactctgtgacgcaggctggagtgcagtggtgctatctcagctcactgcaacttctgactcccgggttccagcaattctcctgcctcaacctcctgagtagctgggattacaggcatgtgctaccacgcccagctaatttttgcatttttttagtagagacggggtttcaccatattagctaggctcgtctggaactcctgacctcgtgatccatccaccttggcctcccaaattgctgggactacatgtggtgttttgatacatgaatacaatgtgtaatgattaaatcagggtaattgggatagccatcatctcaaacatttatcatttatttgtgttgggggcattccaaatcttctagctattttgaaacaagcaattaattattgttaactacaattgtttttataactattttgaaatatgccattaattattgttaactgctgtgatatcaaacactagaacttatttcttctatataactgtagttttatacccattaaacaacctctcttcatccttctctccccacaaccttcctaacttctggtaactactactatactctccacctccatgagatcaactttgatagcccctactcacatatgagtgaaaacatatgatatttgtctttctgtgcctggcttatttcagttgacataatgtcttccagttccacccatgttgctgcaaatgacaggattttctttttatagctcaataatattccattgtgtatatatagcaacatgttcttcatccattgatccatcagtgggcacttaggttgattccatatcttggctattttgaatagtgctgtgataaacaagggagtgcaaatatctcttctgacatattgatttttcttcttttggctatatacaatatatacccagcagtgggattgctggatcatatggtacttctgtgtttagttttccataccattttccataatggctgtactaatttacattccgatcagcagtgtatgagagttctctgttctctgcatcctcttcagcatttgttattttttgtctttttgataataaccattctaactgcggtgagatgatatgtccttgtgattttgatttgcatttccctgatgattaatgatgttgggcatttttcatatgcctattggccatttgtatgtcttcttttaagaaatgtctgttcagagcatttgcccacttttaaatcagattatttgtgtttttttgctattgagttgtttgagtcacttacatattttggctattaatgttttgtcagatggatagtttgcagatattttctctcattctgtatgttgttgcttcactctgttgattgtttcccttgctgtgcagaagctttttagcttgatataatcccatttgggtatttctgcttttgttatctgtgctttagaggtattactcaatagagtctttgtgcatatcaatgacctgaggcatttttccagtgttttattctagtagttttatagtttcaagtcttacgtttaagtcgttcatctattttgattttattttttcatatggtgagagataggggtctagttttattcttttgcatatggacatccagtttgtccaagaacataagttgaagaggctgtcctttctccaatatgtgttcttggtgtctttactgaaaatgaattggctgtaaatgcatgggtatattttgggattctctattctgttcaattggtctatgtgtctgtttttacttcagtaccatgcttttttggttactatagctttacagtgtattttgaagttaggtagtgtgatgcctccagctttgttctttttgctcgggattgctttggctattctgggtcttttgtgggtccatatgaaccttaggatttttttcccatttctgtggtgaatgtcattggtattttgatagagattgcatttaatctgtagattgcttttggtagtatattttagcaatattaatttaacaatattaatttaatattaattaattgcatttaatctataggttgctttaggcagtacattttaacaatattaattcttcccatccatcaatatgggatatctttccctttttgtgtgtagttgtcaatttttttcagcagtgctttttatttttattttagagatctttcacttctgtggttaaatttattcctatttttttttaaatcctgttttaaatgggattgcttttttggtttctttttcagattgttcactattggcaaacagaagtgcacctgctttttgtatgttgattttgtatcctgcaactttactgaatttgttgatcatttccagcatttcgtgtgtgtaggtagtctttaggtttttctaaatataagattatatcatctgctaacaaggataatttgatttcttccttttcaatatggataccctttatttcattctcttgcctaaattgctctggctagaacatgcagtactacactgaacataagtggtaaaagtgggcattcttgtcttggtctagatcttggaggaaaggcttttgatttttttcctgttcagtatgatgatagctgtgggtttgtgatatatggcttttattattttgatgcatgttccttctgtacccagtttgttgtctttttctcatggagggatcttgaattttatgaaatgctttttcagcatctattgaagtgatcatacaggttttgtccttggttctgttaatgtaatgtatcacgtttatttatttgcatatgttgaaccaaacttttgtccctgggatgagacccacttgatcatcgtgagtgatctttttaatgtgttgtttaattcagtttgctagtattttgtttggaatttttgcatctatgtttgccagtaatattggcctgtagttttctttttttgatgtgtttttgtctggtttgggtaccagggtaatgctggcctcatagaatgagtttgaagtattcctcctctttacttttttgaaataatttgcatagaattattatcagttcttttttaaatgtttggtggaattcagcagtgaaaccgtaaggtccttggcttttctttgatgagacactttttattactgttttgatcttgttacttgttattggtttgttcaggttttctatttattcatggttcaatcttggtacgtcatatgtatccaggaatttatccatttcttctaggttttccaatttgtttgcctgtagttgttcatattctctgtaatgatcctttgtatttttgtggtatcagttatattctcccttttcacctctgatttcatttatttgagtattctttttttcttagtctagctaaagatttgttgattttgagtatcttttcaaaaaaaacaacttttcatttcattgatcttttgtatttttcagccttaatttcatttatttctgctctggtgtttgttatttatttccttctactagctttgggtttggtttgttcttgccttcctaattctttgaagtgacttggtagattatttatttgaagactttctttttcttttttgatgaaagcttttattgccataaattttcctctttgtactgcttttgctttatttcataggctttagtatcttgtgttttcattttcatttgttttgagaaatttctattttttaaaagaattttgttatttacccactgatcattcaggagcaatgtatttaatttcggtgtatttgtacagtttcttaagtgctcttcttactgatttctagtgttgtttcattgtggtcagaaaagacacttgatattaatttgactttttaaaatttgttgagatttgtttatggcctaacatatggcctgttttcaagaatgttctatatgctgatgaggaaaatgtgtagtctccagcagttggatgatatgttctgttattttcagttacgtacatttggtctatagtacaactgaaatccagtatttctttgttgatatcttgtctggataatctgttcattgctgaaagtgagtgttgaagttccctattattatggtgttgtagtctgtctctctgtttaaatctactaatatttgttgtgtatatttgggtgctccagtgttgggtgcatgcgaatttataattgttatatcctgtagctgaattgacccatttattattatataatgacattctttgtcttttcttacagtttttgacctgaagtctgtttcgtatgatatatgtgtagccactgctgctcttttgtggtttctatttgtacgcagtatctttttccatcccttcacttttagtctctatgtgtcttattcactagaaattcacttaaagaagtgaacttcttgaaggcagcatatagttggatgctgttttttttaatccattcagccactctcttttaattggagaatttagtcccatttacattcaatgttatttttgaaaggtaaggacttactactgccattttgttattattttctgattgttttgtaactcctgtcttccattattttactactatcttcctttgttgtttagtgatttttctctggtggcatgtattaattatttgcttttgttagtgtatcttttacaggtttttgctttgatgttactgtggggcttagaacatcttattataaactgatgacaacttaactttgatcaaaagaaaaattaaaaactaaaatctctaaaatttaagtccattacttccccattttaactttttgttttctcagtttacatctttttatattgcctatcccttaataaattgcctttttgttttgttttgtttttgagatggagtcttgctctgtctcccaggctggagtgcagtggcacgatctcggctcactgcaacctctgcctcccgagttcaagcgattctcctatctcagcttcctgagtaggtgggattataggcacgtgccatcacactcagctaatttttgtattttttagtacagatggagtttcaccatgttggccaggctgaccttaataaattgtcattatttttgatagatttttttcagtcttcatactaaagttgtgaacggtttacacaccacaattcagtatttgtctgcatagtttattctgaatttgtctatatacgtttaccagtttattttataacttcaggtgttttcttgatacatattagtgttcttttaagattgaacaactggcttcagcagttcatgtaagacaaatcttctgttgatgaattccctcagcttctgtctgggaaagtctgtatctctccttcatgtttgaaggatggctctgctgggcacagtatgggaggtttttttgttgttgttgttttgtttttttcattcagtactttgaatatgttgcccccctccctcctgccctgtaggacttacactgaaaactctgttaccacaggaattgaaactcctttatatgttatttgcttcttttctcttgctgcttttaagatttccctctttgtctgttaacctttgagagtttgattattatatgccttagggtaatcttatttagattgaacatgtttggttgtctttaaccctgtacctggatatttatatctttctctaggtttggaaaagtctctgttattattactttgaataagctttctaccttttgttctttctcaacatcctctttaaagccaatgaccctttgacttgctcttttgaggctatcccctagatcttgttggcgttcttcatttttctcattattttttctcttcttattgtgtattttcaaatagtcttagggctcaccggttctttcttctgcttgatcaattctgttgttgagaccatcccatgtatttttcagtttgactattgtatttcttagctctaggatttctgtttaattttttaaaatttcaatttcattgttaaatttctgtaatacatttctgaattgcttttctgtgttacattggcattttctgagtttcctgaaaattgctattctgcattcttgatctgagagctcacacaacatcatctcattagggtcagtcactggctccttattttgtctatttgggaatgtcatggtttcctgtttgctctttctatggatatatgtctgtgcatttgcattgaaggattagttctttattccagtcttcactgtctggcttggtttggtctttcagaagtatgtctgtctagaggttttgtgcagagtgactatttagttcccttagcctgagatcactgcctccttttcaacactagatggcaccctgaacccagatttgacatagtctttctcaatttcagagtgctactcatcctggatggggaggaatcccaaagataccccagctctgtgggaaagctggatggaggtttgttcccagaggactgatgaagtgtgcttcctgcaacgtgatgctgttaaacagcctttctgatttggtgtcttttttgaggtcagatgaagggaagctggagtttcatgcactgggtgttgctaaccccacccccaccctctaactctagctgcctttgggattttttactctgcaggcattcaagaggcttcttacaggttgaggcaggaataatttttctggaaaggaatctaagatggtggggaagctagctgtccacttttattttttccagtattataggaaccttgattttgagggtgcctttctacacagtgcctggcagcttggggaaggagctattttaccttttgcttgcagtttttcagttctctgtggcctctgggattgtcacaacttcagtcattgagttctggaatattccttttgataatctgggcagtggctagttctttttggttttctgtggaggagagtaaagctacatatactgtgctattttggtgacattctcagttatgagaattatatattttgttaacaagtcctttgtcagataagttatttgcagacattatatcccagtctgtggcttagcctttcattttcttaactgtgtcttttctaagttgtgcatatttatggagtatgtgagaaatttttaacatatgtataatgcatagtgatcaagtcgggttttagggtacaatgcattttttttaagtatagtcatcctactctgctattgaacattgaatgtattccttctatcttatgtttgtaccctttaacccacttatcttcatgttctcccttctcacctgctcacacttccgtctctgttatttttccaccctctacctccatgtgttcaaattttttagcacccccaaataaatgagaacatgtgatatttgtctttttgtgcctggcttatttcacttaagacaatgacctctagtttcatctacgttgatgcaaatgacataatttcattctttttatggctgaatactattccattgtgtagaagtaccatattttctttatccattcatttgttgatggacacttagattgattccttatctttgctattatgaatgttgctgcggtaaatatgcaagtgccagtattcctttgatataatgatttattttctttaagtcaatacacagtaatgggattgctggattgaatggtaattcgatttttagttttaagagtatcttaattttattgaaatccagtttatcgctttattttattttatgggtcatactttttgtttcctactttctttgcctatctcaaaatcataacggttttctacttttttaaaaatagaagttatatagttttattttttacatttaggcctatgatcccttttgtggtaatttttatatatggcacaaaatacagatcaaggttaattggtttctgtatggatatttgttaaaaaatactgattcccctattgaattgcctgggcacctttgtcaaaaatcaattaagcatatatgtgcagatctatttttaggtatactcttctgttctagtgatctatatgactattcttgtaatagtaacccactttcttgattaatataggttcatagcaagtctttaaatcagatagcataactcctccaacttagttctttttcaaaacaattttagctattttaggttatttgtatttctatataaatttaagaataatcttgccaaattttaccaaaaacaagcaaacaaaaaccctatcagtgttttggttgggattgcattaaatctgtggatcagttttgggaacattgatatgatgagtcttcaaatccatgaacatttaactgtttatttcgatttttttgtgatttctcccaggattgttttttagttttcattgtatgattttgaccttttaaaatttgattgttttaaaaaatatttaaggtataaatttaagatgtacaatgtgatgttttgatataaatgatgaagtgatgactacagtcaaacagattaacatatcatctcacatagttacttttttgtggtaatagtatctaaaatttactctcttagcaaatttccagtgtataatacaataatgttgactctagtccccatgctgtaggttagatctctagacttttcctgtgtaactacaactttgtgccctttgacttatatcttcccattttctcccaccccctcacctctggtcaccaccatcctaatctgtttctatgtattcattttttttttccttttgattccacatataagtgaaatcatgcagtagttttctttctgtgactggattatttcatgtagcataatgtcctctaggttcctccatgttgtgacaaatgacataatctccttccctccttctttttaaagtctgaataatattctattctgtgtctctgtatgtatatgtaatatatatataaataaattaaaaatagaggtaatttattaaaatataggcaacatattacatatacatatacacccgacagtttctttacccatttatccattaatggacactttgtttgcttccacatcttggctattgttaatagtactgcaatgaacatgggagtgcagatatctttacaaggtagtgagtgcatttcctttgggcatatactcaaaagagggattactggataatttgataattctatttttgatttctttgggaacatcttaaaggtattattttccacagtggctgctgtaccaatatatattcctactaacagtgtacaagggtctccttttctctaaacccttgtcaacacttgttatgtcttatctttttgataatacccatcctaatagatgctaggttatttctcattgtggttttgatatgcattttcctgatgattaatgatgttgagcatcatcgtatacctgttggctatttttatgtcttttttggaggaatgtctattcaaattctttgctcatttcttaattagtttatttgtttatttgtttttttttgctgtgaagtgatgtgagttccttatatattttgaatattaaccactttatatattttatatatattaaccactttatgtatattttgaatattaaccactttacagtttgcaaatattttcactcagtctataggctacctttgcatgttgttgactttttttttctgcatagcagctttttaatttgatgcagtcccacttgtttctttttgcttttgttgcctgtgcttttggtgtcatataaaaaagcacagcagtagtgcttttagtagttttattatttcagctcttatgtttcagtctcttatgcattttgagttgatttttgtgtatggtctaaaatatgggcccaattttgttcttttgcatatagatatccagtttttccaacaacatttattgaagagactatacgttccccattgtgtcctgttggtgctcttgtcaaaaattagttcactatatttgcttcggtttatttctggactctctattctattacattggtatatctgtttttatgctagtaccatactgttttgatttccatagttttctaatattgtttgaaatcaaagagtgtgatgcctccagatttatttttatttctcagagttgctttggctatcaagggtctagtttggttccatagaaattttatatatgtttttgtctatttccatgaaaaatgccattggaatttagataggggttgtgttgaatctctatatcactttgagtagtagggacattttaacaatattggttcttccaatccttgcacatgggaaatctttctatttctttgtgtcttcttcagtttctttcatcagggtgttttggttttctgtgcacagatctttcaccttcttgaataaatgtattccttaagtatttcattctttttgatggtatcataaatatgattttttaaaatttctttttttgatacatcattataggtataaagagtgcaactgatttttgtacactgattttttttttgtatcctgcatctttactgaattcactttttctaacaggtttttttctttttaatttttggagggagtcttttgggctttctacatatataatcatcttatctccaaatagggctagtttacttctgatccaatttggatgcattttatttatttttcttatctgattgccatggttagtatttctagtactattttgaataaaattggcaagggtgggcatccttgtcttataccagatcttagaggaaaagctttccatttttcaccattgattatgatgttacctgtgggcatctcataaatggcctttcttatgctgaggaaatttttaatattaatacctaatttgtgaagatattttatcctgaaaggatgttgaactttgtgaaagctttttccacatctattgaaataaccgtgtggtttttaaattattccttttgctaatgtaatgtatcataataattgatttggatttgttaagccatacttgcatcccagggataaatcccacttggtcatgatgtatgatctttttgatatgttactgaattgggttagctactattttattgagaatctttatacctatgatcattagtgatactggcttgtagttttcttttcttcttttttttttttgacagagtctcgctctgtcacccaggctggagtgcagtggcgcaatgtcggctcactgcaagctccacctcctgggttcacgccattctcctgcctcggcctcccaagtagctgggactacaggcgcccgccaccacgcctggctaatttttttgtatttttattagagacggggtttcaccatgttagccaggatggtctcgatctcctgaccttgtgatctgcccacctcggcctcccaaagtgctaggattataggcgtgagccacagcgcctggcccttttcttgtatttctgtctgactttagaatcatttgggagtattccctttagttcttttatttatttatttatttatttatttatttatttatttattgaagagtttaagagggattgctactaattcttatctgggtatttggtagaattcagctgtgaagccatctggtcctatgatcttttgttgttaggagattttaaatgactacttcaatctctttatttgttaatgttcaggctctctatttcttcttgattcaatcttggtaggttttatatttctaggaatatattcatttcctctggtgtttccaagttgttgtcatataattgttcataatagtcccttgtaatccttttcatctctgagacatcttttgtaatatcttcatgttcatttctaattttatttacctatattctttttctctaaaaaccaagtcttagttttgttgatttttttccctaagtttttctgttctctgatttatatctgctttgatcttttatttttttccttctgctatctttgagtttactttgttcttctttttctagttccttgaggtggaatatcagattgtttatttcagattttttttaatgctatcaacgcccctcttagaactttttttgctgcatcccaaaggatttggtatgttgtgctttcaatttcatttgtctcaagatattttttaatttcccttttgattttttctttgacccatttgttattcagggatatgttgtttaatttctactgatttaagaatgttctagttttcttcctgttactgacttgtagttttatatcatcatgaccagaaaagatacttgatatgatgttgatcttcttaaatttgctaagacttattttgtggtatagcatgtggtctattctggacagtattccatgtgtgctttagaagaatttgtgtgatagcctgtctgcgtgggtcagctttggtaacatgtggtagtgagactagaatccctagtttgggaccctagggctgtttgcaggtacatgcatggtagctgtgctgggtcactgggccagagcatccaaggaggtagtacttgcttaagtacctagagaatgcaaaggctcctgtgctgagtccctttgccaaggcacctgtggtaggagtagctcaggcagctctgggcatgggggagggaaagctctggtggatcagggatctggagaatgtgaaagctgttggcctacatcaccccttcccactgggctatagtaaccacagcagcagttgggcagctctgggtggctccaggaagtagagaagaagaagggacatggctcaggcatgttttttgttgttgttgttgttgttgttgttgtttgtttgtttgttttttctcctaaaactcaaaaggaagaaaaaacaacccatggacccttagcagtataagctgcagggcgtctgctgatactatactagcagttggttttctcagcaggaaaagctgaaaaagcttctggggtctgtgactgtgaacactgaagaatcttgagaggtaaaatctacaggaggtacccagtggctatgagggctattgaggtccttgacagagaggcctactggggccctgtgccaaagaggccacggcagatcactgcgactcctgctactttgctgatactgatataaccaatccctattctttgctctctgctgtttccagacatctaggctatatctgtcttttcagagatctgggtgggatgaaactgaagctggtcattagggcagtgtcccataaagctggggaagctggttgtacactcctgtctcctccctgtatgtaggacacaagatccaagatccaagttgctgtttcataatgagcagtaccagctatggggacggggtgatgcaagcaaaatgaaactgtttttcctactcgttttgtgtatttgttttctgactttttctttcactatattgctgtggcttcttaagtggacccctaagcttttccagaattattttttgttcatggatagctaccaaattgttgttgtttgctgaagaaaggaaggcgatatttcctactctgccatcttactgacatcctctcctaaaagttgatttctaagtatttaaaattttttcggctgccattgtaagtggtattttaaaatgtcaatttcctatagtctattactattacacaggaatacggttgatttttgtacattgactttgtgtcctgacacataaccaaattcactaattggttccagtattttttttgtagatttcttaggattttatgcatatacaattatgtcatctctgaaaaaaagagtttaatttcttcttttttcagtctatattctgtctatttccttttttatcttatttcactggccgggatatacagtacggtgttaactagaaatggtgagaacaggcatctttgtcttgttttgatcttaggggcaagcattcaatattttaccaagtaattagcttaacgtttttcatgggtgtcctttattacattgtggtagtgtctttctatttctagtttgctgatgtctttgtcataaatttattttctcaaatgcttattcagcattattgaaacgatcatgtaatttttctcctttaatctgtcaatgtggtaaattacattgggataagtctgtcctgatcatggtatattattctttttatgtgctattttgcttgtttttcaacccttatataacaactctatcttgattttttgttgatcagtttctattgcctattgtttctcttgggttttataaatattttctattctaatgtatcaggttatcttttattaagtacttgtcaatatataataaaaattatagagtttttttaaaactttacttggaattaatttcaaacttatggaaaggttgaaaaataagaaccatacaaaaaatacccagattcccctgttgttaacattttaccattttgtcttatcatttgagtgtgctctccctctctctcctgactctctcctcttcccctctctttatgtacatatttatatgtccatacatacatatacacacactcatacatttttttctcagccattagtgttttaacttgcatacatcttagattccttacctctaaacacttcatcacattgtgtttccttagggacattttatggagataatatcaggctctggattgtgtgattccttcaaacagatatttatttatatttttagcttttccagctactctcagtggcagggtttgcctgcaacaacttagtctgtcattgccagaagtagagtcactgatctcttgctttttgtgatccagtcccagagttttatttccatgctgtgttttactcttattagggccagtgttcccttattacccttcttttacagaatgtccctactattcctatgtactcatttttctataagaaatttacagtcagtttgtcttgttactgaataatttgttttgatatttattattaaattatgaatcaatttaagaataattgactcattatcattttaatatttctgcctaagaatatgatctgtctttccattacttcaagacttcttttggggtccttggtagacttttcctttcctttttttcttttcccacagcaagatggattctggatatactctgagtattgtaacaaccacctggatgcttgcatggagctctccaaactgatgaaggacagccgctaccagcacttctttgaggcctgtcgcctcttgcagcagatgattgacattgctatcgatggtttccttttgactccagtgcagaagatctgcaagtatcccttacagttggctgagctcctaaagtatactgcccaagaccacaggtaagggatcgagggagtcaggagtgaatgagggaacttcctctatctgttggttctcattgagaatacatgtccttttgccctttctgagcttctgttaacttatctgcaaaacaggatgatacattcttgattgcctcatagccaacagggtacagaaggcagagctatcactggctttgttactcacacaaaaggagggtcctttgccactatatttgggttaaaatctgaaatctgcctagggctccagaaccactaaagcatataagatatgatttgttagagaagcagcatcaatccaaaaacgaacccaaagatgtaaaccaaaccaactggcccacacccatggctcatgcatctgggtctgaaagttagccccaaggagaccaagcaatggagctaaatcatacttgtggactgataatattcactaggtaaattatatatggcataattcatcttaaaagttccagaaaaaagtttttaagcatagctcaaagctatgttagtttcttaggccaaaacaacctcagagctttttgggggtttggtgggcaccaaaaagataggacattcgcctgggatttgccatttctgtacactttcaccttgtgactggaactcctgcttcaaagtcctcttgccatctaggtccctgattccctctcctctcaccccttgcgctccagagtgacagtagagtagctcaggcagtgtcaggcgacatcaatttctgccctttctcagagtgacccgttgggcccagcacaactcccacgacatagacaaccccttttggcaggtctcaggaatctgtattaagatgatggctcctgccatgcatgtcaagagtagctcggatttgaaggcaactaaaggctgatgccagcttggaagcttagtaagataggtgttcagataggtagggctgaaatacaggcagtcagaatggcccctgagggagaagattagatgaagaatgataaatagagaagaatactgactttgcttacagatgattgatataattccctaccctaccttccttaagttgatgagaatgaagactgcatgtaagagggaggctagctgacatgtctggaagtagaaaatctttgttctgttgttctccccaataagaggctgggcccagacctcatctgagggctttgaccagggttaggctggaccacagctattcctttcttctcctgccgactgctaaaactagtaggacaggttagagatgggcacattccccctctagccattttgagaaaggcagccagctaaagatggcaaaaataggcagtatgggacactgacagtgaggaatccatgactgagtagtcttggtgtagaggaaatgaacattgtcatgccaggactgcccagtagaactttctgcaacaatgcaaatagtctatatttgtgttattcaatatagtagttacccaccacatgtgactacttgagtactaagaaacatagctagtgcaactgaggaactaaattttaaattttacttaattttgattaaatatggctaatagctaccatgttggacagtacagctctgtgctttacttccaagaaagtggtttagagcactgatctcctcaaatcagagaaaggaaaggtacaggggcagaaaatgggtccaaagagcaggagcacttacttatgttagcagcttctgtgctgcaatcttcccttctgtcaccactctacctccttctaagtgtcaggctcagacatcttgccaaggagaaacttcggtgatgtcacagagcccaaaagatccccatacattggagcaactaactgtaaaagaatgaaatgtaacagaaacaaatgtagagtgtttccattgggtctaagataagaaataaatagctcacggacaggctgagagagatacagcttctagagtgtgttttgaagagacttaggaagtgttagttggccataagctcaatatgggtcagcaatgggatccagaagaaaaactgataatagctaacattcactgaggctcagaataaagacttttctaacatatttgtcttgagacagaatagactggttaggaagtatagtgaaaagcctttcactggaggtgataatgtaacattgtttgagagccatggctctgacaggtgtgcagatcacagattggagtgagggatgtgaactaggaggaggtactacgtaggatctgccctggcaattagaagtccctttcctctgcctttctttggtccatcaacccactattcaatgttgtgggtgtgcagttgtgcagttgtgcaaagatgtgcggttgttgcacatctatttttttctccttccttttttaaaaaatggtactgagagattaagcagactagtgaccacaaggcattttcagtttctctaaagaaaggtgttaacactgaactgtaaggcatcctcttgtcttctcagtttatttttgcccccactgaatggctgagatctcactatcaatctgcctttcccaagagccatttgattgcaaatcagaaaagaacagcagaaaaaaactggataggatatgtaactctcaacacgtctgctatccagagtcccaggatgtggggccaagggttacacgtctgagactaggggttttaagaggcatcccatgtgatggctctactacggaaatgtttgatttgtaataatagtactgctaacatttgttatatgccaagagtaaaatagtttacatggatgattgtatttaatttatgaaaccttcaataaactatacttttccccattttacagatgaggaaattgagtcaatgagagagggagtgaggcttgccaaaggccatactgctagtcagtgagaaaaactggcatttgatcccacaaagtctggcttcagactttatgctcttacccactgtgctacattctgtttctatattgtgcaaaagcaaacgtgaggatatttcagagtgattttgggcagaagctccatagaaatagatgatggaagagatgataaggtggtctatactgtgtcatgtgtgaggctcccttcttggtccttggctggctgtatcagataggacacaaaaaaagtgatgtaacaaaatagtggtccatttgtctctcatgtaaaagaagtatgtattctgaagtttatgactggtatggtggcctcatggtcatcagaaacatgagcaccctacagctatctactatcctatacctagggtattgaccttgtccttatggtccaagatggctaccagaggttcggccatcacatcaacattccaagcatcaggattgagtaaaggctaaagaagcgtatgctctctaccttaaaggtgatttctcagaaggcctacctgatagagcaggagcaccgtcatcttggacaaacactgccacttcaagttccagctccctttctagcctcatgcatttcaaggaaatcacttcttttctaactacaagcagccagaaagagcagacagtaagagagctcaggcacagaaggaggtaggggggaaagtctcttgagtaactgccaaacttcaccctcatacaatgggccccagtaaaacagtgggcgttaataaacacattccttttccttcaggtgcactaagatagagaagatgaaagcagactcaggggatatgcctgcagctgcaaaaagatgtatgggaacagacacacaactctctcttcccagataagcacaacaaagaggcgcaaaagcagtctatgcctctgataaagtctcccaccctgaatccttaaaaactcttagtctgtaagaaagtgtggctctgacctaactcggccagccgctcctctcaggtttatttaaaatcaacctgtccctgttgactgaaaagccatccttcatgtttctctcctctttctttaattcttacactacgcaacacttctatttacatatcagtgtacaaaacttacttgcatagtcatttttgctgaaacaaaagatagaaaatgtagtctttaggtggtgtgggttcccatctgaaaatcaggactctgttactaaggaggtagaggagagtggatgttaagattggcacctagcacattggttctttggcacattggttggttcaacttgcactcttttgttttcacagtgactacaggtatgtggcagctgctttggctgtcatgagaaatgtgactcagcagatcaacgaacgcaagcgacgtttagagaatattgacaagattgctcagtggcaggcttctgtcctagactgggaggtaggaaacttaccaaccagggtattgggaaatctgaatagcttggcaaaagcttcccatcttagctaaggacaggtgaagagaaattacatttgaagagcaacagtaaggatttagattagactcaaggtaaaatttcttgctaatgagaagtgttggatacttgaataactttctaagaagcttggagaaatttttgtgatgatacctcattaagaaatgaaaggttcatttcttcaggtattgccaaggaacaattagggttgattcagtagcctttcaaagctctttctggatttatgaccaacagattcacacttagataagaaatagtatatactaatttacttccagacacagaatacgaggttggttctcctgttcccaaccatgcaggacagccaacatacttttttttttatcggtgataccacctcaccctagcacatctattaggtctctctattaggcctgtacactataggccacaaccatcatccctgccaaatccacagttttcacatctgtttttaaaataatccctgattatttcattgcagacagccatgacttctctgaattctgaaagaccttcccttcctagatgcccaccaaaagtatcaggagtaatgacatttcacatatgtcttgcaggcccaggttgtgcaatctgatagtctgctggctaaaataaccaagataggagaggctggacgtgctactagggagggattagcaatcttaagccttgtggtcacaatatagaggtagggtctgctccctattccactgacctcaactcaagtgtcattttcagtgattaagaggtagtatttctcttaatacttaaagtattttagcccgttccaagggaaccaagcatcatcctcacaaacagctgcttaaccaaggcccagaaaaaagtcactttccttttattctgctacctctgtcctaccttaatgtagattgctgaaaaagaccacaattctgatcagctgacatccttttgggctatatttgaaggataatgttcccatataagtagaacagcactttgatttgcagagaaaggaatttgtctagatgaagagaccctcattctcttaagcagaagccagcactgggccagacttactagaaaattgtgggtccttttttccttgtgttggcattgctttggccatttgcctgattaaaggcagagagctggaccaaatgacttctagcaagcccatcaactctaagacactctaaaattaaggtggattagctggccttattctctctcgttggcagggttttttgtaagagaaggtgcccagcagcagttgtcttcctattccctggagcatctccccaacttcccaatgcctagaagactttctgattcccctgtgtgctctgggacatcagtccttggagcaggagccatggggaaccaaaaatagcatgaaattacctggcctactcagggagcttcagtagcaccaagctcaataacactgagctatgatttaaacactcagcatctcagaaggaatttcctgcatgtatgtctgaatggggccacaaaaacacagttctaacagtgtctgcctcctttattagcctgattgattggtactctaatctcatgtaagcccacacatcccttgtacgctcctgcttggtgaagcctttcttcatctaaattgacatcctacttcattcaggctgctataacaaaataccatagactgggtggcttataaacaacagaaatttatttctcataattgtggaagctgggaagtccaagatcaaggaaccagtagattcagtgcctggtgagggccctcttcatagactgttgtcttctcattgtaacctcacatggcagaaaggatgagagaactctttggggtctcttttatgaatgctattcccatttaattcatgactgcctcattctcatgaccatcatcccccaaggccttacctccaaataccatcacagtagagattatgtttcaacatgtgaattttatggggatacaaacattcagcctatagcaatttgtaagaagaaaaattcttcatggtcttcttgtcagactgaggtcactgtggaacttgccagttccagcgaagttgtcctctaggaagtcttttctctagtaaagcctgatggatatatttcaaaggccaagcctaaagtttctgtcatatttgccatacctgtgttaaagacttctagaatgtcagaatcaccaaggctcttagaggactccccctacaaccctgacgattcttgtgtgtatacacatgcacatatgcacatgtacacatactctcacacacttactctcaaacaccttgcaatgatggtgaaagacagagaagcagagagaggtttatttcctaccaaggccacacagcaagtcagtgacaaagctggaacttgaatctagtcccctgattccttgtgtggtattgttttcagtaaggtaccacatattccttcaaccttctgcctctcacagcccaattgctgttctttgtgatatttcagcgacttgctttttgtatgtagtaaagagtttatatttaaataagacagtgagactaccttggggaggtcatccaaatcccagtcaggtggtgggtgagtgctggggagtctccccaagaaagcaatgagacatggatgctccatggcttgatgatggttaggattggtggcccaatttcacaggttccctggtataggttctttgtgcattccacctgcccaagaagttgtctaggcaaggagagacattctgccagattgccgaggactgctgtgaacagaccgtgcaaatcaagaaaaagatgccatattttgctgtctctgccaccccccttgtctcccagatgtttgaacaaacagagtggctgtcaaaagcatctgcatgataatttcagcttcatttgtcaaatgaaaaagaggagtcataggggaaaccttcagagcttaatctcccttgaagaggaatttggagggtagcatgcaggcaattagtgtctgctcaatagatcagagtgtctggctagagagcaggaagccctgcattatatcaaggcctgacccttctcttagcttattccgtgaacattcttggtctctttgcccaactctggttattatccctgccctctaccattctatagggactagagttcctgaagtaactttccttttaccccaccccccagggctcctgaaaatcaaatggatgagtaaaagtgtcagtcatctctctactaatcaatacattagagcagtatgcgggagcagcagggagaataatctgttcccagggactgcagtttctgggaaatttctatttctaatttccatgatgctgaggtttggttgagctgtcactttgccaccttgcacactcatttaatccacttgaaaacaagggaaaggtaacatatcctggatagcttctttttaatctttttttttttctggagatttgtagcaggaacctaacattgtagctcatatttgggagcttgattgtgtgtggttgtaatttcctctttgtgggatccctctcctcccagcctggttgtgtaatacccaaggacctgttccactttgctatttgatgactgaatccaaagaagttggaggaaacaagaaaacccaacatgatgaaggcagcaaaagcatctacttaaaagctaaagtggcttgatgaggcatactcctgggacaagaagatcaaatgtagggctagatggatttgttactcctctgccttcctgtcagtaggcagcattgaaaataaactagttaaaaagtatggcattccccttgtcctttccctggatctgctcagattacagccccacatcaattggcctataattagaatggggtgaaatcaggcagaatggggtgaattagaattagaatggggtgaggcctcttcgctcgggctctgaccccaaggaaggaaggtagataagctggcaagaaagctttgggtagtttttggtggccactgttcattccacacctattgatttagttgtcaaacagtatttattgagtatttaaatatcaagtactctgtgtcagaccttattctaggttctgcaaagacatcagtgaacatgacaaagtttccactctcattgatttatattccagtagggaaaagaggcaacaaacaaacatatatcatcaggtagatgggcctctgaagaaaaataaagtaggataacaggttagggagtaatgtggatactacctgaggaagtaacagttaagaacagacctgaaggagaggaaggagcaaaccatgtggttttcttggggcacagaattccagacagaggggaaaacaaacacgaagaccctgaaatataggagtgtgtgctaaaggaacaacacggaagccagtgttgttactctacccagagtagagtaagtgagtgagagagtgggagcaaatgaagttagggaggtgactggaggtcagatcctgtcttcataagactgactgttagtttgagtgagatgggagccactggagggtttttgagcaaatacgtgaaattatgagacttatgttttgaacatttcccctcatatgccaggccctatgctgggcaatgaggatattgagatcaatgagatgtggccttgaacatctagtgcggacaaacatattccagcagagggaacagtgtgagcaaaatcctggagggagtgaacagatccaaaggcccacggttggggatttttggaaggagttgtacttttgggggcaagacaaagagatgtgttatataagtggagcagaggaagcaagggtgagatctctaaacaatgagagggctgtctcctttccatgaactcatttgacgctctcaaacagccatgtgaagtgggtcaaacaggaactgttttaatattccccctctacaaatgaggaaacagatggcgagagtttaagctagtttctaactcaagagtgagttggtagcagcattggactcagagcccaggtcttttgagattctcaccttagaaatcttccatggcatctggttgttcccctgggttggtgacagtaggaggagattgggtgggggccatcattctaatgtggtttggtggataagagcataggctttggagggcttctgacctaggttctgcccctttgggcaaattacttccaatttctttgaccctggttttggggtaataacaaaacatcacttactgggttgctatattactaggagacaggataggtatggaaactggggcacacagtaatagtcaagaaaataagtatcacttatgttgagcttatagtgtgatgtgtaccttctaggcactttatatgttttaatttaaataatcctcacaacacccaaatgaagttggtactgttattatccccatgttaatgatgaggcaactgagttatagagagactacgtgtgttgctcaaggttagtcagcttggtgagcatagaggagtattattttaattttttttctaattggtggagttacatgttgcaagtaattaaaatataattgatgctgggcaccgtggctaacatctgtaattccagcactttgggaggctgaggtcggtggatcgcttgaggtcaggagtttgagaccagcctggccaacatagcaaaaaatcatctctactaaaaatataaaaattagctgggcatggtgtcacacacatgcctgtaatgccagctacttgggaggctgagacacaagtatcgcttgaggccaggaggcagagtttgcagtgagccgagatcgtgccactatactgcagcctgggcaacagagggagactctgtctcaaaaaagaaaaaaaaaaatgtagaattgagatgcccctggctggtggagtggatggaccagataatactgggtagccctcctggtcgtatcatccacatttagtaaattgtatatttaaaagtcattctgaccatcttcttatggcattggctctcttttatggctttattggacttcatacatattcaaagtggactgtagcacatcttcctagcctgcatcagggtgggaacctctctcagcttcccatccctccagcaggaaatcgctgtactgctccctaacctggtggctttctttcccagtatcaggcctccagaggttctgtgctagtatgtcagcccctctagaaggagtgtttacctagttcctggataatattgaggctaagtcgggagcctaaagttgaagcagtatttctaagctttttttcggcagtggggtggggggttctattattagaaaataattctactgagttccccctttccttcccatcctttagactggggaaaaaaatggtatgctcgaatacaccatttctagatgccccactctctggcctactaccctgcctgatttgtgtttgcctctgattatttctgggaggtataaaggtctccatctctaaccttgccttgaagcttttgggtgaaaggctgagatcttagcatcaaggtatcagccctatcatgaagatcatcctcatactacatctgggaaaactgacacctagagagagaggaaggaacgggttctccaatgcctttttggcctaaagacagtataatatagtacaaggagtgagcatattctatggagccccagaggttggagttgggtcatggacctgtagctaactagttgggcaactttggcttatcacttgatctttttgtacctctaactgtaaaatgggagcaagaatatctacttcccagggctatcgcgagtctcagataagatagattgaaaatatctggcgcactgtctgactcatataggtgctcaggaaatattaattcttctgtgtcttgggacactactctttgtccctatcttcacataggccctggaatactcacccctgtgcccacaacttcggtgttggtttgccttgtgtttcatgagttttgagcatacctgcattcgtctcctccatgaagacataagctccttgaggacaggggccaggtctaccttgacatctgacacacacctgcaacatacttctgacctatcagagttgccataaagaaggagtaggacttggaaactctgtagaattgaattagctaggacttaggtgtcttggtgcctatttgtgtcagactctttgtagcaaggaggataagtagttctaggctttctggataacagaccaaggaatcatgtggcagttaagtttcttattcaatcagtagattttagtgaactgagaggagaaggaaaaacaattataagaggggagtgggttctttttctctccctctgttatcatcttccttcttgtcctcccgtttccttctactcatgtgggaggcagtgagattaaggcctgttcttcaagtattagaaagagactgagggaccagagcagggattgagagactgggacagaaaaagagatttatagagaagagagatggagaaatatatatatgtgtgtgtgtgtgtgtgtgtgtgtgtgtgtgtgtatgtatatatatatgtgtgtatgtgtgtgtgtgtgtatatatatatatataaagaaaatctctctctctctctttctccacacacatatatatgtgtgtatgtagagagagagagagagagagagaggcagacacagagagagacagacagacagagaacttataggaccagagggtaactggtgtagaaaagctgtagcagtcccgggtggcagggcacatttggccttggggtgaataagaaaatgggtcttcctagctcacagagctgtaaagctttttgaggagtcccaggagtccctctctccctctgtctctaccaggccctttctggcctcttcctatcccagtctatgcccagccttgggtgcctccaggcaggtgatggtgccatccttctgcctggctgcctctcatcatcacatgtccttcccagggcgaggacatcctagacaggagctcggagctgatctacactggggagatggcctggatctaccagccctacggccgcaaccagcagcgggtcttcttcctgtttgaccaccagatggtcctctgcaagaaggtaaccctgcccccttcttccctgagggagatgggtacctaacagggtaccggaccctcctcttcatcatccccaggctcccaacaaagtgggcaaatactgatggggggaaaacagacaggagattggcagcaattctgtatcaggaacactaatgtggcatgaatgtcacaggcagggttggcttgtgggcagtgaaaaactctgaagtcggtgcattttgtcttggtattttttttaccctttgccctaatgaccctggggtgctccttctcactttcttctacccagagctgctggtctgcaccatttgtaaaaaatattgaaatatgtctatcttagttggtaaatagtagtttccctgagcactttccctcatttccactctaatggctctggccatgtggcccctctctgccctgggaaccaacgaggagcctcctacttttgccctgacaggtaggtacctttgtgatataggaattttttccatgcctctacctatttcctatacaaggtgcactggttccccacaacccccaaccgtgctcttctccactcttccttctttgtaatccattagaggagaggtcttactcttgtcactgactctggataactctgtgtatgttggtttctaggactcttctcctttgtgaggctgggaagggtagcatatgttctaagcgtcactcctccttatgggatactcttacccctacttcctcactcacagtagagagttcagaccagttttggctccaggggctaactgggaagaattggggaccaaggaaagtaaaaatggaagaagaaaccagaatgcttagagtgactttacaaattcaccatgctaccctttgctcttttgccatcatctagtccctttgtcctctccttcacccagtagtgaatgcctctgaagaggagtgctgagtcacaaaacaccagagtaaatagtgttacatttttctgggctggaacatgaaccacacagttttaagccccctgtcctctgtgtgtgtatgtgtgtgccatatcttgtattgaatctttatccatttgctttgacagtggattgaggggaaaaacactgagcttaggttcagactgcctcagtgtttggtgataagctctgaatgtccactctagaaccaatagccagtcagttaatggggataataacttacctcagtatggagctaaccctcaaacagagaacttttatgaatctgaaactcagccaaacactaatgcttctttttagctcccccaactcttctcaggactttcataaaatcaggaggtaggatttttgagggttaatttaggtggccatggaaattctcagcatatcagccatgtcaccaacactaatgtgcctgttcttcccactaaggtgtttacactcagaacaagtagccatagaggcagtaaacaaataggaacctggcttattttatagttctgcaccccctaggccctgttaattttggcatctgttagccaaggctgggattactttaactaaattgtgaaactaggctctagaaagcagtggctataagagatagaccaggatccagaacataaaacagtgagtcagaagccaggaataaaggggaagaaacaagataaacaatgggtttaacttagaactcaacgggcagtggaagaccaagatggagtaatgagccatgtctaagccagatagtgggagccaatgattaggaagaaactagaagtcaagccagggctggggattcaaaccagctaagctggcagggtaggggaagcatataacagggatggtgaaaacaagagaaacctcgaagcagtcatagcttcccacagaagggagctttcttgttttcacaagaaccataggctttcttcccaagacacagccagcctagagtctggagtataaaggctaccaactccatatacctgggtgttcttgacactggcttcccagaacacgagcagttatagcctaattgttcaaaggccattaaaactacctgatgtttgttttgaagatttccatttgttatctacaataagactttccattcaacaagtagggataaacttttgaaaaatgatcatgggaccaaaagaaggtatgcagagagacaaggtattttgtctgctgggttgtttagggaccttttgccattactacaaaagactctcttcttgagatagagctgggaggaatggactaggctctctggaggtgaaaattcctttgacaaagagaatccatggaggaaaggaagggaatgtctggattgggccaaggtgagtgaggctgtcaccttgttcacctcaggcacacaatttaattggatgtccgaaagttcagtaatcctttttaccaggaagaaaggaggtgaggatgctaaataatgaaatatggccacattaagctttctgatgatctcatatttaaaaaggaggaaacaaagacccctaggaagtggctaaataatatataatattttacatatgatataatatttaacaggggtgacaaaagagtttcatgaatcctagaatgagtcaaaattagtttttaaaaatgcttaattttaattacttttaaagctatgttcaaatgaagaaaaaagaagtgatagtctgacaaccccctgtttgaggcagatggtttactgataacaggggaatataaattccttctctatcaaggaaaagaagtcataaacttgtttcaaagggaattgaagcccaaaggatctgaggttgtaagagagtactttactgctctgaattctttcatgctatagatattgagcccctcttctgtgccaaccagctctactttcataaggattctagtctaacagaacttaagtatgatgttatttaaaaatatatacatcccagagcactgaaataattctatgatgtcccaagtggaattgctctaggtcatcttgacagaattatgggttccaggagatctgtgagaagactacacataggaaaatgtaccagttttcaaagcagaaaataatatgttctagaaagtagaaatcaacaataaagtattaatgaactagcatttattgagtgcttctatgattctgttctaagaactttacacttattaactcaatttaatcctcacaacaaacctatgaggtaggtactattattatattatttccatgttaaggatatgtaaagtgagacctagataagttatataattttcccaaggtgaaatagctaatgagtgatagagccaggaattacattcagatacgctggctccagattccacattggtaatatttatgtcattattaccattgagcttgtcaaaattctgtacttgattattaaacagcctgtgaacatttagaaagagatacagtggccacaggggtcatctttggctttctgagaacaagtcatatcctataaaactcagtttctattttgccagtaacttaattagttaataggaggattgcacaggacagagagtgtcctcctgcatttcagattttcccatggtttccttgcagacagaagtcatatggagtgatagataaaacataaagtttgtaatcagacaattctgggctcaaatcctgatttcaacactcgctaactatatgatttcaagcaagtgactttttccttcttgtacctccattatatcagttgtgaatggtgagaataactattctacaggattgtcatgaagattaaatggaatcaatgcatataaaatgcctgatagagtgcctggtactcattaatctcatcttacccaacctccaacaaagaaatagacagccttataaagtagtgaggtccccatcactagatgtacccaaatatgggctagattattatgtgccaaagatagtatagtaaacattgaaacactgatctctctccatgagcatgtggcctcaccactaagttctcatccaactgttaagattcccttaattcccagtcaattatgcaacaatgtgcctgttttgtacattgggaattgggattgactaatccactcagaacagcttaaacaacttatgcagcttgtagcttgtttcagagagagagagagagagagagagagaaaaggagagcaagagagtacgtgggcatgtgtgaaggtacctttaaaatggcaattatagtgtgtgggaaagtcaccagtggcttctaattatgtgaccccttctttaatttttgctgtcaccactcttttaacttttcttccaaaaaatccagataagactctgttctttttcttcgtattatctatactgtcagtctctgctcctctgtgtttcattgaatttttattttagtttttgatgtgttttattattttcttcgtgatataattatttgggaaattattttgatgctttgaggggatttttttctctttgactatttactgtggaaaggagcagatccgcttttcctgcaccctctgtcctattgtgccagtctggccatgttctgttgtcccttgtgtcataactgttctttattcctgttgctttcaccatattcaaggggatcagaactaaacaacgtgtaatgatgttgggcagaagacttctgttcagggaagtttctgcatttggacaatttcttcttgcactgaagggtcagacttggaggatgagctatttgggacagcttataaatccaataatagcaacagagatggggctggagcagaaagaagaaggggatttgaaaccagaactcctgagtacttaactttactctgtctcttaactaacttttctaaccattggccagttctttaactttgtccttattttcctcagtgtcaaatcaggctgatgatagaagtcatctcaagaggctttgggagagaaccacctgaggtagtggggaacagtggagtatggggttaagagcatgggtgctagggccagactagaaggcaatctcctttcgcccatgagctatatgaccttgggcaaactttctgtgcttataattatgcccttgtttgcaaaatgagaatgacagtgtatctacaaggaagggaagttgtgagggttaaatgagacaatgcagatgtagtacctggcacatagtaggtacttagtgaatgttggctattaatactattactatatatgcagtgttactaataattcattcagtacttttttatttagaggcaatatagcacattgtaaacaaaagcagagattttagagctggacagcctgaacccaaagccaagctctgccatttagtagcttttattcctggaaaaatttctgttttttcttccaatttttattttagctttagggggtgcatattcaaatttgttacgtaggtaaattgcatgttgccgggttttggtacacaaatgatttcatcacgcaggtaatgaacatagtaccaataggtggttttttattcccaccctcctcccaccttccaccctcaagtaaaccccagtgtctgttgtttccttctttgtgtccctgtgtactcaatatttagctccctcttgtaagcgagaacatgcggtatttggttttctgttcctgtgttaatttgcttaggataatggcctccagttccatccatgttgttgcaaaaggcatgatttcatttattttgatggctttgtggcattttatggtgtatatgtaccacattttctttatccagtctatcattgatcatcatttaggctgactccgtgtatttgctactgtgaaaagtgctgcagtgaacatacgcgtgcatgtgtctttgtggtagaacgatttatattcctttgggtacatacccgataatgggattgctgggtcaaaaggtagttcttttttaagttatttaagaaatatccaaactgctttctatcatggctgtactaatttacattcccaccagcagtgtataagcattctattcctgagaaagcttcttagctgctctatgtctatagttcctcatcagatggggttataacagtacctacattggaggattatttaggttaataaatgcagagcatttaggacagtacatggtacataatatatgctatttaaggggtcactgttgctattattgttgttcttattattttgatgtaattattaagcatgcattctaggatgctggaatatagtagtgagcgaaataaatccagtccaaaccccatgtaccttccctaggatctggagagaaaaggctagagaagagtaactagggtcccctctataaaggggcagggaggaccttatttacaaacaagtgaagcaggctacaatcctgaacagttacattccccagattgcagcatctgtcatttgtagagaatatcctgcaatgtcttactaaggaggaactagctcccttaatgtctcccaattcagacgagcacaaggaaaaaggaggaaggctggcattttattggaaatgataaacttcattaggcaggaaagttgtgatgatccaaatagcatctgttttgagcacctgctcaccgtgtccctgtgaaggcactcagactaccattaacaagtggcatatgggcagcctggttccaacaagaccacaggcaaccagggttcaagaggactttgtccccttgccatgtgcagaggacaaccagaggaaactctggggctttgtcagctgctcttctctggacaatccctaagtgaagcaagaccaaagaagatagagtgctgggcacagcctttaatgggcaggcaaactaaaagctgtgagcagcatggtggctaagtgccaagtgtgtggtatgtcagggccttcacaattggtgtcagaatttggagaaggggagccacatcagcttgagcagtcagagaaagtttatttcaggaataagaatgtgtaagtttgacctcgaaggctaagattggaataggaagcatagttgggccagagagcagctattagtgtgaccccaaatatatatctgttattttggtgacaaataccaccctgtcctgaaaggatgtatagaatttccagggacagtggggcagctatgtaaattgaaaaaatattcagagttacccttgctttgacttatttttactcacaatatttaaattatttggaaagtttaaatgagctaaaggaggtagtgagatgtttttcctttaagtttatcaaaagagggttttaaggactatgaaacactggcccaggagcaagaaagctcagggctgtatttggtggacaagtctggcctcatgtcctggaaatgacatgtttatattagagctttatagctattttacagagtaaggataactgtcttcatttcttagttgaggaaattggggctcagagaggttaactggcttgtccgtaaccatacagctggtaggttaggcagcaaggcatcaaactcagggcttcagactctacatcatgctctttcttttgttccatgctgcttactgcttatagtcttagctactctttctgattggagttcctcaactagtaggtcattcttaattattcctatcacatctttacatttggcttatgacaaatctagcgcctgaaaactcacatttaaccctctgggggaccagggagaacaggcaaagggataattttagtaacacatctctctagccctgtttccccaccacagaagcagaaattctctctagcttcttgtcatccttacatatctaaagaaacaataggagattcaattgatgcttttaatgtagctccaagatcatgcatattctttctatttttgggaactagcaaatgtgttgaaagctctcaatgactatgacacaccaactcggaatgggggcggagcggaaggaggctgcggactgaagttagcaacaaggaagttgaggctgcctgttttaggcaatgtggtccggtgagaatgtgtggttcagatctggctttccaggtttgtatgtattatattatgtatggtaaggcacaattcaaacctttctgagatcgagataaattacattcatacattctgcctagcttatcctgcttttgtacttagattagcctgatagggcccactttttatacatgtgtctcaaaaagtgttcctgagaattgtggaactcagtgtatgggaatcactctatccttttggccaggattgagcttgtgcacactgaacatggtaaaaggaacccaggttctgaaataggcttggggcaacattggccctctctgtatagctgaactcttcctctcctgtgaacttgatcctggggacaaccaatagatcagaatccatctatattcttttcttatttatatgaacaatcattatgggaggaaaaaagtaacatgattgttattttttcaaaagcaattcaacgacatctgtattttccagcctgggcctttgaggttgacagagctatgctgggaaaccttgctatgctgggaatcctgcaaggtagcctttcccagcccaactgaaaatctcagtataccgcacaatgtgaagagttaggattgggaatgtgagtgggcaaaagaagatccttcatagggagcacacagctgagaagtgagtcaagttaggcaattcagtagaatggaaatggtttaattgaactgtaaaatgctaataaaaattaatgagcatttctgactctgtccagctgactgaaagagcagataaagcagagaggagggagagctggcccgaagatatctgtcaggacaggactcataggggccttcctcaacctgactcagccataccacatctcccagcagtggatgtgttctcagaggaggctgagggcagcgccaagaggaggaggggctgaaaggccactccaagatatttataagatctgacattccataggcctatatgtcatttcttccatccctctattttcctttttaacttatgaaatatttgacattcaaaaagatataaaaataatataatgagtacccacgtgtttactatccgcattaagaaataattcattacaaatagttttccttcccaccctctcttctgcttctttttcttccccttcctctcttgcccctccccgttttctgctctgtactgtctggaacgtggcatatatcattgtcacttatttctttataattttctacatacatatgtatctttaaacattatgtggcatttttttgtatgtttttcaaggtaacagatacagatgaggtaaaactatatagaaaggaaaccatggaaatgatgaacataggatttaggatggaggatgccttggagttgtaactttgggattggtggcagattcaccagtactttatattattaaaataagtaagtaaatgaataaatagagaaataaaaatgccatgcatggaccaattatgagtgtctcatggactagggttaggattaatccaattttgtgtctatgagagcaaaacaacaataacaaataggcgacatactgtttgtatccatctacaacttctgtttttctccataagatttgtgacattcatctgtgttgatatgtgaacttctttatttaattttacctccatttctcttggcagactgggccttttctaaaaatccccagagtgctaagtgttagaccccccctaggtaatcctttgccagcagtctgtggcctcctagctactcttactactcagtccccctctgatgttcaggtctcactggcctgcacagatatttgaacacactccaggcaaccagccagctcatttcatacctctagtgggcttgctgatgttttcgaaaaggagaagcccttgctagccgtgtttatgtggcttactgtttcctacctcccatcagcagacttgcacacacgtccaaggattgattctggtgtctgaaatgatctttcgaggtgagacagaggctttttctttgggcatctagttaaccaacctgtcagtgtcagactactagtataacctggccaaatttagaacaaaccaacccccattggtacttcaaaacggtgacagtgttagcattctgctgtgcccctgtgccaactcttctagtactcgccgtgcacataccttcaagaaacctcttccttcccatctaggacctaatccggagagacatcctgtactacaaaggccgcattgacatggataaatatgaggtagttgacattgaggatggcagagatgatgacttcaatgtcagcatgaagaatgcctttaagcttcacaacaaggagactgaggagatacatctgttctttgccaagaagctggaggaaaaaatacgctggctcagggctttcagagaagagaggaaaatggtacaggaagatgaaaaaattggtaagtgacctgagagtagaaagaagaacatggctatgaagaacataggaggtttgaattggtttccattttcttggagtcagagggaagatttctgttgcaaactgacttaagctactttggtggttccttattattaggttctttttggtaagtaccaatagcttccattagtcagtggtaggtttgaactataggttgtcctcccctactagctaagaatatcacactgaaagccagcctcaggcttgattctcccaaacatacatttattagcaaataaacaaaaatcagttatacaacctgttctgtaatcttcataaagcctgagctctctgtcattaggtatatagtttgtactcctgattaggatacttcagatgttaactaaatccccctagactgtagattcaaataatatgcacatacacttcacactttctgtgtggaagtatttaaagtaaattatagaaaatataacaggacttaaaaccatgaccattttcatgatttcaaatcacactgaaacatacttttttgccttacaataagttgtttctcttttccagtggggatatagatagtagagatatttttcatgttgcttcccaactgtgggatttagacgccattggctatagctttgtgacttataaagtactgtctggtctcttgctcatggtcctgcctttctgtcataaaaaataccaagcaaccagacttgttaattccctgagaagacatacagtttctgtctttgccctattgcttatgggagtgaaattgtactttagaaggcctgaaagctcaagtttatggaaattgtctctagaaaaatgggcctactcattgaatcctggtgcaaaagggttctcttatccttccatgtgggcgattgaaattatccagaggtaagaaaggatggtcagaaagacaaatctaactccagtcttctcctcagaacttgggtagagtgcaaattaataactcactttgagtctcattggaatcagactgctttcagtatgtggacactccattgggacatgatgtggagtggcatataaatgttgctggctacttctctcaatagcaagcagcagcagccactgaccttgcctaggctgttagagttattaaaggaatggtcttagtgttcagaccctgaatcaattagaaggcccctgccattcccattggctctaacacaatgtctcccacacaatgccctaataaacctgtgactttatctgcttctaatagaaaagcttctagaaattactttctgaacaggcatatgttcatctttaaaaatgttgaggttttttttttttggtttgataataacagtaaatcacttccattgtaggaaatttagggaaaaagcaacagaaaagtacaagaaaaaaaaaaaacacatgaacatactcagtaataactttcataaacattttgatatatatttccagccttttttatgtgtctaattagaaaaatcaaggtgactgaatcttttttctttctctccccatacctgcctctctatagtggatagatataattttgtatcctcattttcactcatcattatatcattagcatttctatcagatcacttcatatttttaatcattattttatgagggtcatatagttttatcatagcttttttaaacttttactttttaattataaaattaatgcatgaccattataaccatttaaacaaatatggaaatatataaagaaaacttagcattccttccccttctctgtcacttccatactgaatgaaataaccagtgttaacagtgcagtatgcatctttccatacttatctcatgtccatataaacatatacaaacataatacttttatatttacaaaaattatattatatatattaccttgtaggttgcttttttaaacttaatttatcataagtaactccccagataaataatatagaatctaactataaccccttgtatcagttagggttcaaccaaagaggcataacctgtaggagatatatcataccactgctgaaaattgcattacaaggaattggcttatgtgattgtgaatgttgactaagtggctcagaattccatagagcaggcagtcagaaatggaggatcacaggcaggctcaaacccatggacataggccaaagctgtcatctacaggcagtcaggaagagaagctcatgagaaggatgaagtggcacagacatgggctaaagctgtggtgcacaggtagaatttctgccctttctgtgtgagacctaggctctacttttaaggtcttgcaacagattcagtcaggtccatccagattatctaggatattgtcccttatataaagtcaactgattagggcctgtattagcccatgttcacagtgctataaatacctgagactgggtaatttatgaagaaaagaggtttaattgactcacagttctgcaggcttaacaggaagcatcactgggaggcctcaggaaatttagaatcatagtagaaggcaaaggggaagcaagcatcttcttcacatagtggcaggagagagagagagcaagagggaagtgccacatacttttaaaccatcagatctcgtgagaactcacccactatcatgagaacagcatgggagaaattccccccatgatccaatcacctcccactaggcccctcccccaacacatggggattaccattccacatgagatttgggtggggacacagagccaaaccgtatcaggggctttgattatatctgtaaaataccttcatggcaacacctacattagtgaggactacagtctagtcgaatgggcacatcaataaattcatcacacttttcttataaacagctgtataacattccataatattatgtaataaccacagtcatctcttggtatgcacgggatattggttccaggactcccgtgcatatcaaaatccatggatgctcaaatcccttatataaaatgatatagtatttacatataacctatgtacatcctccatatactttcaatcatttctagattatttataatacctaacacaatgtaaatgctatgtaaataattgttatactgtattgtttagggaataaaaacaaggcaaaaatccatatgtgttcagtaaagaagcaaccagccgcttttttctgcatatttttgatccacagttgattgaatccagatgtggaacccatggttacagagggctgactgttcgttttttgctagacattcattttatatttagctttatttcccactacagatattgctgcaataaatatccatgtacgtatctgattgttacttactgatgcttttattcctgtaggatctgtaccctaaagtggaatgactgaatgttaggatgtgaacagttttaatacatacttgcatattaaattctgaaagatttgtagaatctatactcctagcataattttatgagtacccacttccgcatagcctcaccagcactggatagtatctatttgtttcagtttgccatttctcaactagtaaattgaaaaaaagtgttggaaccttttttttttcatatgcttaatggctattttcatttcttttgtgaattgcctcataccctttactcattcttttaacataaatttggaaggactctatattgttgatgtgacactttgtcagtcacgaatttcacgttttcaccagtctgttttttgtcttttgagtttgtttatattgcctacttctataaatatttaaatttttactttgaaaaatgtatctattattccttttttggcccctagtttcatcttgcttaagatctcttgccatccaaactataaaatttcctgattaaaaatatatttttggtttatttttagaacagtaatccatccggaatttacatttttatatgatgtgagaaaggggacctcatttttttcttcaaggtggatagtcagttgcatctgcatcatttattaaataaatcatttattttccacacagtttaaatgccatttttcatatatagtaactctgcatatatacttagatgtgtttttaaactttctattctgttccactcttctgtttgtcatttcttgtatcaagactatgctgtttcaattacagtagattttgagaaagatttaatgcctggtacaatcaattcttattcactcttatcattgcttcttagcagttcttagatgtttattctttgatatgaatatcaaatttatttattctaggtttaaaaacactgccgtaaaaactggcatagaaagcccatttggattctgattggcattatattaaattttttaatatgtaacggcttggcattgttattaagttttcacatttaagacaaggctctgctctcctttcatcaaaatcttgttctgtatgcttcaggaaaatggtagagttttctttagattctgtacatttctgcctctttgtacattacttttgataatttctatttttctgggaaattgttcatttcctctggatttttaatttaatgctatatatctacacataatattttctaattatcatatcttccataattgtagttatctctcttcttttgggttcataatatttcatatatttttattttctcactttaatcttttaatcaggcttatcagggagtattgatcttttttatgtatatataatcattatacatatttttaaggtacatgtgatattttgatacctgtatacaatgtgtaatgatcaaatcagggtaattgcgatattcatcacctcaaatgctcatcttttctttgtgttgggaacattccaaatattttttttagctattttgagatatacaataaattattattaactctaatttccctactgtcctatcacaaactaaatcttattccttctaactgtgtttttgtacctattaaccagcccctctccattgacctgagcctttctttctgagccactgataatcaccattctactctctatctttatgaaatccacctttcagctcccatgtatgagggaaaataatcttatttcacttaacataatatcctccagttccatccatgtttctgcagatgacaggatttcatttttttatggctgaataatataacatcgtgtatatatgccacatttcctttatacattaatccactgatgggcatttaggttgatttcatattttggttattgtgaataatgctgtgataaacatgagagcatagatatttcctcggtatattgatatcctttcttttggatacatacccagcagtggcattgctggattatatagtagttctatttttaatttttttaggaacttttctactgtttttctataatggctgtactaatttacatttggtcgtttcaaagaacgtgtttttggtttgtttatcccttctgcagtttatttctgtttcttcttaattttcacttttatttccttctttttcctactttcaggatttaaggaatattttagatcctttccactctttcattgactgaatacttactttgtttattttgatttttacaaaatcagaaaatcattttagacatgggagggtgtatgtgtcgaggaatttgtccatttcttctagattttctagtttatttgcgtagaggtgtttatagtattctctgatggtagtttgtatttctgtgggatcagtggtgatatcccctttatcattttttattgtgtctatttgattcttctctcttttcttctttattagtcttgctagtggtctatcaattttgttgttcttttcaaaaaaccagctcctggattcattgattttttgaagggttttttgtgtctctatttccttcagttctgctctgatcttagttatttcttgcattctgctaccttttgaatgtatttgctcttgcttctctagttcttttaattgtgatgttagggtgtcaatttaagatctttcctgctttctcttgtgggcatttagtgctataaatttccctctacacactgctttgaatgtgtcccagagattctggtatgttgtgtctttgttctcattggtttcaaagaacatctttatttctgccttcatttcgttatgtacccagtagtcattcaggagcaggttgttcagtttccatgtagttgagcggttttgagtgagtttcttaatcctgagttctagtttgatttcactgtggtctgagagacagtttgttataatttctgttcttttacatttgctgaggagtgctttactatgtggtcaattttggaataggtgtggtgctgagaagaatgtatattctgttgatttggggtggagagttctgtagatgtctattaggtctgcttggtgcagagctgagttcaattcctggatatccttgttaactttttgtctcgttgatctgtctaatgttgacagtggggtgttaaagtctcccattattattgtgtgggagtctaagtctctttgtagatctctaaggacttgttttatgaatctgggtactcctgtattgggtgcatatatatttaggagagttagctcttcttgttgaattgatgcccttaccattatgtaatggccttctttgtctcttttgatctttgttggtttaaagtctgttttaaccaagactaggattgcaacccctgcctttttttgttttccatttgcttggtagatcttcctccatccctttattttgagcctatgtgtgtctctgcatgtgagatgggtttcctgaatacagcacactgatgggtcttgactctttatccaatgtgccagtctgtgtcttttagttggagcatttagccaatttacatttaaggttagtattgttatgtgtgaatctgatcctgtcattatgatcttagctggttattttgctcgttagttgatgcagtttcttcctagcctcgatggtctttacaatttggcgtgcttttgcagtggctggtacaggttgttcctttctgtgtttagtgcttccttcaggagctcttttagggcaggcctgctggtgacaaaatctctcagcatttgcttgtctgtaaaggattttatttctccttcacttatgaagcttagtttggctggatatgaaattctgggttgaaaattattttctttaagaatgttcaatattgacccccactctcttctggcttgtagagtttctgccgagagatccgctgttagtctgatgggcttccttttgtgggtgacccgacctttctctctggttgcccttaacattttttccttcatttcaactttggtgaatctgacaattatgtgtcttggagttgctcttttcgaggaatatctttgtggtgttctctgtatttcctgaatttgaatgttgacctgccttgctagattggggaagttctcctggatactatcctgcagagtgttttccaacttggttccgttctccctgtcactttcaggtacaccaatcagacatagatttggtcttttcacatagtcccatatttcttggaggctttgttcgtttacaggctctaaaattgaggcaataattaatagcctactaaccaaaaaaagtccaggaccagacggattcacagccaaattctaccagaggtacaaggaggagctggtaccattccttctgaaactattccaatcaatagaaaaagagggaatcctccctaactcattttatgaggcaagcatcatcctgataccaaagcctggcagagacaccacaaaaaaagagaattttagaccaatatccctgatgaacattgatgcaaaaatcctcaataaaatactggcaaaccgaatccagcagcacatcaaaaagcttatccaccatgatcaagtgggcttcatccctgggttgcaaggctggttcaacatatgcaaatcaataaatgtaatccagcatataaacagaaccaatgacaaaaaccacatgattatctcaatagatgcagaaaaggcctttgacaaaattcaacaacccttcatgctaaaaactctcaataaattacatactgatgggacgtatttcaaaataataagagctgtctatgacaaacccacagccgatatcataccgaatgggcaaaaactggaagcattccctttgaaaactggcacaagacagggatgccctctgtcaccattcctattcaacatagtgttggaagttctggccagggcaatcaggcaggggaaggaaataaagggtattcaattaggaaaagaggaagtcaaattgtccctgtttgcagatgacatgattatatatctagaaaaccccatcgtctcaggccaaaatctccttaaactgataagcaacttcagcaaagtctcaggatacaaaatcaatgtgcaaaaatcacaagcattcttatacaccaataatagacaaacagagagccaaatcatgagtgaactcccattcacaattgcttcaaagagaataaaatacctaggaatccaacttacaagggacgtgaaggaactcttcaaggacaactacaaaccactgctcaatgaaataaaagaggatacaaacaagtggaagaacattccatgctcatgggtaggaagaatcaatattgtgaaaatggccatactgcccaaggtaatttatagattcaatgccatccccatcaagctaccaatgactttcttcacataattggaaaaaactactttaaagttcatatggaaccaaaaaagagcccgcattgccaagtcaatcctaagccaaaagaacaaagctggagctatcacgctacctgacttcaaactatactacaaggctacagtaaccaaaacagcatgatagtggtaccaaaacagagatataaaccaatggaacagaacagagccctcagaaataatgatgcatatctacaaccatctgatctttgacaaacctgagaaaaacaagcaatggggaaacaattccctatttaataaatggtgctgggaaaactggctagccatatggagaaagctgaaactggatcccttccttacaccttatacaaaaattaattcaagatggattaaagacttaaatgttagacctaaaaccataaaaaccccagaagaaaacctaggcagtatcattcgggacatacgcatgggcaaggacttcatgtctaaaacactaaaagcaatggcaacaaaagccaaaattgacaaatgagatctaatgaaactaaagagcttctgcacagcaaaagaaactaccatcagagtgaacaggcaacctacagaatgggagaaaatttttgcaatctactcatctgacaaaggcctaatatccagaatctacaatgaactcaaacaaatttacaagaaaaaaacaaacaaccccatcaacaagtgggtgaaggatatgaacagacacttctcaaaagaagacatttatgcagccaaaagacacatgaaaaaatgctcatcatcactggccatcagagaaatgcagatcaaaacgacaatgaggtaccatctcactccagttggaatggcgatcattaaaaagtcaggaaacaacaggtggtggagaggatgtggagaaataggaacacttttacactgttggtgggactgtaaactagttcaaccattgtggaagtcagtgtggtgattcctcagggatctagaactagaaatcccatttgacccagccatcccattactgggtatatacccaaagggttataaatcatgctactataaagacacatgcacacgtatgtttattgcggcactattcacaatagcaaagacttggaaccaacccaaatgtccaacaatgatagactggattaagaaaatgtggcacatatgcaccatggaatactatgcagccataagaaacgatgagttcatgtcctttgtaggaacatggatgaagctggaaaccatcattctcagcaaactatctcaaggacaaaaaaccaaacgccgcacgttctcgctcataggtaggaattgaacaatgagaacacatggacacaggaaggggaacatcacacactggggcctgttgtggggttgggggaatggagagggaaagcattaggagatatacctaatgttaaatgacgagttaatgggtgcagcacaccaacatggcacatgtatacatatgtaacaaacctgtacattgtgcacatgtgccctaaaacttaaagtatattaaaaaaagtgaaaaaaaaatcattttagagtatattttcctttgaataaagtctcaactgtatctcagaggttttaatataaaatttcctttttatttatttttagatattttataacttcagttatggtttccttttgatccagggtttattcagaagactattacactgggtacagtggctcattcctgtaatcctagcattttgggaggctgaggtgggaggatcgtttgagcccaggaattcaacaccagcctggtaaacacagggagacctcgtgtctacaaaaaataacaattaaaaaacaattagccaggtgtggtggcatgagcctgtggccccagatactcaggaggctaaggttggaggattgcttaagcttgagagatcaaggctgcagtgagccatgatcatgatcatgccactacactccagcctgagtgacaaagcaaaaccttgcctccaaaaaaaaaaaaaataataataataatagaaggcgattccttccaatatttcagattaggattctagtaatattatgatgtctgttttttgttaagtgagctgtcctttctgttgtgaagcttgtcagattttttttttatcctgaagtttgggaattatactagtcaatatgtagatgtgcatctatgtatgctcatcctgcctgggacttagcaagaccttttattctttccacagtaagtatatcctttttttccccttaaccgagtgttttgttacttatttgttactattttccatttgattttttcctccttcttaaacttttataatctatatatacatttgctgtttgaattatcttttgcctcattatgtccttttctttataattttgcttttggttacaaaatattttttccctatgtcatgctttatttaacgattctccattaacagactcttagcccatgttcataattctttttttggctctctattctgtgttgtgcattttgtagctaagtttttgttcaagtttgtgacaaatttccttagtgaaattcctagaaattactgggttaaagggaatgattttttttttttttgtatttcaagattttttatatgtcttagcaaatctttcttacagaaaagtttactcatttatacactcagtaagggtgtgtgtttctcatttaaaaaatcatatatttttcttttttaggctttgaaatttctgaaaaccagaagaggcaggctgcaatgactgtgagaaaagtccctaagcaaaaaggtaaagctgccccactcagtctctgtgaaagactatggaatcataagctatatgcttacatattcttaggcccatttctgtgctgaggtttacttgggggtggtggaggagtatccaggtccctaggtgtccttgatgacaggtagcaaatggttttaaatgcttaaggctaaggagtgaatagtatagggtattggtatccaaagatagctcattgagtatagcaaaaaatataacctctgttcctcttttttttttttttacttaaaaataagggaaactttactaacaatttatagatcaatggacaacatgatctttatttaataagtatagtttgggcatgatggctcacgcctgtaatcccagcactttgggaggccgaggcaggcggatcacaaggtcaggagattgagaccagcctggccaacttggtgaaaccccgcctctactaaaaatacaaaaatcagctgagtgcctgtagtcccagctactggggagattgaggcaggagaatcgcttgaacctgggaggcggaggttgcagtgagccgagattgtgccactgcactccagtctggcaacagagtgagactacatctcaaaaaaaaaaaaaaaaagtataaagatattgctcagctttctgtcaccggtctggaggcatgtgccaaatcaggagacccaaatcacaataaagaatctcaaactaagccaagacaaaagattcagatattctctttctcttaactacaagccaaagtacttaagaaaaaataccttgcaaatcaatttaaatctgaagttaagctttagtttctcttttctcatgaaccagaacaaaactatcatgctcagccaaacaaagggaaggaactaccttctgcttattggaatacctattcagtgtcagtcactttatatgttatttcatttcatctttatggtaatcctgagaagctggacactattaactctatttctcagatgaggtagctgagggtctttgagtgaagtaactgaacttaatttgacttgactcagagtccactgctttctcctctccatctcagggtcctgatgaagccccatgcttggaaagaagagtttggttttctgtcttgcctcaattactgacagctgcttctattactgatagccatgttcactgtccccaggtgtgggcaatcttaatgagaccttactttccccaggcctttccttctgctttctcagtgggctttgtggttctgaatgagtcaccatccaaaatgatcagattcaagtctcctgaaatttccagcagccatgtaaagcactattttttttccattgaagcttcttttgattgaggctgaatgcctgtgaacatctgatttccagttaagcagtgcacctagctccgctgactagacatgcctccccttcaactgcttattacttcttgctcttgggaggcccttattgtctcttttcctcatcatgcgaatgtgattccccttatatagggaatgaggccagccttaattagccaccaaaaagttgggagttaatttaaggtggggaattaactcctaaccttttgattgctataataacatgtgagagatggtgttagaaagcaatctggagttaatgtcagtaaggatatgacctgtattaacagaacttggtaagattttgctccagttcctcagacagaaatgtgagcagaaaagagcccagccaactgaagttttcaggctgcaaaagggatactgtcctaacagcttgtctcctggacgctctcaactcctgaactttctcactctgatttcctctacttcccccactgtattcttcagcgttctctagagggacagaactaataggagacatatatatatatatgagtttatatgagtttattaaggagtattaactcacacaatcgccaggtcccacaataggccatctgcaagctgaggagcaaggaagtcagtccgagtctcaaagctgaagaatttggagtctgatgtttgagggcaggaagcatccagcatggaagaaaggtgtaggcttggaggctaagccagtctagtgtttctaggttcttctgcctgctttttattctggccatgctggcagctgtttaaatggtgcccatccagattgagcatgggtctgcctctcccagtccactgactcaaatgttaatctctagcaacaccctcacagacacacccagcaacaatactttgcatccttcaatccagtcaagttgacactattaaccatcacatccaccatactgacctttatggtactcctttatccaagcctgggttcctcaagcatatctgagactgaattgtcttttcactgagaacacttcaaacaaaggaatatctataaagcaaccaggagttggttaaccagaagatagccctgctaactcatgccaagcattttggtcaaggtccttccccaccctatgtatctccaggccattccttttagggcctttcttgtctcccagtgtctaaatactgattcacttgaacagttttctttctttaacagcaattctaaagtcttcaaagaaattcatttagtttctgtctttctttctttttttttttttttttccctgagatggagtttcactctcatcgtgcaggctggagtgcaatggtgtgatcttagctcactgcaacctctgcctcctggtttcaagcgattctcctgcctcaccctcccgagtagctgggattacaggcacctgccaccacacccgactaatgtttgtatttttagtagagacggggtttcaccatgttggccaggctgatcttgaactcctgacctcaggtgatcccctcgcctcgtcctcccaaagttctgggattacagatgtgagccactgcgcccagcttcatttagtttcaaacctcccaggattactacaaatctcctcccttatttctatttttggtcttcaagactcctagtccagggctgtagtaactgatatgttttgagactcaagagtgccatacatgtggaagtggttctcaaatgtaggaattcagtagttacaatatgtacatgggaagagcaagaagggattatttaagataaccatgaaagctggcttccttgagcttttcaatgacccatcacaggaagtgaggggcattgttaagaggtctccaatgcggatgtcattagataggtaactactctaatgtccctttccaacaccatctgtaacactgggacattatcaactcagtctactgctctgggagagggggaacctggctgaaataacagtagagaataccagatctagctccaagaaaggccttttcacttgacctttgtctttcacgctgctttcattttaagtattgatatataacttcttgaaagttttatgctaattcctggtacataaacctaattaactagatcagtatagagctccccatggctatgagcacagactccatctccagaggccttggggccagcacaaaatcaaatgagtgccctagaatagcaaaaatgatctcgaaaaagaataaaatgtgagtaatcaatctacccagtttcaacactcattatatagttacagtaaccaagacagcgtaattttggcagaagggtggacatatcagatcaatgccacagaacccagaaataaatgtacacaaatatgcccaattgatttttaaatttattttgtattgatatgtaataattgtaaatctttactgagtacatgtgatattttgatatgcatacaatgtgtaatgatcaaattagggtaattaggatatctatcaccttaaacgtgtatcatttttttgtgttgggaacatttcaagtcttctgttttatgtattttgaaatatgcaataaattattgttaactactgttaccctgctgtgctactgaacactagaacttattccatctatcaaactgtatttttgaatccattaaccaacctctcttcatttccctaacaccatccttccaagcctctagtaaccatcattgtactctctacctccatggaatccacttttttagctcctacatttgagtgagatcatttgatatttgtctttctgtgcctggcttatttcacttaacattatgagctccagttccatccatgttgctgaaaatgataggatttcattctttttgtggctgaataatattccactgtgtatgtatactacattctcttcatccattcatctattgacagatactttggttgattccatatcttggttattgtgaatagtgctgtgataaacataggagtgcaaatatctcttcaacgtactgatttcctttattttagatatatacccagaagagattgtgattataaaagtgtaacaacagggatccttgtgatgatggaaatgttctatatcttgactgtatcctgttataatgtcaatatcctggctgtgatattgtactattgtactattgttttgcaaaatgttaccattgggaaaactgggtaaagagtacacaggatctctattatttcttaaaactgcatgtgaatctgtaatgatttcaaataaatgcttttaaaaaaaatcaaattagtaacaaaattccctctctaatatctgcgtattgtctgttggcattcagtaccctcatacttctgacacttaccaccttgcaaaactagctcttagaaaagattctgatctttctcactgaagtgccagtggctgatgatggcttaaatgatactacttccaggcaaagggacttagtcatcaagcaaaggcaaaaaaagtaactgtaatgttggaatttcagaccctgagtagcagatgaggaaggtatttgggagcagcagagaagccttcctgacatgtctgaattatatgctgtatgtcttgtcctattctgctctgaatgtagatcaggattaaactttcactttaggcctccaggttcctggaatcctccattaatgtggattttgctttgatggttgcaaacctacctacaaatgttgagaaggtttttaatattagtatcatttaagctattccgtttgaaaagacacacacatattccgtcttccttgctccccatgaattataccttctggtagtaagtttactttctccttcacctactaatgtcaattctctattaagtgcaggttcatcactctcaacccaggacagaacactaaatcacttgcaccttatgcttttagaaaatttctcctagaaacctgtcctgaagtcaatagttcttaaccaggctcttttaaaacttccaggggggactggagaaggcgaaatagagtttgttgggttctttgcaggaccaacccctgcataagggattctggtgtcttggaaagagctctgaactgagtagtcaaagaatgtaggttctaacccttgctttgtcgctaacttaccatgtgaccttgggtataacatttcttttcagatatcagtgttctcacctgtaaaacagattatagcaataccccaaatttctttgatacctgactagatgtggaagtgtgtagggttgcaatagtagccatggtattccaaaatctgtttgaaagaggaattctccccttggatgatttgtaaaaccagttcacactctctaaaccagtctgccttgagttgtctgcccagagtggtcactgggtaatttgagaagccctttgttacataacttataccctttccctttgatctctcatctactctaggtgtcaactctgcccgctcagttcctccttcctacccaccaccgcaggacccgttaaaccacggccagtacctggtccccgacggcatcgctcagtcgcaggtctttgagttcaccgaacccaagcgcagccagtcaccattctggcaaaacttcagcaggttaacccccttcaaaaaatgatacctacagggaggcagataattttaaaataaagtaaataaaattat

SEQ ID NO: 4642 - DNA, 120146 bp, human
gaagagggatagggccagcaaggcagggatcgaacgagtgtctggcagccgggagcccagcgaagagagcgagcaagcttaggaaaacgagcgaagtaaagggagtaggggagactgagactgaccggtagccaggcaggcggacggacgcacgcccggacagactgagcaggcgccggagaaccactcacaggttccccccgcctttccctttgaaagctaggattttgcctttcccgtggcgcccgagagagaatgctggactctgccgacttcagcgcaagctaagatttctcagctagggacaaacgatcagcccaatcctgagaaggggggaaccaagcaccccgtccccatccccctcccctcccccgactaaactcgggcgccaaacccagcccttctctaaccaccctacttcctcctctcctttctagcatggtggctgtatggacagtctgacagaacagagactgacatctcccaatctgccggccccccacctggaacactacagtgttctgcattgcaccatgaccctggatgtgcaaactgtagtcgtttttgccgtgattgtagtcctcctgcttgtcaatgtcatactcatgtttttcctgggaacgcgctgaatggagtccagccacctgagctgtcgcgaactctcgctttgatttcatcccgagagccaccgagaaaaaaaaaaaatcacagacagagacagggaaagagagagaaagaacaagctttcttactcaggggggaaaacgttttgagcttcaacatggcctcgctgtgatatgtatgacgttggtatattatctctccctaaatcttttgtcgtgtcttgtcttttaagaatgcctgcgcgtatagttgcctattgcttgagtgaaattgttgatgaagaaatgctttctatttaagtgtgcatgcgtgtgtgcatttttaatctatgtggcgttcatggagcaagctctgcgtccttaaacagtggctttgctgtctgtggtgtcttaactcatttccttgaagactacctttaaactccatcagggaattttagtcaaaatttctctcttgccatcaggagtgcatttgggtttgtttgaggggaaaagggtttgtggaagagcatgatgaatatttgacatcataggaaagacagtctttgcagtggatatttagagggaaaataatcgatgcaaggaatggatttagggaaaatgcttctttagtgtctaaggagaagcaagaatttgggaagtgacacgggtgtgttgtgctggcagttggtgactgtgtcctttgaatctcaatttgctctccagggttcacaattttcaattttgaaagaagccacatttaaaacacttcttgaaccttaaagctttaagatatttaaaatgtcaatttccttggaatcatgaaatagtatgtgaaagcattctctgattttttgaactggcaagagaggactttgacaggagctatttgggctccctttcccaaagattgtacccctggatttgagtttggggattttgtttgtctcatcaaaaaaaaaaaaaaaccccacaagaaagaaaaaacagctctttatccaccttgggaataatagtatttggatatggctcctttgggataatctcgtttgcaatgatgttcttgaactacattttaaatgtaacttgataaggctgatgagaaagtggtgatgctattgtttgctcccgtttgttactttaagatcagaggtctctgtaattgaaacattcccataacaaactgaaagtctgtaatgtgctaaattaagagttatcaaattttggtgctaaatttgaccaccaaaacccaaaaacgtctagaaggaaagggatgagagcatggaaaacatgagctggaagcaacattccagtttgagatatgactgcttgtctgtatcagatggtggtggtggtttctgttgttattgctattgctattatttttatatttctgtttcctctgagaaagctcttggcagagccaggaaaaaaaatgtctcatgccagtctgtataatacttgtttttttgcgttttgattttctttctcccctgttaatgtaggcaggctttccccattccattgcttacctggcttgaaataatgccatttatggctcatgtattatagcagtgaatcaggacacatacacatctacacacatgctccccctccacccatgtgggtggctgttcatgtctgatgtgcaaatctgctggcattatgctgtcaagttccatgtccggttgttcagtctctttggaaatgattatgaaaggagaggggctgtgaagggggcctttgaaattgtcttggccacaggacccagagagtattatttaatggcgtcagagggtgttttgggcctcaaagcatgctatccttgacttggtgtgggtgagaagctgaggtttttgtgagattagtaccatggtgtaaacatgatctgggaggtttgctggcattggttcttattaattactctttggtccgtttgtggagaccccctggatggaactgagaacctatttctttgcaaagataatttagtgagtttttttccccccttagcttcattgtattatttaaagtaagcttatatcttttctgggcactttgttttgatacagtgttggagagtggggaatggctctatgctgggcagctgcagacctgtttttttgttttgttttgttttgttttttgttttttccattcagcagctgtttgaccttggacaatttttttcctcctcggtgggtttgggattcccagtaacattggcattttttgatggctccactaggtgacttccaagttcttgcattttatgattttatgacccctagacacttgaagttgtggggggtgggggggatgagctggaaagacaagtgaaaaggaaaagaaaatgttaatcaaagggtgatgggaggaggggaaggatatctggtactacagcctggataacaagtttaagcgaaggggttttttttgcctagttatttgggaaggaaactgggacagcaataagggaatgctttttgactttttttcccccaaggggagaaggggtctctgagactagtctttgatctaggtttatgacttaaatagtgtcacgaaatgccttctcctctgtgagcctgacagacctttggcagaaagcctctgggaatgtatgtgtgtgtgtagggtgtgtggcagtatgttcatgggggtgtgtgggggggagcacactcctgagtgtggatgcggggtgtggtggtaggaatgaagaaagacagtattgagttccacagttctgaatagcctccttgtgctaggacctataaggatttcacaaatgctgggatggatgggtatcacccatgccattcctcttttcaccacctaaaacccctcaggctaaggaggtgtcttgaatgagcccttccattagtaatttagctgttgaaatgggttagcgcttttaaaattgtctccaggcaaataaagggatgttgctagccagatggcaggccaccatctagcaaccagaagggaatttgagagtagagaacaaaaggtagcagtgtgactttttacttgtgtgaatcctaaaggtttggcatttctgcttcagacttgtgaggatatttttctctagcaaaaagagaaaagagtgggagaaaatgagaaatgcagcccagagaagcggaaccctatgcattttgacttgtcttcttttttccttcctcctctgccttctctcttaatctttctccttcttcctttcttcccacccctgacaccacctcctcctcccacctccccactgtaaatgggtgagaagtaaaaaagagaagaggacttttcctctctgatttgtcccaacttttcccaataaagctcctccattcccttccctcctctctggcccctttgagtagaggataagcttttgccatgtaggaggggcaaaatcccagcttagggattttcgctcctggatccccatcaaagaattaaagaaaatgccctctactggtatcctagcaacccctgtatcactgagcacccactgagctccagagcccaccctttaaaggcccaggcaccaataactctagaaaaaggggactagagcctagtgggacttggagagatgcttttggggagggaacaaagaaagaacagaatcccaatttcctgcaaatgcctcggaaacatgtccacagcagacatgtagagcctagcctcgtccagctatgagattatttattagaaaactcctggtttcaaattcctttctagtcagtcccatctccttaagattaactgtgccattttactgcctagctttagtgccagaagctctgccggtcctgaaaaaacaatttttttcaccctaacttttggctgcatcagggagggggtgaagtgatatcttggtgggaacaaactgaacagcattcttcttccattgagacagcctccatctgtcagaacctgcagtgtgcttgtgcagtgtgccccaattttgtctgtggcttggggaatcctgatcagcctagctttatagaatttgggaatttttctttctgtggttttggtgtagtagtttctgacgggggaggctggacaagttgaaagagcaagtttgataatggagctggtaaacagggcttggaccctggctcagagactctcacccaccggtgtgtgtgtgattcagctactagggagctgaaagatcccaaaaaggctgtaggtgaggtgctcttctgcccttgaggtaaggcccagattgagagcaaccagagggcacagtctggtggtttgaaggatggtaacaaagcatgtcttcctctttagcctttgtctgccatctcagtttctggtcccttgacctgcagagtgcttgctctgggcagggatataagaattgagccttttctcccaaaataactgcctcctcagaagacctcctacaaggcatctggatcttgctccagtggctttgccccaagaaatgggatggaggaggggaatcttggactctctagctcttatttccagctctgcaacttgttctaggccaactgagtctctggctttccaagaatccttgatgaaggtttagcttctccagtatctgctcagagtgtctccttctgtcttaggtggatctagctccatagagtatttagtttattgtactttgctctagcacgaaagtacaaagaggaaaaactagaaggggaagaacatagaggggagagaaggctcaggaagcagtccagtaatgacaatactaataactccttatcagtgcacgggcctatagcgtttatgaaggaatttcacatcctttctaacttgagcatcacatcagccttgtgaagtgggtagagatgattgtaattcccagtgttacagatgaggaaagtaaaggtcagcaagattgttgggatgggagtgggtctgcctttcaaatagagaggagagtcagagttggtcattcctaactagtgtgatgttgaatgtagggagggagggcctgacgtggtggctcacgcctgtaatcccagcactttgggaggctgaggccggtggatcacctgaggtcaggatttcgagaccagcctggccaacatggtgaaaccctgtctctactaaaaatacaaaaattagccgggcgtggtggcacacgcctgtagtccagctacttgggaggctgaggcaggagagtcacttgaacccaggaggcggaggatgcagtgagccgagatcatgccactgcactccagcctgggtgacagagcgagagtccgtcccaaaaaaaaagaaagaaaaggaaacaaaagaaagaaaggagatttgggagtcatccctgaagtcatactagcttcctcagctactcacatttttaataactttcatttgtatagcacttttgctcagaattttcattctataaaatgcctttttgtcttgaatatgcatcaaagagttctgtttagttttatgaaaactcactatttgggatcttcaaggtgagaggccagtgtgaattgctgaagcctaaaatacagaatgttttcaaggaactgtagttttaatacaattgttcttctctttgaagcacacttatttttctatatttctttaaaaatctgctgcctagaactgttcatgctactctaggtgccacctgactgagatcaagtgcaaaagaactttgttttgtctgtgaaatgtctaataatgcagccttctactgattctcaaccctcactgaacattcagatcacttgggaagcttttttttaaatacccatgccaggtcccctatctgaaagattctgatttaattttcatgggctagatcccagggagctttatttatttatttttttaatttaaagttccctaaggtgattcaaatgtgcagccagggttaagagttagccttttgagcatgtaggtccaaaccatttactgtctagtccagtcctctactctcttgtgaagttggccacttcagggttttttgaaccaaacttgctacattttatcttgacatgttggtccattattctagctttctgtggattttaaaattttttcttcatgctgtgctacaaattagcagtcccttctagcactgcatcagttaaattctatttgtttggttggactattgttctagcctttgggaggtttttattttttttcttcatgtcacacaacaggttagcagcctcttctagtgttgcattatttgaacaccaaataaatggcattcgagtcgttgattcaaagaaatgtttactatgatatgattaatgctagctcttctgtcacctcaccagagcccctcttggagttgggacttgttaatttttgtatgtatctggtcaaccagtgcagactgcacctggttgtgccagcatttatcctaccagggtgttaatgtgaataacatagcacgatagatttgttgtatgctttgtgggcatcaagatatgctaggttcatagcaagcatctgccaaactgatagccccatcagaaaaagcagtataagttacttggcctcttactcatggtaaatctggttgcaggctccagagcttcttgttttctttctgtgcctacaatgcaaatgtttctaaactgggttcagaacttggctgagggtcagtactacaactgtagtttctgtgtattactttctcctctttgaaaaagcaggacataatggatttagctttaaaacagaatatattttgtgctcaaagagttccggaaattctttgtgtatgtttctcttgttgttttgcttaattgtttccattaacccagtggttctcagcactggctgcacatcggaatcacctggaatattaagagtaacaacaattcctagaatctttgggagagatctgattgagttgatcatagtggtttcctggcatcaatatttttctaagagttccctgaggtgatgggaatgttcagccaggggtgagaatgactgctatggaatgcttcataggaaatgttagctcagcctgtctgacttatcacacatgtgactaggcaagcttcacagatggtgaaattttattctaggactgtgggagcctcgataagtcccaggggcttgtgctcactctaaaaaggaggaatcaaccctagggaatgagtagtctggagacctaattgtatttaaaataatcagctgtgagatggtttgaacacttcaggaataaaaaaaaagtcagttcctacacatttgctgtaatgatggggaagattctgctcatttgctagtgacctcaggcaaattacttctctcctctgaaatttggttttcttcatcagcaaaataaggataggtggatttgatgacttcaaagatttcttctagctccaacaatatgtgcttattttgtgattaatattaatgatcaacacgagtacagatattatttaaatctagcaggtaatccagagatccattttagcaggtttagaatacacagagtggttttaaggatagcagttttgccttcttaattatacttggcttaggtttcttttagaacaagtgaacttaggttgtattctttgagcacacactggccgccaagcaggaaaggagactgtatgaacacgcattggctgccaaacagggaaggaagtggtacagtgaattgagtagctagggtatgccagtttgggattctgtttattaaagagatatgtcatggataattgagaattgcctctcatagatataataccagtctcataggtctgaaaaagatggattgctttgacagctcagagccccttcctgcagtattttaagtagccattcacttggttaataatactacttctattaataagaatttcaacaaataaggtttcctatgtatttcatgggcttcttcctcaaacctaaaagtagttaagaaagtgaggctcataaagattaagcagcttactcagtgtcaaacaggtagtggtagtgactagtggtagtggtagttctagtggcctagaacctaggcgtcttgataccacatcctgcagtgcttctggtatagcctgcatagtggactctgtggtcaggatgcagtcatgactctgagaattaaaggggttttactgacatagagcagtattcaggaggaagctttgaagaaaggagcaaaaggggcaatgtggaggaagaaaaaaggtttagagagggatgtgttcaggccagtttttctcttgcccttatcactcttatgtgctagttccaggcccctgatgggaattggccattgatctttgagcaccaaggttgagtgttggtagcagagaagaaggaaagttgtacatgcatggcagaaggatagcatagggaaggcagacttgcagtaggagaaaaaacaagaaaaggccttaggagccctaggattaagccctggctctgtacctaccttgctgccagatcttgatcaaggcccttcccacctaggcgtcagcttccacgtcactaaaatgagagtggtttcagtagaagaactatgttctcaaatggaatgttagccagaagcttctatataaaacaggaaaaagcacagatggtctggttgaaatgggcatgggacaggtatggaggacagagtctaaagttccagggaaccatcttgcgtatgcagattttggtcattaggggaactggaattagaagagtggagatggctctgccaagcccagccatagtgcttggggagatagagcatccttggatagagttgtgtgatgggggtgggtatttcatttaagtggccaggatttacagagaatcacttaggggcagatattaaagtgcctagtacaacacactgcccccattcctttttttacaagtgagaaaactaaggcacaggaggggaaagggatgggtccaaggttgcagtgatagttctggaattctgattctttagatagggctcttgcctgctgtaacttgctacctcccctataggtttctggctctatgctcccttggctggatcagagacctgaatgctctttcaggtttggttggagaaagcaagctgacgagaggctgggagaacaagagctttatataacctcctggagagggagcaggcctgttagtagtccttggagttccagggagtaggatggggatgaggggaacacagagtctcctgaaggccacattagctctcctgaggcagagcagtagatgcagccctgtgagtggccatctaccctcagggcccagaggaggccagcactgcacatccatagccagctctgggaatggctttggcagctgatttctccgcctgcctgccttcattagagaaaggaaagccatgtacctccgtgcccagctggctgcaggaaggatgtactaagagcccaccccccaccccctcagagtgtggtgcctaaaggcagtagctacttttagctgaacctcccacagcctctcctccacccactctctccctcctccctctgtgaattgtgcaggatggcaagaaggctggggagtaggtgccttggcattgggatagaggcagaggaggagctaggcatctctaggaggggctctgataagccctgcatggcaggagggcttagaacaaaagcaaaatgatgagattgctttgtgcttaggacccaaagggagttgagggatttattaatttcctttggagcatgcaaccagctgaagttcatgtcttgtaaatttagactgaactgcatgggaagacttacactctacttggattaagaggaaagcaactggggctagtgggtactcacttgattcttaactactcctcttgaacagtcttacacttttcagtggattttgtacatcgtctcacttgattttctctgtggccctgtgaagtgggtagggcagagattatctccatttcacaggtgagaaaaagaatgttcaaagacttattgtcacatagctgcttctagcctggccttctgggcttcagctctggaagttacagtgccacttaaagtcactgcagacagctatattttctagaaaaataggtgctggagctgtcctgattctaatctcctcattgtggaagctggggaactaggtccagagaagaaaaggacttgccccaggaaatgtagtacatctgtagtagtgctggaattagaacattgccatgcaaggatgtgaattcctggacctgcaagatgtgcaagccactgtggtctttcaagggttgtttgggaaacctgtgtggtgtgatggaaagcaaagtgtcacagaactaggagtttgttatttttcagttcaggcagaactgtgggtgactgccccagtggaggcctgacactcagtaagccctctataaagatttggttgaatggaagatgtacacatgagtaaaaaggaggtgcaaatgtgaagtcagttgctgtgtgaccttgaacaaatcccattgtctctgtccctcatttctgtctgtcatttttggaggactctttttacttctctcccttggaagaagaaaggccctgtgacccggcccatgtcttgggtgcttggtggaaagctgttttgttttctgatttttgttgttgttgttgtttttaaataagctttcttttatttatcccaagctccatttcccatgcagtcacacactcgctgctatgaagagcagactaactttgtctctcctcatctcctgcaaagttaaaagaggaacttggaagaaagccaaaattaattgtgtttttatttagcaccttcttaagtccatcaagccataaaccacttaggcacatggcaattaaaaaacaattcttggcccctagatccttggctaggatttgtgatggattactgggttttcatgatatgatcaaaaactgttttagaaattgcaggttcttgcccaatgagctgtgtagaacaaatcaacactcttcacttatactcgcattattttgtttggaaacatctcactgatctgggggcaggacaagaagataaagactactgtatagccttctgctcctgacacatgttcttttctccattacactattaggtggccaaagccaagattattttcccaattttatggctaaggaaattgaagctcagagaattgctttgattgactcaggtcagtactgcatcttaaagtcagtggtgagctaggaagaacatagtatatagcgttaggtattatcaactcaccagtaccaagtgtctctaggcaagccatttaagattccctctgtagtttgcttctgtctaagtattttgttgttgttgtttgtttattttttgagatggagtcttgctctgtctcccaggctggagtgcagtggtacaatctcagctcactgcaacctccgcctcccaggttcaagcaattctcctgcacgccaccatgcccagctaatttttgtatttctagtagagacggggttttgccatggtggccaggctagtcttgaattcctgacctcaagtgatccacccacctcagcctcccaaaatgctgggattacaggagtgagccaccacacctggctctaagcatttttacaaaagttaatcaagatagaagaaagaagtaggcatatgctactggataattggataggttggcattgaaccattaattggtattttggtgcatctactggatctacaataaattcatctggatatcacattgtccagggatacatgagaggcctttcaaaatgaagaaaagtggccccagattctgtagtctttggtgacctacttagtttggacgctttctctctgtgggtttatctggccatgttcttaaagactgggccttgatcctaaaagcaggctctttaccattaccagtttctatggtcatcccaaaggatggggaagaatgatttggataaactacatgtcattttgcctgggctttggtggagattgtatgccattccttttactccagttggttcaggccactgggaaaatgagtgtggaatgacaagaatagggagacaaccaatagcttgctgagggttagagggggcctagctgggatgagacatctgcaggtgctaatccacgtgcacatatctacacactgattctttgtggtgttggggggagcaagcagagtttgtccatagtacttcagctgagaagtgactgggtaacagtgagaggaacccaagcattgagctcgttccttcagtgtacttctggggaaactgaggtctaaggagaggcaggaacttgcccagagtctcagaatttgtccgtgatctttgcctattctctctagtcagccaatggctaatttaccttacatttgtgaggctctttagatgaatgaggggtggctaagcctcttgggaaaagcacctgtgattaccacattcaggaagtgacagagatgaaatctgaacccaggtcttttgtcctgcttaagagcagattgacccagacttgaaggaaggctgttagaaacaaattgatggggaagaaaattggttcagctttgctgtctatccatgctctatgcccgtaccttcacatacacatacatgatagatcatatgtgatgcacacttacacatactcagacacatgggatgtatttgggacacacatgggacacacagctggaacatattttcacattaacacacttggaacacacattcagttaaacatgggaggaatattcacacttgcacattctcagcacaggcaggatacacacacaggaacacacatgagggatacttgtacgcatctgcatgtgtgaatgcacatggatgcatataaggcacaattgtgcacccacatacatatggggcatgctgagatgcactctcagatatactgttacccaggacatgcactcctatacctgagatacacactcctaaagactacttgggcaaacaacactccacacttgagtgttgagtcacacttgaacacacctatgggacatatccacatgctccacacagccatgtgggacatattttgatgcagaacacgtccttcccttagggccagccagctgtcactttttcctaagtgggcatgacagggaactggtcccagctggtgggcctccataagtttgctctggctctcctttaaccttgaaattagacttgagagggcagtatgctcagtaataaaatggatgttcaagatggcatgttttgtagcaggctctgtaaggtaaacagggttcagagcagagccctcagatgtgagttaacaggcagatgcagaagaatggaaaacacaaattgggattgatcaatgcagaaagcttgagcctgctccttcatcccccagttcacttacaaaccattgtggagtgatatggttatgaagcaatgtcaaagaaggcctaaagtcactggatattaaagtttatctttcttgggaatgaaataacagtctggactagagcaaagatatctaaattgtgggtgttagggtgtgaggggaagtggtaggatgcataagcgggagatccctttgggcagtggcccatcctctcctgggttagtggtggtctgagaccagcctcatccttaatgaccacaacctagcccctaggcacagcagcttgggtcatctggccccactaatgaatacctgctatttttagagttcctcaagctggaaaccaggtcatggtgtcctggggaagcctttgtggtccttggtacctaaggctgaagctggaaagacagggccctagattgggtctgagtgaagggtgggaagcagggggacacgtagctggggaataccaggctttcctgggagcagcatcctcagagcctcagttgggttactattaactataacagcctcatgcccatttctcagctttggctttgaggtcaagaaacatgagtttcagttgctactctgcctcttacagtgtgtctcagtcacgttcccctctgctgtctgagtcttacttgctttatttataaaacatccagtattgcccttagatgatggaaaggctcagctaggctaagagttgagaaaatgttttgaagatacacttttctccatgcataaagctgcatcatcattgtccctaagctggattcaattcctgccaacaattggacctgactcctattggagtagctgtagacagcaaaggccaaaaaaaaggagccaagagaagacaccctcatggagtcaggttggtcaaagtcatgctgagattacccccacatatacagatgcttttcaatgccaggtcagtcattctgggaaagaaaacagatttgcagcatttaggtggtcatgtagctttggctcctcaggaatctcctaggtaatgagagaaggggaggcatcaggagcagggatttcttcctaaactaggaaatgcaagaccaggtcacctgtacctgccacctgccagaggaggcagcctagagtgccagctctggctctaagagaatcctctttgtgtttgtgctcatggccattttatctggtttgctgagagggagaaggtcagaaactagactatgtagttcaagtttccccctgctgcagacattgtgggcaaagttctcctgaccctcagttttctggtctgtggaatgggcttaactgtagtctctcataagagttttaagtgcaagacttcattgtgacataggatgtgaaaagtgtcttgtaaaatgttgaacatgtgttcctgctgtttggattgttaagatttcatccaggttgtaattacacatagtttggaggtaattgagaaacttcactttatttctctacccctttcccataccgttcttttaaggcattattatatccattttacaaatggggatactgaggctcagagaaaagagaaacaagtctgaggtggcaggattaggtggtggtagattcaggactagaagccatgctttcagattcccaacccaatgtactctggccctgggctgccaccaatgaattccagtgctaaaggaatctgccagaggttacttaagtaaatatatataaagagttagatttttctctgacaagcagtacagggggttctctggggcacagctttacccagcactctccctgcttgcccaagagagacacgctgattgtcccttcatccctcctacagcagctcatgtcctgctgtctcctgcatgttggaagcagtgaagaattggagatgttaggctgttgtgagaagcaatccttctgccggtttaagccacttcaagacaataggaggattcttggaggcacaaaatccaccttggtcacccgcacctcctcacagttttttgggtacccctgacctgcctaaggggttggctgaaagggatctaaggaaatatatttgagggccttgatctctggaggattgtgctaatagttgagggataagattatggaaataatccaagaaccaaaactgggagtgtctctggagaccatttgggctgaatttcacctggcctcaatgaggacattaaaacccagctgggcttaccttttctcccttagtgtggttttcctttgtacaccacagattctcgtgttcagtcagatttcctggagtctttctagcttgcttgtttttgctattctgagcccagaagagggaaggggtgacacattgagtggagtggtgagaggaaagagatggaggaatctgatgagctcaggccttgaggggcaggcattggaggaaaagggcttttgtgtctctcttcatttgtattgctgctgatgcattattttcctatcttccactgattggctgtgggagcctaatccaatctgttgttatcttcacttttgctgctcaaacctccaaaatgactacagtattcattttgagggatgtcttctgtgggattggataagcagtggggcagggaagtggggtggggggaatgcggtgcttcaggaaaaatggggagaggaactttcttttcttcaaatttgagagcccagagaagtgaataggaaaaggttagctggcacagccctgccaagaagtagccatgcagtttcctaatctcttttgaccatagataccttatttttaaaattttatttttggataggaaatatattcacatgtttcaaaattcaaaaggtccaagagagtgcacagtgaaaagtctcccttccactccctgccctctgcagaggccaccaatgagtccttccagaaaaatgttatgtggatgtataaacaaatatgaatatattcctctttctcttttttatggtaatatacaacacatattgttctgtaccttgctatgctttggagattctttgatacttcattgaatttcaccttttggggatgtgaagatgtgctgtggaaagtagaggttaagagcactgattctagagggaaactgtctgggttcaggtttggattctggctctatgaacttcaacagttacttcattgtttttctgaactttggtttccttatctttaaactagggatcaaatgagttattatatgtaaaaacttagatttgtctctgacacatagtaaacattcaataaatgttagccattttttattattaggaaaaaaaccccactggaccagcgccagtagatctaggttttctcctggcctctgtgctcctgggatagctgggtaacttcctttgttcacaaattagtttccttacctttaaaatggaacaactcatccccactctgcttatccccaggatttctgggtgggtccagtgagctcatgaatatgaaggcaacttagcaattgtgatgttctgagcagatggaagaagtgcaacttaatattttcatagacactactttgggtggcttgaacccagtggtctgaactgggtggaaaaggcagtgtttttccttctgccagtggaacccaaaagccatccctgtactggtgttgtattttgagtgggagatagcccatggcaaaattttgaaatactcaggttttgtcttctgaccttttttattccaccccatccctctcctgacttccttgtttcattttttttggggggccaccccacccctgtcaaaacctgcttttagaagcaaagcagcagcatatgtcaaagatgacctcaactttccatttgaaataatttaatacagctggctcagagaggcgctggatctgcccaagttcatacagcaagtccagaatcaagctacacctagagctcattcttcccatcccagtttttattactgacatttgcattttagtgtgaatttgaatttgagattccttagcaaaaatcatctggtcgtgggggagattctggaagtatctttactaatccttcatactgaagtgttcttatcttttaatcttcagggtcagacctgtttgggaccctgagcagggagggaaagtcaggttctggttttagtactgaagggatgatgtctatagagcagtgggagagaagagcaccagaaaatgttgaaagcggtaacctccaaggtgagacttagggagaaaatattagttctttatatattaaattgttaatctcattgttatttaatttctattttgtggagtttttttttataaaacacatactacattaatatttaaatattgggataggtgtttcttgttttgttttttgtaaaataaattttattgtgtatatttgaggtttacaacatgatattgtaatatagatagatagtaaaatggttactgtagtgaagcatatctgtcatttcacagaattacttttttgtgacaagaatagctaaatgtttgtatttttgtttttaacattagaggtacatgatccaaaaactattggctaccattcttctaagactataggcttggtttctaatcttggcagctctgctgctaactaacttgatgccttaggaagcttttctcattggagcctcatttttcttacctgtaagaaagggaggactgagctaggtgtgctaactagttacttggaaatctccaatcctgaccacctctgagtataagaatccactgcctttggggctcttgagctgagacagttaaaaggagttcaagccctgacaccttactagatgctttatccctctatcagctgccttggtttccttcccttctctacccccaccactttcacctagcccagactggtagatgcttccttacataagtttagcgaacctacttgacattgttttgttacaagcacaaccacttttcctgtagacacagacctggtgccatcccttctgagctttgagggtgtgtctgattttgcttctattttgtcctctctggcagcctaggtttagtcgttgtatccctctggctaagtctttggtttcaaggtctgaggggaagccagctcagccagtttgagtcccttggggcctgacccaatggctgctcactgaatccctctgccacttcctcatccaggactgggctagacttttttaggagaacatagtccattcctgagcataaaaggcttctgacatggactagaggcattgctaggtgccttggccttggctggatgtcttttctctcacagtgagccaataggtagagggaaatcattgcaccactggaaactatcttccactttttgatgggctgtttaaatgcagatgtcctctctgggctgtaaaaactccctgggagatacttacattctctttggaaacgtatgccaaggtctagagtttttgcaagcctgtgtccttgctgggcatgctcagtagacgtaaaggtggtttcagttaattgaaatatattcatttttcctgcttcatctctagatataggagcaggtcacagtgctcctaactaaatgttgtttctgttcttgtcactgtaaaccagatggtcacatttaacgacgttaggacccttagttccaacctatctcctcccctgctcctcccgctaccttcagctctcctttctctacaagattttaacacgacatctgacaaatggataaaaaatgaatttccctttttctctctgccttgcccacccaccctctgcctgtggtgttgagtatagaaccatgcatgtgggagtcatggaggacagattcttcttgtagttctagccccctcctcctaccttctggaaacaaaggaaccccacccctgcccagaaaactccaaggcctggcttcaagtcgtagtccaggaaaagttaaagctcccaggactggtcctaaggcgactacatgaagaaattcaggaacccagatgcagaccttaagatgagtttaggtcgcctaagggatctgtggctcttagagcatccctgcatattccctaggtttgtcctggtcagctcccatatctcagggtagtaaggcaacaaaagtctccagtgggtagctggagctcggcattcacaccaagtccaagaagacgagcatggctcccagggcagggacattttgggtataagacccacgctggctcaacagatgggtgaaggtcagggtaacctcaagcttgagatggcatgttctgactcaggaactcatggagagggcattgctgagtccattattattatttttactaaccatctgtctcttagaatattggaggttgccttggggagatttaatacagctctaggaaatttcttccagattatagcatagagagatgctgctaggacttgctgttagaactagtggtagcttcagtgcctgaaggttgggacgggaatgagggtggaacagagcagaagcaaatagtctctcaaggcaggctgggagaaatcctctccgacaggccaccgtaattcctcagcctttctggaatctgacacaagaaggataagcctagagttggagttccagagattctggtttcttttgagtggcccagtgcagtaagaggaaattcctgcaatataaactctctggtcccagaaagattaagacagttggtttcagtgtggcacgtgattcagaatcactctggttgcttgttattaataaatatggtacggtggttctgagcaggggtctgtggacctcacattaagaaacagtgttgtaatgcgtcagaagtgccaaaatatcccagaataacttgacaattactcctgtttccaagatattttgtagatacaagctaatgtttatcagattgggagctgttgtagtatataggaccttctctagccaacatcatctaggttggccattcagaaacatgtcttctctctgatctgtgcaatccttggcccatttggctgcattttctttaaaggggatcattctctaaacaagaccaagttcttaacattgtgaactttgaggcagcagctgggtctcacttcagaaactcctgggcccatttggctgagctactggcttgggtttcttaccatctattgctaaggtccagacaagcaagcaacaacccttttctcatctgttgggtcaccattagagcagagatcaccttttaacttcctttggaagaagtgcaggaagaagctgttctttgttattagcctcagtgagaaaatattctggatggcatcatgccctaaggggcttctctgggttttccaagctaaaatgtcctaaaaggtcctggaaagtgtgaatcggcttatgaccactgttcatattgggctctagatcaggtggtctgtcttgctcaaggctgaccccatctaggcctaccttttgtgtctgccaggtgtggctgaacagtagatctttcattttattaaagtgaaaactggatagtataatgggatattgaaggaaactgatgtgtaatgactcacaaatcacacacccaaattaggaaaaagatgattttgtgtcatgaaaaaatatatgtacatacttccattcagcatatttagagtcattatcacttgagtgcattaattattctgccaagaaatgaaattatttacttgtgggcaatagcaacacccacattgaaactggaaacaatcaagtgcaaaatgttaaaacctgaggaaaagaaaaagcaactcttgggatgtttttgatattcacagtgggatttttcttacctagcatctatctctgcctctttccctggtgatcactgggcaccagtgcagatctttagcaaaaactggcctgccatagaagccacctagcaataaatcctggcaacaatggactggcatatagggcagctgggtacatattatgtaaacaatttccttggccccataaattgttctgccacctgacagagatgcttactctattgctgtgttctgcctcagagtttgcttgcttttagaactcaagtcagaactttaagtggagtatacacattgttcattatggattaagcttatgttttagacctatcattcagaagtatatactctggttatttgaagaataacactctggtcagcaacttgaatagctcttccaaatttttgttttctgcttatcctaggtagataaggttactgaaagaggcagagagagagagaggatgcagcctggagtcatcagagaagggattacggagtaggtcggccacaatcacacagctaggaagaagcagcctggccccagtgtcgctacgtgtaaccattggctaaggatatggccaaatcagaggcacagaagtaggattgatcattattttattggaggcagtagcaggccatccagtgaaatgttgagcaggcagtaggaaatgtgggactggaggtgagtgacagctgatgtcatgagaaggatgcaagagactcattttgacaagagtggtggaaagcccctgccttgttagaggtaaaggttggatccagagatgaggctagattaaggagagctttgagatagtggggagttactgaagcttcttgagcttgaggagtgatactagcaaaaatgctttaagattcgcatcattaaggcatagcttgaggaagggacagacctgtaagggccaaggaagccggttgggagacagtttgagctgatgaggaccaggataagacagtgggaatgaagagaatgcgttgtatctgagagggagagacatgaagaagaaagaaatagcagggccagaagattttccttaaatgggaaaaattgagaaggagggagaatgggggaatatgatgaattttgcattttattggaggtggtagcaggccatccagtgaaatgtggagcaggcagtaggaaatatgggactggaggtgagcgagaactgatgtcatgagaaggatgattcatctgaagaactaagtggagagaacaaaaagcaaaggtccctattgacttttgaatgcggcagtcaagggtttaagtgggaagcccacttctcaattttcccaggtagtctgactgtgttgccagcaatgcttgagtgagttatcttcaggaaaaagttctcatttttttgagcagaaagcagtaaaagcatcctatcaagcacaaagaagggtgaggagaattaagctgcaataatgacatccccgtcctttgcagagtaagtgttagcctcagtagaataccagagctggaagggacttgagaggtcatctgtatggttccagtctgtcacttgacatgtaaaaaaactgagacgggctgggtgcggtggctcacgcctgtagtcccagcactttgggaggccaaggcaggcggatcacctgaggtcaggagttcaagaccagcctggccaacatggtgaaaccctgtctctacgaaaaatacaaaaaattagccaggtgtggtggaagatgcctgtaatcccagctgctttagaggctgaggcaggagaatcacttgaacccgggaggtggaggttgcagtgaaccgagattgcaccactgcgctccagcctgggcaacagagcaagactctatctaaaaaaaaaaaaaaaaaaaaaaaaaactgagacagggaaagggacctgtccaagatcatttggtgagttactggcagattttcttccaatagccaatctgagtctttactgtacaccatggtacctcatagctattgttggggcagcctggttcacaccttcccaaaaatagggaggatgattatccttcaacactttgggcaagatagccagagcgttttcaaggctgtattaaaaggaatctagctttttcaggagagagcataaaatctcagcttgttttagatatgcttaagggagcaagggaaaataatttgctcttgcccaagtttagctgttcaggagaagggggccttctgagaggatacgggcagacaccaacctgagaaaacctcataggcaaacccctgtcatgtccctccttttcctcctacggagcttcttggaaggcaggtccagctcatctaccttcatggcaattggcatatttgctattccatacatgtgaggttcacattttttaacccattctcccttctgctgcttcttattaaaacactaatatttctgacagccaccaaggctaattaaatgtctattttgggggtggtgctgttgaactagaggggaagaacaagaagttgtagataagtggcatggctctaaaagactgggtgacagccataatcccaagttttttcctgtgttaacacagcctgacattgggcatgctgcttacatgaccccaaatacccttttgcagacatttaccaacaactgaggaaggccttgtagataggaagggagtgctggaggcagggagcacaacatatggtgtggcatggggaaatctgtgaagaatgaggcatcagaagaggcaagggtagggcctacactaggacagtccattagggcagtggttctccagatgtgattcccagaccagcagcatcagtatcacctggggatctatttgaaatgcaggttctcaagctgcacttcagacctacctaatcaatactcaaggcctatgtggcccagcaacctgtgttttaacaagacctctgaggaactgagaatcactgctgtaggtcattcacagggtgagctggtccccctccctgccatttgactggttccatgggggactggcaaatagcaaagctgtagagtaaggccaactggagatttaaatctgctccaccacctactaactgggtaactgtgggttacttgttttatctcacaagtcatcttcagtaaaaatggagatgttaatgcttacattggagaattatagaggttgaaatcacaaaagaaagccctttatccagtttgcagcatatgttttctacaagtataagcttctcttgcttcgtccttccctttataactcttttactttccttctgtctttcccatttcttcttctgttcccactgaaagggtccactggccaccccaagctcactgcaaacacacatgccttttttggtcacagagaccagccttagatctcagactcccagtgcctccagggtatagcaatcatatttctaggttaaaaatcaaggcacatgacagctgataaacagatatatctactttggggagcaattagatagaatatttgatattaggattgtcttcggaaatctggatacaaagaaataatatcctattctgtctttaagcataatgcaggactcttaaccctccccatcctcttattcatgtccaaaagttttgttgatgtgggagtgggaaacactatgtgtcccactcacttgtaagtctgagcaagagcttccctatatttagtgcttcctctgaaatgtcctggggattgggaattattttgttagaagccacagtagtgctgtcctaaggctcagagctctttgagtaccttgctagaatgatgctgctccatcttctggctttatgataggcttgcaagatgaaggatggtaacagttggattttggcagggagggaatataaaccagtttgggaatagagaatataatctctgctatagctactcccaaatggccttttcttggttttcttttttatagctctgtaccatttgataatgttgatgagctcttgctgcttgaaactcttgtctttgacttttgagagatcatgctcctttgtatcctaatgatgtgctaacagcttcttttagttttatttatgtagctctttttctgttccttacctcacattccatctttaagcataaatcttgatttcccaaggcttctggccttagcacttttttccagggcaaactctgattttcacaatttcttctgggccattgattcccaaccctgtatatataccctaatctctcttgagcttcccacccacctgcatgtcctgctggccccccatatttaacaccttaaagagaaaatttgtcatcacttcttttgcaaagccaagccaatatttcctcctaatttgtcctatgctttaattgacgtttgcacccaaaaattaactttgacctttttcttttcctcagactagattcaaggtccttcaaacatgacttcactcacctttttagccatcactccctccactcccctttcccaaccctaacctctccaaactccactacttgttcaccatcacatttcccagtcttcttctctgagacttggcttaatctcatttctctgcttcaaatgcccctccctttcctcctgtatctggtaccatcctacccatcctttaagggctatcttcattgccacacaaaacctttctatagcccaatacccatgtgtaatcaacctcctttctctgaagtcttgtactaggccagcacatgccaggcactgtatatccaccatctgagttcaccctctctataaccctgcctgtgaggcaaacattattacccccattttgcagatgaaaaaactgagacccaaggttgtatagttagaaactctttggcttttgtgaaattatactcctagatgtcataattacatgctgacaattacatttaagtttgtgtttctgactcctcttctattcctcacctcctattgtcattgctactttctaaagtagtaaagcccagaatcgaaggtaggtatgcgtgcccataaaaccacctttgcgtcctgctggaaagatatgcattgttggtacctggaaaccctttgttcttcaggtaaggactgcagctgagtcacagtgagcagatccctgcacacagtaggagctcaatgaatgaatgttggatggaagatggatgagcagagcaaagtgcattttaacaaaaattgtagcaagttaaaagttaattctgtacacaaatggaagatttggaaccaatttccaggttaagtttagtttacattttcaaaacaactcagaagatgagggaggaacatccctttgctccggcttgtgtttgtgaggagagaacacagaagccccacacagctgttaacgccttctggattagcgttcctctcacctccatgcacatacctgtcagctctcagttcagtgttttataccctacaaagcagatggtagagtagaattatccccattttataggtgaagaaactgggacccagaggcagaatagtttataagttaagagcagagtctctagagccagactgtgcctctactggaataatggcttcagtagttattggctgtgtgaactgcaaattatttaacttctttgagcttcagctacctcatctgtaagatatgaatagtaatagtttttccttaaagggctgctgtgaggcttgaatgaattaatgtatataacgtgtttagaatagtgcctgacataatagcgctctttattagctaacatcatcataattatcattacacctttagctagtagtataacaaggtcttaaattcagattattttttctacctgtattccctctctgtggtgttatgttagaaaaaacactagtccagaaggctgaccatttgatgactgtaggcaagttacttttgttaaacctcatctataaaatgagggcatgaaggtgatgatctttaaaattctgtccaattctgacagtcattgattctaagtaggccctgacaacaggcttgcaagttggttagttgtttttgtgaccactaggtcctagattggctttgtccagggtatagctgagccttgtgacctgagggcccaggtatatcagctggactaaatgggggacaaaagtcagcgatctgcttctgggaaaagccaggcatggagttcctgaaaagaagactgcaaagtaaaaaagtatagacagtggaatcagccagatctgggcctgggagacctcaaagagcaccacagatagtgtcctgagcagaaggttggtaattgatactgagatactctttgacccttgataaaaagctatggatatagctttaaactacaggtcttaatggtgctctgggttggggctgtatgtgcttactgagttctaacaatgcccacttgggacccatcttttccaggagaggggagacttctctataaaaatttactttagtaagccagtgaccagcttttctttttcttcactgaggccaaaacaaggagaaattgacttttagtacaattggaagaaagcaagttcaacataaaaatgaatgtcctcagcatcaggggcacctatgattaaaggtggctgtgtacatctcctgtagggttctttaagaataggagccaactggcttatgatatcatagatggagttcagtatagataatgagtagacattggtagtacagtttgataattgtaagagcacacaaagttagaagacccagcttcataatgtattacttgtgttattggctgaaggactaggtcacctttctgagcctcagtttcctcatctttaaaatataggtaaatggccaggtgcagttgctcacacctgtaatcctagcactttgggaggctgaggtgggcagatcacttgaggtcaggagtttgagaccaccctggccaacatggaaaaacccccatctctactaaaaatacaaaaattagctgggcatggtggcgtgcgcctgtagtcccagctacttgggaggccgagacaccagaatcgcttgaacccaggaggtggaggttgcagtgagccaagactgcgccactgcactccaacctgggcaacagagagagattccgtcccaaaaaataaaaatgaatgaatgaatgaatgaatggtaatagtgaggcccagttgattccgtaaggatcaagtgatgtagtagatgtgaaaacacttagcaaagcgtaaagcatgaggtatttgaaaggtggtgttgtgaaaggtcctgctggaaatttattttttatctatcctgaagagctcaccctatgccttaccttctgtggaaggcacaaagatgaatcctgagccatgacagatgcatctggcaggacctgaacaaaacatgttaacttaagtcaaagatcagcatgtgtgtatgtgtgtgtgtgttcatatatatgtgttcgtatgtgttgtgcatttattttgagaacctagggttattctgtggctagcatgttggagggtagatatatgagacaggatgtatattctatagactatttctattgtcttaaagttgttttagttttggtcttatggagccattattgccttgagcaaagtaggctgatggaaaagctgacttctagaggacttgttcagaaattcaatgcttgggagagagtgcttgagtctctttgcctgataggccatgtgttctctattctggaatctgttaccccaaatgctgagaagactgatggcccatacaagctggaacagttgagggaaaaagaacaaataacacagtgagcaggatggtaaagagaggcagactacctccccacccccaccccatccctatcaccgtgcttagatgagtttcatgaatgtctgtttgctggtatggcagtggaatagatgtctgcctgctcttgtgtggagcccagtcctgctagccgtgaagtctagtgagcagggttagcgtgcattccatgcacaggtcctgccttgccagctgatctccagctcatcacttgcttgttcagttttgccatccatcaaatgcagaattcaacccagacctctccccctactgtatctcacaggatggttgtacaaatcactgagagaatgtgtgctaaagttgagtttcttgggtacaaggcatcacagaaagccatattctttcctacccatgacctctctggatggcatcatgtgtgagtgagaggaggaggctgcaggactggggtccattatgcgtgaggaatgttatggtctgttaccccaggaggagggtcacggtggggttaaataatgtaccaccaactctcaattggtcagttccaaggaggaggaggaaagggggaggagcacagggaattgaaagcaaataagcttgagtctcattttagccattgctgtcagcctctccacccattcctgacctagagctgccttgaagcaccaaggagagatggactggagctttctttgttctgcacaggagaagttcatgattagggataaaaagcatgaggcatatgtagtacatattcatattctgggtcattccatgcactggctaacagagagttgacagtattgtttgtcttgcggtctaatggaacttttgttccagtgccatccccctcacccctatctctcaccacttgagtatatgagtttctctgtaagtagtagagctctgtgggtgggggaaggggcaagcaaggtagctgtgtggactgaacacattctcattttgtctcctaagctgatcactggagattccatcgttagtgctgaggcagtatgggatcacgtcaccatggccaaccgggagttggcatttaaagctggcgacgtcatcaaagtcttggatgcttccaacaaggattggtggtggggccagatcgacgatgaggagggatggtttcctgccagctttgtgagggtgagtgtcagtcttcactctcctctcctatttccttggctgcctgtacctggcttccccttcaccagcctctgttctcctgtttatttctctcctggtggcttttctcatatttttttcctttttttaaaattgtctcatacagagaacctgggcttcctttaatctgtgcccttttaatttttagacttttcatttgtctcttgtttaacacccccgccccaccacctcccacctttgtacaaatcacttaccttgtctgggtcttggtttcctcttttggggttggccttggtggtttttgaataagactttttaaccctatattgctgtgaacttttgtctttcttatctctcttttttctgctttctatttctcatcttttttttattctttcttctcgtagtttcttcccatctcctcctcttgctcctctgctcttctctccttcctgtctacttctttgcctctcacacccctgtgtgttgtcactgtgtattcagatgttaatataagagtgtgagctccctgccccccaggcgctagagcttactgatatcaaattttacttttttcaagagaatcaagtggctgggatctaaatgtgctgggggtgggaagcaagtggcatgtaaggtcttgcaagccttctgcctctttgacattgtaccatgaagaacctggcccttaacagagaggctcttgggaggaatttctcagcagtttttgctttttctgggtcactgtaaaggaagtgatcccaatgtgcttatgacctcagggtgctatgggagaataacattggttaggtgtctcagctcttattttttcttggaattgtgagctggaatcagctatttgactattttgagctctgattttcctcatctgcacaatggtcttgacagttctttaatgccagggcatgtcacagtgaatgagataaaacatgcgaaaactgctttgtggcaagacaagtactgaagctacatgagggtgtcttataactatccttacgacagcctatcacgttttgttagtttctcctgtaaaattaggctgaagtcttctagaccccaaacaaaaggtcagaagggctagctagggctcctagaggttgaagggccccaatattagaattatggcaatgtgatataaagaaaggaacagggcatttggagttagaaaactctagatacagttttactaccttctagctctatagcttttggtaagatttttaacttccctgagccctgatttcctcatctgaaaaatagggataacagactttttataaggaattagatcatacatgccaataaggtgtctagcacagtgctagacagatattaggaacttagcaaatggtaacttattttatgattatcatcataattataatcatcaccactacctttttagctccaagaaggtccatgtatcaaggcttcccttgaggttgatagaggcctccttcctcaaggtaaaaaatccagaaagtattgttacctggttgggacagtttaggtgagggcactgcctagaagcagaggaatggacaaaattacctctcattcccttctatcatgagaatcttctaatgaaatatccaatcttttcttctcttcagtcagagtctgcaaatgccatctgtgtcccatctcatctttgctggttaaagaatcagtcccagggatagtcagaaaaagcgtatcaataaccacagaccttcaggactaatgtgaggccctgtacgcatacagctggtatgtcttgtgcttacagacctccctctttaaaagaaggattaaactgtaccaaatgatgatgtcacccaaatccaaatgcatttcattttcaaggaaatgttacttttataataaatagtaaatccaaggatggggggaaatgattgagcaagccaggatggctcagggaagcaaatgacagagccagacttcagaatatcagtgggcagccattaatgcccctaagtccaaggccgggaggagtgttcctacaggaacaaagccccagcagccagagtctagctcaagtggttctcaaccctggctatacaacagaatcacttcagtagcacaaaaaaaaaaaaaaaacaaaaaacaacaagaagaacccaaacaaacaaaaacactaacacccagcctccaggctagtaaaataagatcatttgactaaattggtaactgacatggtgaggtatcttcattccctacctggaagtctcattgctgacatttgaaccctaggatggataatcaagggtggttagtgtggttctgttcaagttagccctacctgttgttacacattaaaacccaacctgcagtctgggaaacccagatgcttgcctcagttctattattagaaatgcaacttgagcagcttcctatgcatcttcaaatatcagttttcttccttgtaaaatggggacaattcagtcttgtaaaaatgctttgttacctgtgatatgctggatacttgtaaagaggaattataataccatttagccactgtacaggaacttaccaggtatatgtgtcttgacctattcacacctgtctcctctgttgttcagaatttcatacttgtatgtgcttatgtgtgtgtatatgtgtgtgtgtgtgttctcaggttctttcctttctgtactggggatatggcttcacaagagcaatgtaggagctgatataccttcccagtagttggtaaggttaaatgaattaaacttgctgaacatcagtcctcatatctagttgtcgacatcgtcagctgttttcctgggctggtttccctgctaggagctaagggtagactgctaggatatgattgtgtctctaagtagcaaatcccacctctgtggtgggcctccttttgtctaatagaccctaacttcaagtcattcaggctcttttcctttgtcactgtgcacaaaatgaaccttttttttctgactttgggccatggcctgaggagagcttgctgcctaattaagggtaggttgtggacaggacacatgacaacctgttactgatgggaggtgaggctcgtgtgacaaggcatgggtttggtcagaaagtaaagagcttgctgaggtgtcatcaggagctggatatatacttttcttgttctttcaaattctttatttctctggtttctggcctgcttggaagtatggagatgaaaggatcacctaagccaatcattaccatcatttcttggctttctacagaccagatgtcatggaaacccaacttttccttttcaaaggaaagcccattgttccagagtgtgacctggcttttatttatgtattatctctttttggctgcaaaaagagatacttgggaaaagcttttcacctctatgaaaccctagattcactgtagatttagaactgaaaataaccatcttagccaagagtggccaacttagatgcttacaggggccaattaagtgagtgaaacaaattgagacaaggggtaagtgggcacctgtgtccaactgggagatccatgccccatctaaagacagcaaaagtgacttggatggttcccatcattagagtgggatatagtggagaggaaagcccagaggggccagatcttctagtatttcaagaaaagccgggaattggatttttatgtaaaactctttatatttaaaaaaatgttaatgaggaattcatatttttaaagaagcacagtgagagtcaaacaaaacacatctgtaggataaattatctcccaaggacccagcttgttgccattggtcaccctacctccacgttgtataaatactgaggcaacatgggcccagaaaatggaaatgacttgctttctcatgtagggaattagtggcaaagccaggacttgaacccaggcctcctgaatcttaagacaattttactagacagtctttgtctaataagtttaatgtcttggcttcctttggtatgttttctgccaaattatttttttcctgtgaataggtcacatgttcctgttttcttgtaggccttgcaattttttgttgaaaacttggcattttcaatattataatgtggtaactctagaaatcagattttcttctctccccagggttttctactgttgattgttgagggctgtggttgtccatttgtttagtgactttttccaactatttttgcaagaccgtattcttgttatatatggtcactgaagtctctgttcttttatctcattggtcagccaataacctgacatttctttaaacatctggatccaagaagaaacaaacaatactactttcctggtttttgtagcttgactctgagctggagtacccacttgagactgtgccaggtcatcaactcttctgtctcagccttctcctcctgtttgtatgtagatcacacatcctccagaaatataagcctatggtcctctgaggtttttttctgagcatgcatctggtcctgggcatgcgtgttatagtgtgacttccctggtatgcatggtggcccttatgaatccttattccccaaagaaacttcctttttagcttcctccttcctgtgctattgcatgtgtttgctatttgtcctgtccacaatcccttgtcccaagtgggcatgagcagtgtatgtctttaaatctttcaacaaaggcagccacagcctggaaagcctctccagccagaggtcaacctctgtgctagtccctcagtgccaaaaaggtcaaaatgcacagctacaatattgtaaagaacaaggtcattatctcctggcaccagcaagccacaccaggaatgtgggccactgtcacctcagccactggggaatggggaatggtaagaggataagcaaaagtgcttcaatgctctcttaccaaatttttgctgcccttttctgcattacacagtcccctgtaagttgctgcaagttttggattagattctagagttccaaaacaatgtgttctgtcattcattgccagtttaaggttgtttcagtggaagaactgattctttgtgtgccctgctccaccacttttagtgatgttgtccccttctgaatcttaatcctgtgctttctggcctatagcataatcaagaaagggcaggcttgggctgctaacaagactgttaacacttgaggacttaccttccattccagactaaaggcaatagtgtttttgcgttcttgagaggagtttcactataccaacccttgtttatccattcaagcttcaaagtgttcataagtctctagtcttaaacatttatatcatttatgtagaaggtcttgcttgtggccctagaggtaacacattataggttgtgagtttaggctgacattaacagggagagtctttctccctggattatggctatttctctcccctgtactagaatttcaaatgacattattataactcatttgcattcacataatccatcttaatggcttctcactatgcacattttttggattacatcatctagtacatcatttggctaattggaggttttttatttttttcttttaatatggagacctcttcagctcagagagaatcttaaatgtagctgttacatcacccagatgattcctccaaattaggtagcacaggtcaccctcatagaaatcccaagttgaaagcaaccttgagagtcatatagcctatccctcagcctccaggcaggaccagagctaaaattaccctgggcttttgagaacctggccagcatctgtaaaccaagcttgaactactctgttatttccagctactagcccttatgctgtagtctgagccaatttcttgaaacatgttgcttttttcaataggaagatggtatttaagagttgacaccagtaggagacattctgaatggttttcttggctctggggctttccaaggccctattgttgacccatagcatggatttgtaacctggttggctgcctgagttgaggctatgatcttgggcctggcacctgtttttctctgtgtaatcaacccccgggtttatttggggattagcttagaccttcctagcatcgtgtatatactgccttggtggtgtgatgacttgaggagaggaggaccatgactgagtacctggagatgaggtctgtttctgtggctctttgtaaagtacaacatttttggaaaatcatcatacttgtatatatatattttcttttttcatcagtatatttatcattatgagtaagagtgaaaccacttatctttacatggctctagtgctattaatatcttctcaccagtatttactaagtcctgaacaaaagtgactgtctagcacttagcaacagccacctcctggagtggtctagacaagtactaagggtatctggcatcttgagaggtctgttgtcctctatattagagggtcactagagaaacaatactcagaagtgggttggtctctttttttagttttcagaagtgaaaactgacagctccatacctcttcaggccaccagttatacctcaggacagatctgaaatagtttgtccttaagttgaactagaatctgtctttctggagcttctactcatgggaagggtgtaaatgtccaagagaactggctctggagataatctttctggattagaatcagagcctttccatttattagcaaagtggccattgtatgcttcagtgatctcatcattaaattgaggatataacaacacctatctcattaagttgtcaggagaactaaacaaaatacaggaagagcactgacaatgggatctgacacataggaaacactcaataataatactggtaatacttgcagcaaactcttaatgtaaatggtagaaataatgtcctcatttttccctgctcctctctcaaaccctcttggaatatactgactctccactctgtctatagcccatcagagatctgaaacctcagaccaggtcagccaagcctctcctgtcctccaggcttctgagctttcaccttttagccattatttggatgaatcagtttcttgttgctgctatgtgtgagtggctagactgaggccatccgggcatgcaaggcccactccattcagccacttgtatgagaacatgggctacatggaggcctggacatgctgacactgccaggctttcaagactaataggaatgatattacaactaatgaccctgctgaacatgtaattggacaatgttctttcttggctgttctgacctctaccaagaggcataataatgttactggggccatacatcagcagttagcttccatttaggaacaaataaatggtggaacattgtgttatatgtaggaacccaagaatggattgaaaaacttctttttaaaatatactggggaaaaaagccataataatagacctgaacattctgcccattggtccaactctttgttttgataagcttattaaggtagtacagttattgacattgctgctcagtagagcttggccctgaatgccatgtgccatgtgtgcgatggactcattcccatatttatataaagtaagcatagcttactgttaagcgtacatttaataaagatgctatatacgggacagggccagcagtagccctgaaaaacagtgcagccagatgaacttgaatttggggcaggtcctagaggttcactttcccttgtgggttgggataggctgagagtgtgtgcgcagtgggtaaggtccctcccaactgaaaatattgggagaaagtccagcccagtaggtagagtgtagcatcagtaggcagcagacagagggtggtttgttgtcatgacaagtgactggtattattggtccaacgtcaggttgtttagtgtgcttcaataagcaggtaaagcatggtgaccaggtatccagaggcagggagtatgcagtgaaaatggtttcttaatttgtagaatgaaggacttaataaaaattcattcacccaacagatgatcatcaaatggctactgagaagatacagaggtactctagaacttcagcccatcctctaagagtctgatagtagatgtgaaaacttatgcataagggaggtgatttgccaaagctctgtcactttagtcaagttctttacctttgccaaatctcacttttctcccctgaaagatggaggggttggaacagatatactccaagaacttttctagcccattctccataatttcttcttctttttttttttttctttgagacaggatcttatgcttttgccctggctggaagtgtagtggtgtgatcatggctcgctgtagccccaaactcttgggcccaggcagtcctgccacctcagcctcctgagtagctgggactacaggcacctgccaccacacccagctaattttttgtattttttgtagatgcaggatttcaccatgttgcccagactggtcttgaactcctagactcaagcaatccacctgcttcagcctcccaaagtgctgggattataggtgtgagccaccaccctggctaatcttgttttagttgaggtaaaataaacataacatcaccttccccatttcaatcattttaaagtatacaattcaatgcatttgcaatgttgtacaaccatcaccactatctcattccagaacttttttatcaccacaaaaagaactccatacccattcacactcattcctcactcctctctcctctcagtctgtagatggtataatgttttgtacaaatgttagcaggtagaaaatacaggatagttagggaagggattaaattcataggaactgaggtcaggaagaggcatatgacttcagtagctataggagactacatcagcctggatacaggctaaaaggagtaaaaaacataagacagatgttgcgggaaaagcctcaatagggaacaggtgtcatctaaggcattggtactatcctggaggatcagaaagtaaatgagaccctgccagacttgcctttaacttgttagtaaatggcatagcccaaacaagatcacattccaactccaaagccagtgtttgccacatcaccatcctgaagtgttttttttttttcttttctaaatgtctgtcaaataattgcaagctttctgtgagatgggtaactcaggtcagcttgatttcagcattctgcttagcgtggctttcatcatgaaatcggtacttccatatctgaatagcttaaatggaagtcttctcttcattttagctcaaatagaaagaaaatcaaaggaaatacagaataaatgaacttctaaaggtcctggcagagcactccttttttggctacttaactaattaacctaaattctatcaacgtctaagcaggataattccatgaaaaccaatgaaaggagaagacttaggggtagagtggagtgtagttcttattagaggcatctagttttcttgactgggaaggaagctatgttatctgtgaagggtttccctacactccaatccacccccattctagcttgagttctcactttaagaagccttgtcatgggcagaaatcatcaatacctccagcctcgactaagtaagtctccattcgttgggaagggtttttgagtctggttgtcaaggaggtggcatttggggtataagaaatttgggacaattgcaaagcaattacaaaagtacttcctaaaactcttccctgactagagaggacaatgtttctcatatgttgcttcattgttctaggggcagatgatgccaacctaggggataataacaagaacagctaatatttgactctgtgctagaaactgttttacatgcacagtttaataaggattaaataaactaccttatttaatcctcacaacagccccatgagatagatagatattatttctatttcagaggtaaggaaactgaggatcagaaaacttaaagttgcttactctgtgttactcagaggtagttgtagagccaggatttgaaatcaggatcccgagtcttcaccctttaccactgtcacagactgtctctcctaattttggcctaagagtccagagactttgcttcaatcctgactgccactttgatgcatccccctgtctggccttggatttctcatctgggaaatggaaataaaaaggtttgcttgcctgccttgcagggctgttttgaagtccaagtaagagagttcgtgggaagacactgttcttgaactaggttttcagagaagccagggacaaaagaagaatgatagaaaagagtagggaaggccttcctgaagaaggagtagggggcaggctttagaaggatacaaggtacagaggtgtgaataaacagaatgtgttggaatgaatgggaagggtagcttgcctgaggtcacacgtctgtgttgaagagcagtgaaactcggtgggtcggtcccattttaatgtgctgatgggaagccatgaatgcaaaaacagtatattcacacaggtcttttctttttctctttttgtctgttatataacaaaaattttcattgctctggttgaagctccttatttctcattgtgttggtgctggagagggagaacaatttgttagcagccttcttattatgatacttcatataattagtgagagttattaaatcttcccttgaggggtagaggagtagtttctgtgtctgactgtacataccgtgctgattgtctttgtgccaggcaggaatgctaagtgcttcctggcatgcacattcaggaatccctaagcacttctgatcctcctgaaagctgagactggggctccaaaactgggtgtgtgtgtgtgtgtgtgtgtgtgtgtgtgtatgtgaagtgggagctctgcttgcaactaaccaggttcctctcagtccctcacattcacctttgtatccacacttcaccattgcttcactgtggtggcagagaaaaggccttttggtgacctttgttattgaagagttcacgttccctccaatctctcctttatctgtgttttgcccttttgtagtgtttgctgagatttttggctggcaactttattcagacagagacagagctcatgattagaatgattagaattatctgaaaaaggaaagggctgccttgggagacagtaatctcatcattcgttgtgttcaagcagataggctgtgcaattgctggcagggtatgttgtcaagggagtttatgtattgattggggagcaaggggtggcatggactagtccaccttccatttcctttataaactgattctatagctctgagagtctattgttcaataagactggcaataacccctcaccttctcaaaggatgtcttgctttttactcctctctggttgattagatttggcctttgaaaatatcaaggtgagatttagacaataccgcttacccattctcttctcagaaatattacactgctggagacaggggccggctggctttctaagacactccttgagcctttattgactttatgaaggaattactggctggatattatggtagttttcttttagaactactgatccatttgcagggaggggctactaaagatgttgaagaggttgtaccaagggctgggtaatcatcactttatcatatggaacaatggtgagtctattggaatatgcatataggtatataaatgcaaggagagaggttgacaaggatttcacacaaaatccataaccatggtttcctcaggagaggtagaatatggttaggatgaggaacaatcaggggaaatttcaccttatctagacagttttagctttttatgtatttattttaatagagatataatttccataccataaaatttaccattttaaagtatacagtttagtgggttttagtatattcacaaagttgtataaccatcaccattgtctaattctggaacatatttttaaaatcatttttaatagataaaactgtatatatttgggggatgtaatgttttgatatatatatatgtatacacatattgtggaatgattaacatatcatcatctcgcatacttatcattttttgtagtgagaacatttaaaactgtactttcttagcaattttccaataataatagtattctattacataactatgccatattttggtttatccattcatcaattaatgaacatttgggttgtttctacttttggttgttatgtataatgctactatgaacatttgtgtacaagaatttgtgtgagcatgtgtttttatttctcttgagtacgcacctacgagtggaattgttgaatcatatggtaactatatgcttaactttttgaggaactgccaaaatattttccacagcagctctaccattttacattcctgccagcagtgcgtgggagttccaatttcttcacatgctcgtcaatacttgttattgaccttttaaattattacagccattctaggacgtgtgaagtggtatctttttatggttttggtttgcatttctcagatggctaatgatattgagcatcttttcatgtatttattggccatttatatgtcttctttggagaaatgtctattcagatattttgcccatttttaagcgagttgttactttattgttaagttacatatattctgaatactacatctttatcagatatatgatatgcagatatttttcccattactgggttgccttttcactttattgatggtatcatttgtagcacaaagtttttaattttgttgaagtccactttatttttgcttggttgcttgtgttctaggtgtcatatctaagaaactattgtctaatgttacagattttcctctatgttttctttaatgacttttataatctgattccattcagatatttcatccattttgatttaatttttgtgtatagtgtaaagtaggagccaaagttcattctcctgcatgtggatatccagttgtaccagcaccatttgttgaaaaaactatattttcccccttgaataatcctggcacctttgacaaatatcaattcagcatgaatgtaggatatatttctggactcctggttttatttcattgatctttatatctattcttgtgccagtcccccattctcttgattactgtaggtttgtagtaagttttgaaatcagaaagtgtgagtcctccaactttattctcctttttcaaaattgttttggttatcctaggtcccttgaaattccatacgagttttagtaccagtttttcaattttctgcagacaccaggtgagattttgataggtattgcgttgaatctgaattaatctgaggagtattgctatattagcaccattaaatcttccaatccatgaataggagaggtttttctatatagttcttctttactttctttcaataatgctttgcagttttcattgtataagactgcacttcttttgttaaatttattcctatgtattctttcttttcctatttaaatgtgatcattttcttaatttaactctcagattgttcattgctagtatatagaaacataattgatttttatatcctgcaacattgctgaacttatttattcattataaaaggtttttttttggtggattccttatgatttcctgtatatcacgttatatgatctgtgactagagatagttttacttctttctgatgcaatgtcttttatttctttttttgtccaattgctctggctagaaccttcagtataaggttgaataaaagtgatgaaagtgaatatccttgtcttgttcttgattgtaggatgaaagccttcagtctttcaccattaaatatgatattaactatggattttttataaatgttcattattatttggagaaaagttcccttctatttctagtttgtttagtattttttttttaatcatgaaagggtgttggattttgcaaatgccttttctgtgcctgttgagatgatcatgtgggattttgtaaccttatttcactcatatggtgtaatttacatggactgattttcatatgtgaagcaaccttccattcctggaatcgcatctggtaaggtgggcaatttgtttttaatatgttgctggatttggtttgctagtattttattgaggatttctatatttttgttatttggaagggtttgtgaaagattgatgttagttattttttaaatgtttggtagaattcaccagtgaagccatctagtcctgaggttttttttttttttttttttttttctcccatgtgggaagttttcaagattgaatgaaattatttattaaatctttttcttgttataggtcttctcagattttctacttcttcttgagtcagtttctgtaggttgtgtctttctaggactttatccatttcatcaggttatgtaatttattggcatacaattggtcataatattccctttaattcttatttctgtaagactggtagtaatatttcttctttcatccatgattttaataattttaatctattttttctattttaactttttgcaaggcaaatgtgttcttgtataatgtataattttaaaaatagaaaaaaaaatggaaggcacaaaataaaaatgcacattaaagatatgggtatattgctaactccctggctgtctctgtgggtatcagtttctttattacgaaattgagaggatggattactgttgctgaagtttttgaaagcctttggactatagtatttctatgtttgagcatgggattaaaggacatagatgagaatatttgtggacggaaaatagaccagtctgggaggaacccaatattcctaaaggaagtagtaggaagtaagagtggaaatacagattggagtcagattatggtaatattttaatgtcagggtgagggatttggacttgctttataatcagtggagagctattaaggattttgggtttatgggattagccagtcaatgtgatagtcaaggaaattggtctaatagtggtatgtgggaagggtaaaagctagaggatcacccagggacttgttcaggtataaaagtatgagagcaatgacagtgaaaatagaaaagggagtaataaagaccagagattgtctccaatttggaaagcactccgtggtttagaaggaggagggaggagtgagttgtcttgctcatcctcatgtccttcacagttagtggttaggcacagaataggtccaaagtatttgttaaattgaactgcattaatcagccttgcttcggagttcagtgaagttcaaaggctggtttccccagcctttaagcactctaagaggacttccaggacagcctttcaacctggcatgttccaggcattgtctatcttcttacttgtcacccaggcatctatatgtgctaattgcagcatcaatgaagaaaaggtacacattagcctgcacggattgttgggcagggttgataatggctctctggtctgatatttcaaccagggcagataagcatatgggctgacctgtgtcagtgcactctgacatacatgcagacaaagaccttcctctgtacagaacagataagctctcaagagcagaggacttagaggttagaccagaaagtcttatcattaggcccgggggatgttttgtgggaacctgggatcaggagaaaaacagttaggccttatatgccacctttttctaggctaagaaacatcttccctcaaatgtcagctctataaagggcagtgatttctgtcttttttatttgctgttgtatccctaatacctggcacattatccacacttggcatagatttaatgaatgaatgaatctgttagtagttctttgggatgaaagcagcatcttaacctaaggaatgggcttctggggttgttgcagtagagtagatgaaggtgtcttctcagaagctccttatgaaggaccctgctacacaggcctttagttataaccagaaggacttctctaccaaattctttataaggaatctgttttcacttggctgcagttgccttcgtcttttctcattgttatttggaacgacagtgtcatggtgtatagcttgaacctaaatgtggttctatttctgcctttacatctgcttcccctttccttcatatcctgtcttcattcccactagaattgttcaaaatattcatcttattccagctatccaaaagtgaacatttggacctgacttttcttaaactcctaagaagaaaagaaatgattcttattccttaaaggcctgcctatgttaccctttccatagcagagtttagcttgctttgtgagaagcagggaaaagctaatggattattaagagggtgaggttttcattggtacaaatagacagcatcatgtatatgagatgtttgtttcagtgccttaaatcactttttttttttgcccaggtctattcttttgaataattatctctcatattgcttactgattgcattaaaggacagctattagcatattgaagacacaaagctgaccttttagaagctggaaagatatttataatggagcacttgcagagggtgataggttttggatagagatacattttgcaaatttggctgtatatacaaaatacataaaaacagagtgagccctatttactttggcctgtgacaattcagtgagatatacgctggtgacatctctaagttcactgagtggtaatcatgccccctcacctcctgtgagaaaaagaaagaaggaagaatatacagagttgggaagtaactaccatccttctagttctatcccaaagcctcttccccccgagtgattacccactaaaaggcttttctgatggcagaaatagggatgcatctaaattgtgtgattttagcttcttgaggcaggaatgtggaaaaaactggggtttaaggagggaaaatatggaaaatatggagaattgattaaacctgttgagacaactggcaagctctttggctaattacccctgacagattttgtcactctgccaagcgggcccacccttcgtttccttcctgcccccatggtttccccacttcctaggactgtggggggtggcgggaagggctatcttcttgggccttcttgattttcagtcaaagtcatctagaatatccagagacatctcactcggccgtcccaaaggttttttttttttttttttttttttagcttcccactgccttcatgatttaggatggacagtctcaactgttagcgaatttatcagtttctgatgattctaataattgtctgcccaccttggcccaagccctttccttttcttttcctgtcttccttagaaccagaggcacaaagattctagcacagtgtttaaaagcataggctctagagacagactggctcctatcccagctcctctgcttcctgtgcgacttgggatagattacttaacttctctgagcctcagtctccttttctgtgaaatggtgataatagtggtacctatctagcagggctgaatacagtatattgcaagctcttagcacagtgaatggtgtatagttggtgccaattaatagctattgctagtatgtggtggggaagtattctcccatccctatcccagtcttgaagaggtagagatctttgcatgtccaaggcactttacagtcaaattttgatgattatttgtatatcccatcacagaaatcaacactaaactttgttttcaagacacccactctagtatttaactttggcctctatacttgcaggtgcataaatgctgtgttttgacagcaatccaaatgtggcactcaagatgtatagcttaacctttttaaaaatccagttgtgctacctagatgtgctccagcatgaatgaatttagtccctccactctatttacagataggtcaccagagacctagagaagattaaacccatgcccagggcaaaaagtcaccctagagccaggtttcgaattctacttgcacaggtctctggttgaaggttctctgaatacctgagaagttcagttcatcctttttctacttgcctggaaacctcccaaagaaggaagctaactcattatttttcttttgcctgcttccacagctctgggtgaaccaggaggatgaggtggaggaggggcccagcgatgtgcagaacggacacctggaccccaattcagactgcctctgtctggggcggccactacagaaccgggaccagatgcgggccaatgtcatcaatgagataatgagcactgagcgtcactacatcaagcacctcaaggatatttgtgaggtaaccatggtggttcatgtggaggcacttccacgaagaaccagcaaccctcctgggccctgcctgtgacagtcccaagatgttggaaagggcacatagcctcccagattctgttcagtgaggtgaaactgcttccttagggtcagtgaggtaaaactgcttccttagggtttctcaatctctgtttttcacatttttctctctgtctagttttaatatttattcatttatattcattgtctctctgtctttaccctttcttagtcttcctccttctctcccctgcatctctacctttatctttttggtatctgatccagttacagccatctcatgtaagggcttaacctcactcattaaagcaaaatgcatctcccgccaagccagtgattcacagacttcaatatgtaccagagtttctgggggagcttgttaagcagccctctcactcttgtcccccaagtcatgaattatcagtctcaggtaaggcatgagcatttttaggtttaatgagcatccctggtgattctgatgctgctggtcctactctctcacttggagaacaccggttgtgagtttaagcagaaaagagcttggagacaggactccacagaagatggaggctggatggacaaacctgggctccttcagtatgtcactttttttccccaagagctgtctctctacattccctaaccccattccttccatctctctgtcctaaatgaagatgagagccttcactctcgtactctcttaagcttagtagctgcaagttggcatttttaaagggcattttactgaacaggaagggaaaaccaatgggaaatgaaggcagcgttttaaaaggattaaacacacacacacacacacacacacacacacacacacacacacacattctctcttatatctttcttcttgactcggaaaactctgcattgaatctttttgtctccttccttccagaggaggggttaggttctattttctgtcccccagcctagggtccactgtggagtcagtagtacagctccaacatttttcaaagttcttatttctctacatcagtactgcccaatggaacttcctgcaatgatgaaaatgttccatgtctgcattctccaatatagtagctataagccaacaatttatggttgttgaagagttaaaatgtggctggtatgactgagaaatggaattttaaattgtatttacatttaattaactttaatttaggtaaccatatatctgtaatgacagccacattgaacagtatagctctggaaacaccaaggccaaggattttgtgcctgaactttctttatctcaactcattttctcacccctttcaggaagattaaaagttatcttttcccactgccccactccctgccctgccatgaggcagatagagtagaaagaacaagaggtctggggacatggaatgctggtttttcacattctaacttggtcattaattaaccctgtgggcttgaagataccccttaactcctctgacattcaattttcttatttttccaatgggcttcattatagcaatctcttaagtttgttgaggaaattaagtaaatagaatattgcaataacctatgctgtatttggaaaaaggtaattttcttttttgcctcctttttaaatttattcacccatccatccatatgtctttttcttcttcctcctcccttcacatcaatggctgatgctaaaaaaattccccctcggaatgtgctacatggcattcagcatcaaaccactgacatttcattcattcggcaaacttttagtggaattctgttctgtgccaggcctggacataacttctagcctcaaagtgtcgtactttagagcagcatctgcatcacctggaaacttgttataaatgcaaaatctttggctccaacccagacttactgaatcagattatgcattttaacaaagttactatttgatgtataatacatattaaagtttgaggagcattgctccaaaatgatacctatattacaatgtcatagtgtttttcataaaattaagtacaatctattcttcgcttggtagctgagggatgctgtcaagatctaagtcaggtcatatcactcctctgctcagaaccttccaatggctcaccatttctacctgagtaaaagtcaaagttattattgtttacaggggcctgtgtggtcaacccatccttgcctctatgactttcacctcctgctcctttctgctatgctttcgttactactccagctatactggcctcttgcttttccttcagcattactaatatattcctcccttagagcctttgcactggtttttccctctgcttaaagcattcccctccccaccccacatttacatggctcccatcctcagctccttcaagtctttgctcaaatatcatcttcttgagacttctctaagcattctattgaaacctgtaaccttgcactgcctctgcccctttcctgctttatttctatctgttacatttatctatctgacatattatatatttaacttatatattttgtttattgtctgtctcctctactggaatgtactttccatgaagggcagggattttcatctattgatttactgatatattcccccagcacagtgcctggtacatagtagatgctcgataaatattgcttaaagtcaaaattaaatataattgctcacatgtatgtactgctttgattggcaaagtacattcacatcatatgtcatttgatcttcaaacaggacaaaagttgttattgttattcctattttctagatcaacagatttaatctctaagaagcaaaattattttcccagagctctcaggtactagcccagtggaagtccttagaagtttctctcaactcccacacatcttggcctcttcctatgggacacagactcaggacagcaatggaagttatttgtctttccagaaagtagggggtgatatgatcctgctttaaggagtttccaatccagccaacccaatcaaaccttttgttgacaatttgctggttccttatttttcaacaattattggtgctgaaggtaagtatttaaatgggagctatctccttttctcaccctataatcacgggcatcaaagggaagtggagaaagctgcatctagctggatcagaagacagtagtttagcccaggattgtgtaatctttaaaccaaaagctgtgaggagcgaatggtttatcagaaagaataccagactcagaattgggagtgctgggttcaggacctaccttggtcactaactgactggggaatctcagatgagtcttttcaccctagggcttgtaccccatctctaaattgcataggttggaggagctctttaagttctgtttggctcttactttttctctagttctgtaagatgtagatatgccctcactagagaaaaactgtgatagcgagccaggctacttctgcattttctgcttcttccttcttggtaccattggaagcatgtcttactcaagcatggatgtgttaacatggcataaaccactctttctgtaggttatgggagagctctaaacacttcctacttttgtacttgttgaaggggaaagggggaaaattatattcaatataaaaaaagtcacactatttattagaggacattctttttccctcctgggagcagaaagtgctttacaaacatttaagttataacacccttattttacaaatgaagaagtaggaaataaaggggtttttaattgaagttattcaatgaggtcagtaagagacataatcttttcaaatgagttctctgcagattacattcttctttctaaacccagacagtggtataaaataccttcagtttagttctagatcaccttgaccaacaattggtgatattgcctcttataaccttagaactcaaagtacaatcaaggaaactgaggcaagagtaagcagagctaacgatgctttataaagctgtcttgtctgctttctcttgaggaagataatctcagccatctgatacctatgaaataccttctgtcttcaaatgcctccagagaagctggcctagctttcctcactcactctgtattagtgatcataccattcactatcaagaaattcttccttaggcatgctgtagcttcaagtcatttccatttggtatattttaagcctgaggttttcaaacgtattagccatttgggttttcccttctgcaaattgcctatctcaatacatcccaatagtctttacatcttggcacatagaaaatgataacacattgtataagatagtaatatttgtacagtatcctaggataaaaatatgagtcagctagtcagcctaaaatgccaagcccaggggtttctgcctgccataggccctacctgtccattctgtctggacattctgtgctgtgttcctatactttgcccattttcatggagtttcttatgtttttttcttgctgatttgtaagagttccttgtatattctagatatgaactccttgtcaactttccatgttgcaggtatcttctttattctcttgtttttgaataacttttttacttcatttgaagaaagggtttcctatctcaaagagaggaagaaggaaataaaagaaaaccaccaatttgaacattctgcttctaacttacctttgatcatcaccagcatgggaagaactaattagcatttagttgacaaataactgagcagcaactatatgccaggtattctgttaaactttgaggatacggctgtgaataacaaccatggtcattatctcctaattttcttaaaaatgtcttcaagatgtttgtcaggtcgcctatcaggcctcaggttccaggcaaaaaaaaaaagacatatgaaacccctagaatgtcagaactgaaaggatccatggacatctttttcgatgtcttcattttagagacagagacactgaggtctaaactttttgtgagggcccttccctaaagaatttcctaaaccccagatgatccaggggctgtttggttcatcctattttctggtagtttctaggatcttttctggagatcttgggtattgtttatatcccatatcaaggcattacttctagatcaatgcactaggtctcaactcgtagatcagccctggtgggtttaagaacaaagtgaaatagatgggcagctttccttgctgttaccataacaatgccagagctaatttatgccagttgtgactgatttgataatacccacatttatcttagctactctctggcctgccttcccacccatgcccactttactcctaggagacagagattaggctctaggaaactgcctcccttgagccatagtaccctgttccctgttaccattcagatggggcgttcaaagcatacctggcagtaagagccacagaccccttttgttccccctgccctgtgacaggccttcaatgggccctgagtgttatctaagacaaacaaattttatgtcttccatcattcttcatgatgttgcttttcaggcccctccctaccctgctcactcccctctggctgtgtgctattttcttggtgttcctctgaaaagagggtggactcaaaatttaattctgctctcctgcagtggtatgactaccttccaattgcctctcccatttttgcctctcaatatatttcttcttttttctaactgaaaatggtattaggctttttgacaatcacatttcactgccaactcattttaaacttacataccttcaaaaatgagtgaatgagagtagacaagtattgattgaccccctaatctaccctctgttcaccactgatgtggaaaatttgatagccatcaggccagccaaaagaaggggataaaaaaagcaagactccagggagctaatcatttctcctggcctttctttttccagaaacttgtgtggtatagaggtcgagggtgaccctttggggttatccagctactcccatattcttatgtctcatcgcttatttttttgataagggcagtttacatctattatttgtaatctttagcaagtgactatcttagatactatggctgcaggagatcttgagaagacattgggtcttccctcctctttccttgataatatttcattccaggcagccttcttatagctgcattttcttttctttacactctctggcaaagacttttatcccatttttgatcatgaagacaattaaaaaacagcattagaggaagtttaaaaataggaacaaaaaccagccagaatccatcaactataacagaattatttgcacttttgcataatcccttcaaatctgtccatatgtgtatatatttacagagttgtaatcacactgatataccattttatgtcctactttttaacattgtatcataaacaattttccatgtttctacatggtcttcctaattatcattttaactgctatgtaatatttcatcaagctaaatgtaccagaatatatttataatctatcattggctttaaaaataagagttgataaaacattctaaggtcctaccatcctgtgggcattcttcctaatatatcccctgccataacatacataatataatagaaagaaaatgatttccttgagagtggcaataaataacatatttagggacttaggaagttggactgaattctttattcattgtcttttcctaagatcactctcttagttttatttctgttatattttatgctgatgttgacttctagtatcattgttgaattctggtgattttatggtgttttgtttcttccctgagacttttcaaataggagcagtggacacaactattaaatattttctgaactggcttctcagcagataaatgagctatctacgctgccctcttctgtctctcattgtggtcactcatcagtacctattgcttacccagaagtaatatgttgaatgtgccactgttactgttttcccccagctgtgctcctcagcctgccttagggaaaaaaaagtgggagaaggggtaaggaagccttcactcccatttaatgttgagatgatatgctcactgctctccctgctccattgtagctaagacacgtccagagatggtagggtgaaagagacagatagacaggcacacaggcacagaccaacccagacatactaggctctgggaattacatattaggtagggaagggcctacaggagtttattgccattccttctggtagtcaatgtaaaactttctagggaggcagaatttggggagcaacctctgtaaaggtagtggagccaaaagggtgttctgggaattttcttcctgatcaaaaattgcatatgaaagaatgcaggaaattttcaacatgtcagtcaatgagggcacaaatcattagttaaacagatgtcaacacaggcatagactattaatttgccaactatttaaagacacctactaattaatggctaaattggagagtgagaacagatatgggaaggggaagtgagatttgttgtagaggtcagtaaaagacattgaagccagggatgaggatcttcttggagtgtgcccagatgacctcattggtagctgtgttaagggagacaaagcgaggatagggacagggctatatgtggtaaatcagtccctgtaaaactcttccttaggggttcaacccttaagaaaagtgttaagataatttcacttagctttttgatgaaagcaaatgactataatttcttctcaccaagaacatttttatgtgttactgatttctaatgaggacagtaactatcaagtgaaaacctatgatagtaggttccaaatggaagatgcaatttagattggggctgtttttgtcctgacttaagtatgccttgagtctggtttatgttaccccaatgctttcttactagaccaagaatctctttcatcctttttttctctttcatcagtggttatctttattaatgtgttttatgtgtttagggcacatttatgtgtttaagacacatgtgttaggtgttaggacatattaacgtgttaggacacatttatttataaatatatatatatatgatatatttataaatttatatatatatatataaatttataaatgtgtcctaaacacctgttctgttaaaaacaccatgtccaggcacacataggcttgttggctgagctcatctaaatgatcactcctggccagctacctcagatagttgagaaatttgctttgagaaatggtttgacagatatttgcataatgtgaatagtatgaatgcattttcttaaagtatgtgaagacatgaatgtctaagaaaatattgtatgtgtactttgatgtacacaacagggaaagtctaaaatgataaacaactattattcctggttatttcctgacattaaagttcatgaggaaacttttttttgaagaaatggttttgttttgtcaatttctgttcccttgtgggaagtttttctgttctggcctctgttcccaattttttgtcaatgttattaagacctttggtttggtcctataaggaatagaactttagagatgtgaatggatccagctaaaccagtagctaataagacctgtgaaaatgtgctcaaccagcttcttggaaagggatatttgactttgggggtcttcttcatagaggatggagggaaaagactttggagtctttgcactcttaagacttttgctggcaacccagctttcctaattactcactgggggagtgacttccttctgtaaacctcagtttcctcatatgaaaaatgaaaataattattccatgcctacttcttgggaccaaaatgaggctcttaagtgcttaggaagtgtaaagccttctggaagtcagggacttcctcagcctaggctttttctttgtctacagggctatctgaagcagtgccggaagagaagggacatgttcagtgacgagcaactgaaggtaatctttgggaacattgaagatatctacagatttcagatgggctttgtgagagacctggagaaacagtataacaatgatgacccccacctcagcgagataggaccctgcttcctagagcacgtaagtatcttatccatttggggagggttttgagaggtgttaggaaacaatggaaggagcgtttgagctgtctggttctgttcagctcctttttcctgcagtggggaatgggttcctcttgggccttcattttgacccctggtctctagccaggaaacaaggacttagaaaagtgctgtgatttgccctataaatgttaagcatgtgtatgacctgctggttccattcccgaatgtatattccagagaaactcacagaagtccacaagggagcacatacaaggctgttgttgattgcatggcagtgtcgtatgtggtggagtaccattagaagcaacctaggattctccttctttaccattcccctcccctctccctttccttcttggcagttaccagtagaatttttcttcatcttcccttttttgtttctgttaagtttccatgagactcagtattttgggaggaattcaaaatattcactgcacagagaatcaaggaatctgagaaataacaaggaccatggttagtaagaaagtggtccctgcaagacatttatgggaagggcactggagaaggtgaagtgacaaaaataggaaaagaacacatggacttcgaggatggagctctgggaaacaggatagtgacgatttgagtcctgtatctgtagtgtctgtctgggttactttgggcaagtccttcatgggctttggtttgttcatctggaatgtgaggttacactgtatgatctctctggttctttgacatcatctgagtctcattcacaggtgacctagttgttttgacagcatgtttccccttttaataaagtatttatttttaaagatttaatatgtgcacttaatataaaattcaaatgacacacaaaagcatgcagctaaaaataagccttcttggaaatattcctgttttacttctgagactctgtgttggggtgggttccctaagatcactcttatgtttagtgatttggactcagaatatggttatattgaatgtggtttaggactcagaacatgtttatactcatagctatgatttattatagcaaaatgattcgaagtaaaatcagcaaaaggaaaaggcacacagggcaaagtgcagaggaaaccaggcacaagctttcaggagtccatcccccaatggagtcacacaggatgcacataaatcccctaggaatgagttgggacaacacatataaaatgttgtctgccaagaaaactcattagagactcagtgtccaaggttcttattgtgggctcatcatgtagacaccttctgcctagtgtgtactaaaattacagactcccagaaggaaagcaggtatttagcataaaccacattgtttgtacaggcagtctggacacagtgagccactcttatcagggaatagtgggggaaccctcttgagaaccaagtttcaagatgccagtcaaggggaaatatttccagcaggtttttctgagaacagcaatttcaggcctgatacgataactcttttctgtatggtatgtaaactcattcaaccattctagaaagcacctgggtagtatttataaatgttaaggatgtgtatgaccttctggttccattcttgaatgtatattccagagaaactctcacagaagtccacaagggagcacatacaaggctgttgttgattgcatggcagtgtcgtatgtgttggaataccattagaagcaacctaggtatttatcaccagggagatatataagtggatggggtttgcttattgtgaggtattatgtagcaacaaaccgaagactagatgtatgtaccttatagcaacatatatcagaaacatagtattgaatggggaaagtagaatatagaatagtggttctcaaccgggggctgccctgtacattgtaggatgtttaacagcattcctggtctctagccactagatgtctgtagcaatgccttgctacccagttgtgacaaccaaaaatgtctccagacattgacaaatgtcccctggggaaaaaaaagaatcacttatgttttgaaatgataacatacttttacctttaatctgttaatgcagtgaatttggattgaatgattttcatatgtgaaatgaacattgtattactgggatagaccccacttaaacactgtgtgttatctcttttaatgtattattttaccttttaaaattaattgtttacccttttattagttctagaatttcatttttatcagctttacgtagatataatttacatacaataagattcattcattttaagtgattttaagtgtatactttaaggagttttaacaaatgtatatagttgtgtaaccaccataataatcaaaatataggacatttctataactccacaaagtcctcttatctagacattgcaaacaatctgtgcccctactcctggctactggcaaacattgatctcctttttatttgaaattttgctttttctagaatgtcatatatgtgaaatcatacagtatataatcttttatgtttagcttctttcatttaacatagtgcctttgatatccatccatgctgttgcatatatctttcgtttatccttttttattgcttagtagcactccattgcatggatataccacctattcacaaattaatggatatttgagttgtctccagttttgaactctaatgcataaagctgctatgaacattctagtacaatattttttgagaatatatgttttcatttttcttggttaaggacttccagggttagggttgctaggtggcatggtagattttttagcttattagataatgccaaactattttccaaagtttctataccattttgcattttcactactaatacgtaagagttgaagttactccacatggtcatcaacacttgatattatcagtatttttttttttttttggagacagagtcttgcttcgttacccaggctggagtgcagtggtgcaatcttggcttgtagcaacctctgcctcccaggttcaagcaattctcctgcctcactgtcccaagtagctgggattacaggcatgtgccattacacccagctaatttttgtctttttagtagagatggggtttcaccatgttggccaggctggtctcaaactccttacctcaagtgatcttcccacctcggcctcccaaagtgctgactgggattataagcgtgagccatcgtgcctggccagtcactatttttttttttaattttcgccattctaacatgtaggtgtgtagtggtatctcattgtaattttaatttacatttccaatgtatagtgatgttgagcattttttcatgtgtttatttgccatctatataaaaactggtgaagtgtctattcatgtatttttcccgttttaagtgtattgtttgtttttttattgtttagttttgagagttcttttattaaaaattaatatgtaatttacttatttatggggtacatgtggttttttttttttttttttgagatggaatctcactctgtgacgcaggctggagtgcagtggtgctatctcagctcactgcaacttctgactcccgggttccagcaattctcctgcctcaacctcctgagtagctgggattacaggcatgtgctaccacgcccagctaatttttgcatttttttagtagagacggggtttcaccatattagctaggctcgtctggaactcctgacctcgtgatccatccaccttggcctcccaaattgctgggactacatgtggtgttttgatacatgaatacaatgtgtaatgattaaatcagggtaattgggatagccatcatctcaaacatttatcatttatttgtgttgggggcattccaaatcttctagctattttgaaacaagcaattaattattgttaactacaattgtttttataactattttgaaatatgccattaattattgttaactgctgtgatatcaaacactagaacttatttcttctatataactgtagttttatacccattaaacaacctctcttcatccttctctccccacaaccttcctaacttctggtaactactactatactctccacctccatgagatcaactttgatagcccctactcacatatgagtgaaaacatatgatatttgtctttctgtgcctggcttatttcagttgacataatgtcttccagttccacccatgttgctgcaaatgacaggattttctttttatagctcaataatattccattgtgtatatatagcaacatgttcttcatccattgatccatcagtgggcacttaggttgattccatatcttggctattttgaatagtgctgtgataaacaagggagtgcaaatatctcttctgacatattgatttttcttcttttggctatatacaatatatacccagcagtgggattgctggatcatatggtacttctgtgtttagttttccataccattttccataatggctgtactaatttacattccgatcagcagtgtatgagagttctctgttctctgcatcctcttcagcatttgttattttttgtctttttgataataaccattctaactgcggtgagatgatatgtccttgtgattttgatttgcatttccctgatgattaatgatgttgggcatttttcatatgcctattggccatttgtatgtcttcttttaagaaatgtctgttcagagcatttgcccacttttaaatcagattatttgtgtttttttgctattgagttgtttgagtcacttacatattttggctattaatgttttgtcagatggatagtttgcagatattttctctcattctgtatgttgttgcttcactctgttgattgtttcccttgctgtgcagaagctttttagcttgatataatcccatttgggtatttctgcttttgttatctgtgctttagaggtattactcaatagagtctttgtgcatatcaatgacctgaggcatttttccagtgttttattctagtagttttatagtttcaagtcttacgtttaagtcgttcatctattttgattttattttttcatatggtgagagataggggtctagttttattcttttgcatatggacatccagtttgtccaagaacataagttgaagaggctgtcctttctccaatatgtgttcttggtgtctttactgaaaatgaattggctgtaaatgcatgggtatattttgggattctctattctgttcaattggtctatgtgtctgtttttacttcagtaccatgcttttttggttactatagctttacagtgtattttgaagttaggtagtgtgatgcctccagctttgttctttttgctcgggattgctttggctattctgggtcttttgtgggtccatatgaaccttaggatttttttcccatttctgtggtgaatgtcattggtattttgatagagattgcatttaatctgtagattgcttttggtagtatattttagcaatattaatttaacaatattaatttaatattaattaattgcatttaatctataggttgctttaggcagtacattttaacaatattaattcttcccatccatcaatatgggatatctttccctttttgtgtgtagttgtcaatttttttcagcagtgctttttatttttattttagagatctttcacttctgtggttaaatttattcctatttttttttaaatcctgttttaaatgggattgcttttttggtttctttttcagattgttcactattggcaaacagaagtgcacctgctttttgtatgttgattttgtatcctgcaactttactgaatttgttgatcatttccagcatttcgtgtgtgtaggtagtctttaggtttttctaaatataagattatatcatctgctaacaaggataatttgatttcttccttttcaatatggataccctttatttcattctcttgcctaaattgctctggctagaacatgcagtactacactgaacataagtggtaaaagtgggcattcttgtcttggtctagatcttggaggaaaggcttttgatttttttcctgttcagtatgatgatagctgtgggtttgtgatatatggcttttattattttgatgcatgttccttctgtacccagtttgttgtctttttctcatggagggatcttgaattttatgaaatgctttttcagcatctattgaagtgatcatacaggttttgtccttggttctgttaatgtaatgtatcacgtttatttatttgcatatgttgaaccaaacttttgtccctgggatgagacccacttgatcatcgtgagtgatctttttaatgtgttgtttaattcagtttgctagtattttgtttggaatttttgcatctatgtttgccagtaatattggcctgtagttttctttttttgatgtgtttttgtctggtttgggtaccagggtaatgctggcctcatagaatgagtttgaagtattcctcctctttacttttttgaaataatttgcatagaattattatcagttcttttttaaatgtttggtggaattcagcagtgaaaccgtaaggtccttggcttttctttgatgagacactttttattactgttttgatcttgttacttgttattggtttgttcaggttttctatttattcatggttcaatcttggtacgtcatatgtatccaggaatttatccatttcttctaggttttccaatttgtttgcctgtagttgttcatattctctgtaatgatcctttgtatttttgtggtatcagttatattctcccttttcacctctgatttcatttatttgagtattctttttttcttagtctagctaaagatttgttgattttgagtatcttttcaaaaaaaacaacttttcatttcattgatcttttgtatttttcagccttaatttcatttatttctgctctggtgtttgttatttatttccttctactagctttgggtttggtttgttcttgccttcctaattctttgaagtgacttggtagattatttatttgaagactttctttttcttttttgatgaaagcttttattgccataaattttcctctttgtactgcttttgctttatttcataggctttagtatcttgtgttttcattttcatttgttttgagaaatttctattttttaaaagaattttgttatttacccactgatcattcaggagcaatgtatttaatttcggtgtatttgtacagtttcttaagtgctcttcttactgatttctagtgttgtttcattgtggtcagaaaagacacttgatattaatttgactttttaaaatttgttgagatttgtttatggcctaacatatggcctgttttcaagaatgttctatatgctgatgaggaaaatgtgtagtctccagcagttggatgatatgttctgttattttcagttacgtacatttggtctatagtacaactgaaatccagtatttctttgttgatatcttgtctggataatctgttcattgctgaaagtgagtgttgaagttccctattattatggtgttgtagtctgtctctctgtttaaatctactaatatttgttgtgtatatttgggtgctccagtgttgggtgcatgcgaatttataattgttatatcctgtagctgaattgacccatttattattatataatgacattctttgtcttttcttacagtttttgacctgaagtctgtttcgtatgatatatgtgtagccactgctgctcttttgtggtttctatttgtacgcagtatctttttccatcccttcacttttagtctctatgtgtcttattcactagaaattcacttaaagaagtgaacttcttgaaggcagcatatagttggatgctgttttttttaatccattcagccactctcttttaattggagaatttagtcccatttacattcaatgttatttttgaaaggtaaggacttactactgccattttgttattattttctgattgttttgtaactcctgtcttccattattttactactatcttcctttgttgtttagtgatttttctctggtggcatgtattaattatttgcttttgttagtgtatcttttacaggtttttgctttgatgttactgtggggcttagaacatcttattataaactgatgacaacttaactttgatcaaaagaaaaattaaaaactaaaatctctaaaatttaagtccattacttccccattttaactttttgttttctcagtttacatctttttatattgcctatcccttaataaattgcctttttgttttgttttgtttttgagatggagtcttgctctgtctcccaggctggagtgcagtggcacgatctcggctcactgcaacctctgcctcccgagttcaagcgattctcctatctcagcttcctgagtaggtgggattataggcacgtgccatcacactcagctaatttttgtattttttagtacagatggagtttcaccatgttggccaggctgaccttaataaattgtcattatttttgatagatttttttcagtcttcatactaaagttgtgaacggtttacacaccacaattcagtatttgtctgcatagtttattctgaatttgtctatatacgtttaccagtttattttataacttcaggtgttttcttgatacatattagtgttcttttaagattgaacaactggcttcagcagttcatgtaagacaaatcttctgttgatgaattccctcagcttctgtctgggaaagtctgtatctctccttcatgtttgaaggatggctctgctgggcacagtatgggaggtttttttgttgttgttgttttgtttttttcattcagtactttgaatatgttgcccccctccctcctgccctgtaggacttacactgaaaactctgttaccacaggaattgaaactcctttatatgttatttgcttcttttctcttgctgcttttaagatttccctctttgtctgttaacctttgagagtttgattattatatgccttagggtaatcttatttagattgaacatgtttggttgtctttaaccctgtacctggatatttatatctttctctaggtttggaaaagtctctgttattattactttgaataagctttctaccttttgttctttctcaacatcctctttaaagccaatgaccctttgacttgctcttttgaggctatcccctagatcttgttggcgttcttcatttttctcattattttttctcttcttattgtgtattttcaaatagtcttagggctcaccggttctttcttctgcttgatcaattctgttgttgagaccatcccatgtatttttcagtttgactattgtatttcttagctctaggatttctgtttaattttttaaaatttcaatttcattgttaaatttctgtaatacatttctgaattgcttttctgtgttacattggcattttctgagtttcctgaaaattgctattctgcattcttgatctgagagctcacacaacatcatctcattagggtcagtcactggctccttattttgtctatttgggaatgtcatggtttcctgtttgctctttctatggatatatgtctgtgcatttgcattgaaggattagttctttattccagtcttcactgtctggcttggtttggtctttcagaagtatgtctgtctagaggttttgtgcagagtgactatttagttcccttagcctgagatcactgcctccttttcaacactagatggcaccctgaacccagatttgacatagtctttctcaatttcagagtgctactcatcctggatggggaggaatcccaaagataccccagctctgtgggaaagctggatggaggtttgttcccagaggactgatgaagtgtgcttcctgcaacgtgatgctgttaaacagcctttctgatttggtgtcttttttgaggtcagatgaagggaagctggagtttcatgcactgggtgttgctaaccccacccccaccctctaactctagctgcctttgggattttttactctgcaggcattcaagaggcttcttacaggttgaggcaggaataatttttctggaaaggaatctaagatggtggggaagctagctgtccacttttattttttccagtattataggaaccttgattttgagggtgcctttctacacagtgcctggcagcttggggaaggagctattttaccttttgcttgcagtttttcagttctctgtggcctctgggattgtcacaacttcagtcattgagttctggaatattccttttgataatctgggcagtggctagttctttttggttttctgtggaggagagtaaagctacatatactgtgctattttggtgacattctcagttatgagaattatatattttgttaacaagtcctttgtcagataagttatttgcagacattatatcccagtctgtggcttagcctttcattttcttaactgtgtcttttctaagttgtgcatatttatggagtatgtgagaaatttttaacatatgtataatgcatagtgatcaagtcgggttttagggtacaatgcattttttttaagtatagtcatcctactctgctattgaacattgaatgtattccttctatcttatgtttgtaccctttaacccacttatcttcatgttctcccttctcacctgctcacacttccgtctctgttatttttccaccctctacctccatgtgttcaaattttttagcacccccaaataaatgagaacatgtgatatttgtctttttgtgcctggcttatttcacttaagacaatgacctctagtttcatctacgttgatgcaaatgacataatttcattctttttatggctgaatactattccattgtgtagaagtaccatattttctttatccattcatttgttgatggacacttagattgattccttatctttgctattatgaatgttgctgcggtaaatatgcaagtgccagtattcctttgatataatgatttattttctttaagtcaatacacagtaatgggattgctggattgaatggtaattcgatttttagttttaagagtatcttaattttattgaaatccagtttatcgctttattttattttatgggtcatactttttgtttcctactttctttgcctatctcaaaatcataacggttttctacttttttaaaaatagaagttatatagttttattttttacatttaggcctatgatcccttttgtggtaatttttatatatggcacaaaatacagatcaaggttaattggtttctgtatggatatttgttaaaaaatactgattcccctattgaattgcctgggcacctttgtcaaaaatcaattaagcatatatgtgcagatctatttttaggtatactcttctgttctagtgatctatatgactattcttgtaatagtaacccactttcttgattaatataggttcatagcaagtctttaaatcagatagcataactcctccaacttagttctttttcaaaacaattttagctattttaggttatttgtatttctatataaatttaagaataatcttgccaaattttaccaaaaacaagcaaacaaaaaccctatcagtgttttggttgggattgcattaaatctgtggatcagttttgggaacattgatatgatgagtcttcaaatccatgaacatttaactgtttatttcgatttttttgtgatttctcccaggattgttttttagttttcattgtatgattttgaccttttaaaatttgattgttttaaaaaatatttaaggtataaatttaagatgtacaatgtgatgttttgatataaatgatgaagtgatgactacagtcaaacagattaacatatcatctcacatagttacttttttgtggtaatagtatctaaaatttactctcttagcaaatttccagtgtataatacaataatgttgactctagtccccatgctgtaggttagatctctagacttttcctgtgtaactacaactttgtgccctttgacttatatcttcccattttctcccaccccctcacctctggtcaccaccatcctaatctgtttctatgtattcattttttttttccttttgattccacatataagtgaaatcatgcagtagttttctttctgtgactggattatttcatgtagcataatgtcctctaggttcctccatgttgtgacaaatgacataatctccttccctccttctttttaaagtctgaataatattctattctgtgtctctgtatgtatatgtaatatatatataaataaattaaaaatagaggtaatttattaaaatataggcaacatattacatatacatatacacccgacagtttctttacccatttatccattaatggacactttgtttgcttccacatcttggctattgttaatagtactgcaatgaacatgggagtgcagatatctttacaaggtagtgagtgcatttcctttgggcatatactcaaaagagggattactggataatttgataattctatttttgatttctttgggaacatcttaaaggtattattttccacagtggctgctgtaccaatatatattcctactaacagtgtacaagggtctccttttctctaaacccttgtcaacacttgttatgtcttatctttttgataatacccatcctaatagatgctaggttatttctcattgtggttttgatatgcattttcctgatgattaatgatgttgagcatcatcgtatacctgttggctatttttatgtcttttttggaggaatgtctattcaaattctttgctcatttcttaattagtttatttgtttatttgtttttttttgctgtgaagtgatgtgagttccttatatattttgaatattaaccactttatatattttatatatattaaccactttatgtatattttgaatattaaccactttacagtttgcaaatattttcactcagtctataggctacctttgcatgttgttgactttttttttctgcatagcagctttttaatttgatgcagtcccacttgtttctttttgcttttgttgcctgtgcttttggtgtcatataaaaaagcacagcagtagtgcttttagtagttttattatttcagctcttatgtttcagtctcttatgcattttgagttgatttttgtgtatggtctaaaatatgggcccaattttgttcttttgcatatagatatccagtttttccaacaacatttattgaagagactatacgttccccattgtgtcctgttggtgctcttgtcaaaaattagttcactatatttgcttcggtttatttctggactctctattctattacattggtatatctgtttttatgctagtaccatactgttttgatttccatagttttctaatattgtttgaaatcaaagagtgtgatgcctccagatttatttttatttctcagagttgctttggctatcaagggtctagtttggttccatagaaattttatatatgtttttgtctatttccatgaaaaatgccattggaatttagataggggttgtgttgaatctctatatcactttgagtagtagggacattttaacaatattggttcttccaatccttgcacatgggaaatctttctatttctttgtgtcttcttcagtttctttcatcagggtgttttggttttctgtgcacagatctttcaccttcttgaataaatgtattccttaagtatttcattctttttgatggtatcataaatatgattttttaaaatttctttttttgatacatcattataggtataaagagtgcaactgatttttgtacactgattttttttttgtatcctgcatctttactgaattcactttttctaacaggtttttttctttttaatttttggagggagtcttttgggctttctacatatataatcatcttatctccaaatagggctagtttacttctgatccaatttggatgcattttatttatttttcttatctgattgccatggttagtatttctagtactattttgaataaaattggcaagggtgggcatccttgtcttataccagatcttagaggaaaagctttccatttttcaccattgattatgatgttacctgtgggcatctcataaatggcctttcttatgctgaggaaatttttaatattaatacctaatttgtgaagatattttatcctgaaaggatgttgaactttgtgaaagctttttccacatctattgaaataaccgtgtggtttttaaattattccttttgctaatgtaatgtatcataataattgatttggatttgttaagccatacttgcatcccagggataaatcccacttggtcatgatgtatgatctttttgatatgttactgaattgggttagctactattttattgagaatctttatacctatgatcattagtgatactggcttgtagttttcttttcttcttttttttttttgacagagtctcgctctgtcacccaggctggagtgcagtggcgcaatgtcggctcactgcaagctccacctcctgggttcacgccattctcctgcctcggcctcccaagtagctgggactacaggcgcccgccaccacgcctggctaatttttttgtatttttattagagacggggtttcaccatgttagccaggatggtctcgatctcctgaccttgtgatctgcccacctcggcctcccaaagtgctaggattataggcgtgagccacagcgcctggcccttttcttgtatttctgtctgactttagaatcatttgggagtattccctttagttcttttatttatttatttatttatttatttatttatttatttattgaagagtttaagagggattgctactaattcttatctgggtatttggtagaattcagctgtgaagccatctggtcctatgatcttttgttgttaggagattttaaatgactacttcaatctctttatttgttaatgttcaggctctctatttcttcttgattcaatcttggtaggttttatatttctaggaatatattcatttcctctggtgtttccaagttgttgtcatataattgttcataatagtcccttgtaatccttttcatctctgagacatcttttgtaatatcttcatgttcatttctaattttatttacctatattctttttctctaaaaaccaagtcttagttttgttgatttttttccctaagtttttctgttctctgatttatatctgctttgatcttttatttttttccttctgctatctttgagtttactttgttcttctttttctagttccttgaggtggaatatcagattgtttatttcagattttttttaatgctatcaacgcccctcttagaactttttttgctgcatcccaaaggatttggtatgttgtgctttcaatttcatttgtctcaagatattttttaatttcccttttgattttttctttgacccatttgttattcagggatatgttgtttaatttctactgatttaagaatgttctagttttcttcctgttactgacttgtagttttatatcatcatgaccagaaaagatacttgatatgatgttgatcttcttaaatttgctaagacttattttgtggtatagcatgtggtctattctggacagtattccatgtgtgctttagaagaatttgtgtgatagcctgtctgcgtgggtcagctttggtaacatgtggtagtgagactagaatccctagtttgggaccctagggctgtttgcaggtacatgcatggtagctgtgctgggtcactgggccagagcatccaaggaggtagtacttgcttaagtacctagagaatgcaaaggctcctgtgctgagtccctttgccaaggcacctgtggtaggagtagctcaggcagctctgggcatgggggagggaaagctctggtggatcagggatctggagaatgtgaaagctgttggcctacatcaccccttcccactgggctatagtaaccacagcagcagttgggcagctctgggtggctccaggaagtagagaagaagaagggacatggctcaggcatgttttttgttgttgttgttgttgttgttgttgtttgtttgtttgttttttctcctaaaactcaaaaggaagaaaaaacaacccatggacccttagcagtataagctgcagggcgtctgctgatactatactagcagttggttttctcagcaggaaaagctgaaaaagcttctggggtctgtgactgtgaacactgaagaatcttgagaggtaaaatctacaggaggtacccagtggctatgagggctattgaggtccttgacagagaggcctactggggccctgtgccaaagaggccacggcagatcactgcgactcctgctactttgctgatactgatataaccaatccctattctttgctctctgctgtttccagacatctaggctatatctgtcttttcagagatctgggtgggatgaaactgaagctggtcattagggcagtgtcccataaagctggggaagctggttgtacactcctgtctcctccctgtatgtaggacacaagatccaagatccaagttgctgtttcataatgagcagtaccagctatggggacggggtgatgcaagcaaaatgaaactgtttttcctactcgttttgtgtatttgttttctgactttttctttcactatattgctgtggcttcttaagtggacccctaagcttttccagaattattttttgttcatggatagctaccaaattgttgttgtttgctgaagaaaggaaggcgatatttcctactctgccatcttactgacatcctctcctaaaagttgatttctaagtatttaaaattttttcggctgccattgtaagtggtattttaaaatgtcaatttcctatagtctattactattacacaggaatacggttgatttttgtacattgactttgtgtcctgacacataaccaaattcactaattggttccagtattttttttgtagatttcttaggattttatgcatatacaattatgtcatctctgaaaaaaagagtttaatttcttcttttttcagtctatattctgtctatttccttttttatcttatttcactggccgggatatacagtacggtgttaactagaaatggtgagaacaggcatctttgtcttgttttgatcttaggggcaagcattcaatattttaccaagtaattagcttaacgtttttcatgggtgtcctttattacattgtggtagtgtctttctatttctagtttgctgatgtctttgtcataaatttattttctcaaatgcttattcagcattattgaaacgatcatgtaatttttctcctttaatctgtcaatgtggtaaattacattgggataagtctgtcctgatcatggtatattattctttttatgtgctattttgcttgtttttcaacccttatataacaactctatcttgattttttgttgatcagtttctattgcctattgtttctcttgggttttataaatattttctattctaatgtatcaggttatcttttattaagtacttgtcaatatataataaaaattatagagtttttttaaaactttacttggaattaatttcaaacttatggaaaggttgaaaaataagaaccatacaaaaaatacccagattcccctgttgttaacattttaccattttgtcttatcatttgagtgtgctctccctctctctcctgactctctcctcttcccctctctttatgtacatatttatatgtccatacatacatatacacacactcatacatttttttctcagccattagtgttttaacttgcatacatcttagattccttacctctaaacacttcatcacattgtgtttccttagggacattttatggagataatatcaggctctggattgtgtgattccttcaaacagatatttatttatatttttagcttttccagctactctcagtggcagggtttgcctgcaacaacttagtctgtcattgccagaagtagagtcactgatctcttgctttttgtgatccagtcccagagttttatttccatgctgtgttttactcttattagggccagtgttcccttattacccttcttttacagaatgtccctactattcctatgtactcatttttctataagaaatttacagtcagtttgtcttgttactgaataatttgttttgatatttattattaaattatgaatcaatttaagaataattgactcattatcattttaatatttctgcctaagaatatgatctgtctttccattacttcaagacttcttttggggtccttggtagacttttcctttcctttttttcttttcccacagcaagatggattctggatatactctgagtattgtaacaaccacctggatgcttgcatggagctctccaaactgatgaaggacagccgctaccagcacttctttgaggcctgtcgcctcttgcagcagatgattgacattgctatcgatggtttccttttgactccagtgcagaagatctgcaagtatcccttacagttggctgagctcctaaagtatactgcccaagaccacaggtaagggatcgagggagtcaggagtgaatgagggaacttcctctatctgttggttctcattgagaatacatgtccttttgccctttctgagcttctgttaacttatctgcaaaacaggatgatacattcttgattgcctcatagccaacagggtacagaaggcagagctatcactggctttgttactcacacaaaaggagggtcctttgccactatatttgggttaaaatctgaaatctgcctagggctccagaaccactaaagcatataagatatgatttgttagagaagcagcatcaatccaaaaacgaacccaaagatgtaaaccaaaccaactggcccacacccatggctcatgcatctgggtctgaaagttagccccaaggagaccaagcaatggagctaaatcatacttgtggactgataatattcactaggtaaattatatatggcataattcatcttaaaagttccagaaaaaagtttttaagcatagctcaaagctatgttagtttcttaggccaaaacaacctcagagctttttgggggtttggtgggcaccaaaaagataggacattcgcctgggatttgccatttctgtacactttcaccttgtgactggaactcctgcttcaaagtcctcttgccatctaggtccctgattccctctcctctcaccccttgcgctccagagtgacagtagagtagctcaggcagtgtcaggcgacatcaatttctgccctttctcagagtgacccgttgggcccagcacaactcccacgacatagacaaccccttttggcaggtctcaggaatctgtattaagatgatggctcctgccatgcatgtcaagagtagctcggatttgaaggcaactaaaggctgatgccagcttggaagcttagtaagataggtgttcagataggtagggctgaaatacaggcagtcagaatggcccctgagggagaagattagatgaagaatgataaatagagaagaatactgactttgcttacagatgattgatataattccctaccctaccttccttaagttgatgagaatgaagactgcatgtaagagggaggctagctgacatgtctggaagtagaaaatctttgttctgttgttctccccaataagaggctgggcccagacctcatctgagggctttgaccagggttaggctggaccacagctattcctttcttctcctgccgactgctaaaactagtaggacaggttagagatgggcacattccccctctagccattttgagaaaggcagccagctaaagatggcaaaaataggcagtatgggacactgacagtgaggaatccatgactgagtagtcttggtgtagaggaaatgaacattgtcatgccaggactgcccagtagaactttctgcaacaatgcaaatagtctatatttgtgttattcaatatagtagttacccaccacatgtgactacttgagtactaagaaacatagctagtgcaactgaggaactaaattttaaattttacttaattttgattaaatatggctaatagctaccatgttggacagtacagctctgtgctttacttccaagaaagtggtttagagcactgatctcctcaaatcagagaaaggaaaggtacaggggcagaaaatgggtccaaagagcaggagcacttacttatgttagcagcttctgtgctgcaatcttcccttctgtcaccactctacctccttctaagtgtcaggctcagacatcttgccaaggagaaacttcggtgatgtcacagagcccaaaagatccccatacattggagcaactaactgtaaaagaatgaaatgtaacagaaacaaatgtagagtgtttccattgggtctaagataagaaataaatagctcacggacaggctgagagagatacagcttctagagtgtgttttgaagagacttaggaagtgttagttggccataagctcaatatgggtcagcaatgggatccagaagaaaaactgataatagctaacattcactgaggctcagaataaagacttttctaacatatttgtcttgagacagaatagactggttaggaagtatagtgaaaagcctttcactggaggtgataatgtaacattgtttgagagccatggctctgacaggtgtgcagatcacagattggagtgagggatgtgaactaggaggaggtactacgtaggatctgccctggcaattagaagtccctttcctctgcctttctttggtccatcaacccactattcaatgttgtgggtgtgcagttgtgcagttgtgcaaagatgtgcggttgttgcacatctatttttttctccttccttttttaaaaaatggtactgagagattaagcagactagtgaccacaaggcattttcagtttctctaaagaaaggtgttaacactgaactgtaaggcatcctcttgtcttctcagtttatttttgcccccactgaatggctgagatctcactatcaatctgcctttcccaagagccatttgattgcaaatcagaaaagaacagcagaaaaaaactggataggatatgtaactctcaacacgtctgctatccagagtcccaggatgtggggccaagggttacacgtctgagactaggggttttaagaggcatcccatgtgatggctctactacggaaatgtttgatttgtaataatagtactgctaacatttgttatatgccaagagtaaaatagtttacatggatgattgtatttaatttatgaaaccttcaataaactatacttttccccattttacagatgaggaaattgagtcaatgagagagggagtgaggcttgccaaaggccatactgctagtcagtgagaaaaactggcatttgatcccacaaagtctggcttcagactttatgctcttacccactgtgctacattctgtttctatattgtgcaaaagcaaacgtgaggatatttcagagtgattttgggcagaagctccatagaaatagatgatggaagagatgataaggtggtctatactgtgtcatgtgtgaggctcccttcttggtccttggctggctgtatcagataggacacaaaaaaagtgatgtaacaaaatagtggtccatttgtctctcatgtaaaagaagtatgtattctgaagtttatgactggtatggtggcctcatggtcatcagaaacatgagcaccctacagctatctactatcctatacctagggtattgaccttgtccttatggtccaagatggctaccagaggttcggccatcacatcaacattccaagcatcaggattgagtaaaggctaaagaagcgtatgctctctaccttaaaggtgatttctcagaaggcctacctgatagagcaggagcaccgtcatcttggacaaacactgccacttcaagttccagctccctttctagcctcatgcatttcaaggaaatcacttcttttctaactacaagcagccagaaagagcagacagtaagagagctcaggcacagaaggaggtaggggggaaagtctcttgagtaactgccaaacttcaccctcatacaatgggccccagtaaaacagtgggcgttaataaacacattccttttccttcaggtgcactaagatagagaagatgaaagcagactcaggggatatgcctgcagctgcaaaaagatgtatgggaacagacacacaactctctcttcccagataagcacaacaaagaggcgcaaaagcagtctatgcctctgataaagtctcccaccctgaatccttaaaaactcttagtctgtaagaaagtgtggctctgacctaactcggccagccgctcctctcaggtttatttaaaatcaacctgtccctgttgactgaaaagccatccttcatgtttctctcctctttctttaattcttacactacgcaacacttctatttacatatcagtgtacaaaacttacttgcatagtcatttttgctgaaacaaaagatagaaaatgtagtctttaggtggtgtgggttcccatctgaaaatcaggactctgttactaaggaggtagaggagagtggatgttaagattggcacctagcacattggttctttggcacattggttggttcaacttgcactcttttgttttcacagtgactacaggtatgtggcagctgctttggctgtcatgagaaatgtgactcagcagatcaacgaacgcaagcgacgtttagagaatattgacaagattgctcagtggcaggcttctgtcctagactgggaggtaggaaacttaccaaccagggtattgggaaatctgaatagcttggcaaaagcttcccatcttagctaaggacaggtgaagagaaattacatttgaagagcaacagtaaggatttagattagactcaaggtaaaatttcttgctaatgagaagtgttggatacttgaataactttctaagaagcttggagaaatttttgtgatgatacctcattaagaaatgaaaggttcatttcttcaggtattgccaaggaacaattagggttgattcagtagcctttcaaagctctttctggatttatgaccaacagattcacacttagataagaaatagtatatactaatttacttccagacacagaatacgaggttggttctcctgttcccaaccatgcaggacagccaacatacttttttttttatcggtgataccacctcaccctagcacatctattaggtctctctattaggcctgtacactataggccacaaccatcatccctgccaaatccacagttttcacatctgtttttaaaataatccctgattatttcattgcagacagccatgacttctctgaattctgaaagaccttcccttcctagatgcccaccaaaagtatcaggagtaatgacatttcacatatgtcttgcaggcccaggttgtgcaatctgatagtctgctggctaaaataaccaagataggagaggctggacgtgctactagggagggattagcaatcttaagccttgtggtcacaatatagaggtagggtctgctccctattccactgacctcaactcaagtgtcattttcagtgattaagaggtagtatttctcttaatacttaaagtattttagcccgttccaagggaaccaagcatcatcctcacaaacagctgcttaaccaaggcccagaaaaaagtcactttccttttattctgctacctctgtcctaccttaatgtagattgctgaaaaagaccacaattctgatcagctgacatccttttgggctatatttgaaggataatgttcccatataagtagaacagcactttgatttgcagagaaaggaatttgtctagatgaagagaccctcattctcttaagcagaagccagcactgggccagacttactagaaaattgtgggtccttttttccttgtgttggcattgctttggccatttgcctgattaaaggcagagagctggaccaaatgacttctagcaagcccatcaactctaagacactctaaaattaaggtggattagctggccttattctctctcgttggcagggttttttgtaagagaaggtgcccagcagcagttgtcttcctattccctggagcatctccccaacttcccaatgcctagaagactttctgattcccctgtgtgctctgggacatcagtccttggagcaggagccatggggaaccaaaaatagcatgaaattacctggcctactcagggagcttcagtagcaccaagctcaataacactgagctatgatttaaacactcagcatctcagaaggaatttcctgcatgtatgtctgaatggggccacaaaaacacagttctaacagtgtctgcctcctttattagcctgattgattggtactctaatctcatgtaagcccacacatcccttgtacgctcctgcttggtgaagcctttcttcatctaaattgacatcctacttcattcaggctgctataacaaaataccatagactgggtggcttataaacaacagaaatttatttctcataattgtggaagctgggaagtccaagatcaaggaaccagtagattcagtgcctggtgagggccctcttcatagactgttgtcttctcattgtaacctcacatggcagaaaggatgagagaactctttggggtctcttttatgaatgctattcccatttaattcatgactgcctcattctcatgaccatcatcccccaaggccttacctccaaataccatcacagtagagattatgtttcaacatgtgaattttatggggatacaaacattcagcctatagcaatttgtaagaagaaaaattcttcatggtcttcttgtcagactgaggtcactgtggaacttgccagttccagcgaagttgtcctctaggaagtcttttctctagtaaagcctgatggatatatttcaaaggccaagcctaaagtttctgtcatatttgccatacctgtgttaaagacttctagaatgtcagaatcaccaaggctcttagaggactccccctacaaccctgacgattcttgtgtgtatacacatgcacatatgcacatgtacacatactctcacacacttactctcaaacaccttgcaatgatggtgaaagacagagaagcagagagaggtttatttcctaccaaggccacacagcaagtcagtgacaaagctggaacttgaatctagtcccctgattccttgtgtggtattgttttcagtaaggtaccacatattccttcaaccttctgcctctcacagcccaattgctgttctttgtgatatttcagcgacttgctttttgtatgtagtaaagagtttatatttaaataagacagtgagactaccttggggaggtcatccaaatcccagtcaggtggtgggtgagtgctggggagtctccccaagaaagcaatgagacatggatgctccatggcttgatgatggttaggattggtggcccaatttcacaggttccctggtataggttctttgtgcattccacctgcccaagaagttgtctaggcaaggagagacattctgccagattgccgaggactgctgtgaacagaccgtgcaaatcaagaaaaagatgccatattttgctgtctctgccaccccccttgtctcccagatgtttgaacaaacagagtggctgtcaaaagcatctgcatgataatttcagcttcatttgtcaaatgaaaaagaggagtcataggggaaaccttcagagcttaatctcccttgaagaggaatttggagggtagcatgcaggcaattagtgtctgctcaatagatcagagtgtctggctagagagcaggaagccctgcattatatcaaggcctgacccttctcttagcttattccgtgaacattcttggtctctttgcccaactctggttattatccctgccctctaccattctatagggactagagttcctgaagtaactttccttttaccccaccccccagggctcctgaaaatcaaatggatgagtaaaagtgtcagtcatctctctactaatcaatacattagagcagtatgcgggagcagcagggagaataatctgttcccagggactgcagtttctgggaaatttctatttctaatttccatgatgctgaggtttggttgagctgtcactttgccaccttgcacactcatttaatccacttgaaaacaagggaaaggtaacatatcctggatagcttctttttaatctttttttttttctggagatttgtagcaggaacctaacattgtagctcatatttgggagcttgattgtgtgtggttgtaatttcctctttgtgggatccctctcctcccagcctggttgtgtaatacccaaggacctgttccactttgctatttgatgactgaatccaaagaagttggaggaaacaagaaaacccaacatgatgaaggcagcaaaagcatctacttaaaagctaaagtggcttgatgaggcatactcctgggacaagaagatcaaatgtagggctagatggatttgttactcctctgccttcctgtcagtaggcagcattgaaaataaactagttaaaaagtatggcattccccttgtcctttccctggatctgctcagattacagccccacatcaattggcctataattagaatggggtgaaatcaggcagaatggggtgaattagaattagaatggggtgaggcctcttcgctcgggctctgaccccaaggaaggaaggtagataagctggcaagaaagctttgggtagtttttggtggccactgttcattccacacctattgatttagttgtcaaacagtatttattgagtatttaaatatcaagtactctgtgtcagaccttattctaggttctgcaaagacatcagtgaacatgacaaagtttccactctcattgatttatattccagtagggaaaagaggcaacaaacaaacatatatcatcaggtagatgggcctctgaagaaaaataaagtaggataacaggttagggagtaatgtggatactacctgaggaagtaacagttaagaacagacctgaaggagaggaaggagcaaaccatgtggttttcttggggcacagaattccagacagaggggaaaacaaacacgaagaccctgaaatataggagtgtgtgctaaaggaacaacacggaagccagtgttgttactctacccagagtagagtaagtgagtgagagagtgggagcaaatgaagttagggaggtgactggaggtcagatcctgtcttcataagactgactgttagtttgagtgagatgggagccactggagggtttttgagcaaatacgtgaaattatgagacttatgttttgaacatttcccctcatatgccaggccctatgctgggcaatgaggatattgagatcaatgagatgtggccttgaacatctagtgcggacaaacatattccagcagagggaacagtgtgagcaaaatcctggagggagtgaacagatccaaaggcccacggttggggatttttggaaggagttgtacttttgggggcaagacaaagagatgtgttatataagtggagcagaggaagcaagggtgagatctctaaacaatgagagggctgtctcctttccatgaactcatttgacgctctcaaacagccatgtgaagtgggtcaaacaggaactgttttaatattccccctctacaaatgaggaaacagatggcgagagtttaagctagtttctaactcaagagtgagttggtagcagcattggactcagagcccaggtcttttgagattctcaccttagaaatcttccatggcatctggttgttcccctgggttggtgacagtaggaggagattgggtgggggccatcattctaatgtggtttggtggataagagcataggctttggagggcttctgacctaggttctgcccctttgggcaaattacttccaatttctttgaccctggttttggggtaataacaaaacatcacttactgggttgctatattactaggagacaggataggtatggaaactggggcacacagtaatagtcaagaaaataagtatcacttatgttgagcttatagtgtgatgtgtaccttctaggcactttatatgttttaatttaaataatcctcacaacacccaaatgaagttggtactgttattatccccatgttaatgatgaggcaactgagttatagagagactacgtgtgttgctcaaggttagtcagcttggtgagcatagaggagtattattttaattttttttctaattggtggagttacatgttgcaagtaattaaaatataattgatgctgggcaccgtggctaacatctgtaattccagcactttgggaggctgaggtcggtggatcgcttgaggtcaggagtttgagaccagcctggccaacatagcaaaaaatcatctctactaaaaatataaaaattagctgggcatggtgtcacacacatgcctgtaatgccagctacttgggaggctgagacacaagtatcgcttgaggccaggaggcagagtttgcagtgagccgagatcgtgccactatactgcagcctgggcaacagagggagactctgtctcaaaaaagaaaaaaaaaaatgtagaattgagatgcccctggctggtggagtggatggaccagataatactgggtagccctcctggtcgtatcatccacatttagtaaattgtatatttaaaagtcattctgaccatcttcttatggcattggctctcttttatggctttattggacttcatacatattcaaagtggactgtagcacatcttcctagcctgcatcagggtgggaacctctctcagcttcccatccctccagcaggaaatcgctgtactgctccctaacctggtggctttctttcccagtatcaggcctccagaggttctgtgctagtatgtcagcccctctagaaggagtgtttacctagttcctggataatattgaggctaagtcgggagcctaaagttgaagcagtatttctaagctttttttcggcagtggggtggggggttctattattagaaaataattctactgagttccccctttccttcccatcctttagactggggaaaaaaatggtatgctcgaatacaccatttctagatgccccactctctggcctactaccctgcctgatttgtgtttgcctctgattatttctgggaggtataaaggtctccatctctaaccttgccttgaagcttttgggtgaaaggctgagatcttagcatcaaggtatcagccctatcatgaagatcatcctcatactacatctgggaaaactgacacctagagagagaggaaggaacgggttctccaatgcctttttggcctaaagacagtataatatagtacaaggagtgagcatattctatggagccccagaggttggagttgggtcatggacctgtagctaactagttgggcaactttggcttatcacttgatctttttgtacctctaactgtaaaatgggagcaagaatatctacttcccagggctatcgcgagtctcagataagatagattgaaaatatctggcgcactgtctgactcatataggtgctcaggaaatattaattcttctgtgtcttgggacactactctttgtccctatcttcacataggccctggaatactcacccctgtgcccacaacttcggtgttggtttgccttgtgtttcatgagttttgagcatacctgcattcgtctcctccatgaagacataagctccttgaggacaggggccaggtctaccttgacatctgacacacacctgcaacatacttctgacctatcagagttgccataaagaaggagtaggacttggaaactctgtagaattgaattagctaggacttaggtgtcttggtgcctatttgtgtcagactctttgtagcaaggaggataagtagttctaggctttctggataacagaccaaggaatcatgtggcagttaagtttcttattcaatcagtagattttagtgaactgagaggagaaggaaaaacaattataagaggggagtgggttctttttctctccctctgttatcatcttccttcttgtcctcccgtttccttctactcatgtgggaggcagtgagattaaggcctgttcttcaagtattagaaagagactgagggaccagagcagggattgagagactgggacagaaaaagagatttatagagaagagagatggagaaatatatatatgtgtgtgtgtgtgtgtgtgtgtgtgtgtgtgtgtatgtatatatatatgtgtgtatgtgtgtgtgtgtgtatatatatatatataaagaaaatctctctctctctctttctccacacacatatatatgtgtgtatgtagagagagagagagagagagagaggcagacacagagagagacagacagacagagaacttataggaccagagggtaactggtgtagaaaagctgtagcagtcccgggtggcagggcacatttggccttggggtgaataagaaaatgggtcttcctagctcacagagctgtaaagctttttgaggagtcccaggagtccctctctccctctgtctctaccaggccctttctggcctcttcctatcccagtctatgcccagccttgggtgcctccaggcaggtgatggtgccatccttctgcctggctgcctctcatcatcacatgtccttcccagggcgaggacatcctagacaggagctcggagctgatctacactggggagatggcctggatctaccagccctacggccgcaaccagcagcgggtcttcttcctgtttgaccaccagatggtcctctgcaagaaggtaaccctgcccccttcttccctgagggagatgggtacctaacagggtaccggaccctcctcttcatcatccccaggctcccaacaaagtgggcaaatactgatggggggaaaacagacaggagattggcagcaattctgtatcaggaacactaatgtggcatgaatgtcacaggcagggttggcttgtgggcagtgaaaaactctgaagtcggtgcattttgtcttggtattttttttaccctttgccctaatgaccctggggtgctccttctcactttcttctacccagagctgctggtctgcaccatttgtaaaaaatattgaaatatgtctatcttagttggtaaatagtagtttccctgagcactttccctcatttccactctaatggctctggccatgtggcccctctctgccctgggaaccaacgaggagcctcctacttttgccctgacaggtaggtacctttgtgatataggaattttttccatgcctctacctatttcctatacaaggtgcactggttccccacaacccccaaccgtgctcttctccactcttccttctttgtaatccattagaggagaggtcttactcttgtcactgactctggataactctgtgtatgttggtttctaggactcttctcctttgtgaggctgggaagggtagcatatgttctaagcgtcactcctccttatgggatactcttacccctacttcctcactcacagtagagagttcagaccagttttggctccaggggctaactgggaagaattggggaccaaggaaagtaaaaatggaagaagaaaccagaatgcttagagtgactttacaaattcaccatgctaccctttgctcttttgccatcatctagtccctttgtcctctccttcacccagtagtgaatgcctctgaagaggagtgctgagtcacaaaacaccagagtaaatagtgttacatttttctgggctggaacatgaaccacacagttttaagccccctgtcctctgtgtgtgtatgtgtgtgccatatcttgtattgaatctttatccatttgctttgacagtggattgaggggaaaaacactgagcttaggttcagactgcctcagtgtttggtgataagctctgaatgtccactctagaaccaatagccagtcagttaatggggataataacttacctcagtatggagctaaccctcaaacagagaacttttatgaatctgaaactcagccaaacactaatgcttctttttagctcccccaactcttctcaggactttcataaaatcaggaggtaggatttttgagggttaatttaggtggccatggaaattctcagcatatcagccatgtcaccaacactaatgtgcctgttcttcccactaaggtgtttacactcagaacaagtagccatagaggcagtaaacaaataggaacctggcttattttatagttctgcaccccctaggccctgttaattttggcatctgttagccaaggctgggattactttaactaaattgtgaaactaggctctagaaagcagtggctataagagatagaccaggatccagaacataaaacagtgagtcagaagccaggaataaaggggaagaaacaagataaacaatgggtttaacttagaactcaacgggcagtggaagaccaagatggagtaatgagccatgtctaagccagatagtgggagccaatgattaggaagaaactagaagtcaagccagggctggggattcaaaccagctaagctggcagggtaggggaagcatataacagggatggtgaaaacaagagaaacctcgaagcagtcatagcttcccacagaagggagctttcttgttttcacaagaaccataggctttcttcccaagacacagccagcctagagtctggagtataaaggctaccaactccatatacctgggtgttcttgacactggcttcccagaacacgagcagttatagcctaattgttcaaaggccattaaaactacctgatgtttgttttgaagatttccatttgttatctacaataagactttccattcaacaagtagggataaacttttgaaaaatgatcatgggaccaaaagaaggtatgcagagagacaaggtattttgtctgctgggttgtttagggaccttttgccattactacaaaagactctcttcttgagatagagctgggaggaatggactaggctctctggaggtgaaaattcctttgacaaagagaatccatggaggaaaggaagggaatgtctggattgggccaaggtgagtgaggctgtcaccttgttcacctcaggcacacaatttaattggatgtccgaaagttcagtaatcctttttaccaggaagaaaggaggtgaggatgctaaataatgaaatatggccacattaagctttctgatgatctcatatttaaaaaggaggaaacaaagacccctaggaagtggctaaataatatataatattttacatatgatataatatttaacaggggtgacaaaagagtttcatgaatcctagaatgagtcaaaattagtttttaaaaatgcttaattttaattacttttaaagctatgttcaaatgaagaaaaaagaagtgatagtctgacaaccccctgtttgaggcagatggtttactgataacaggggaatataaattccttctctatcaaggaaaagaagtcataaacttgtttcaaagggaattgaagcccaaaggatctgaggttgtaagagagtactttactgctctgaattctttcatgctatagatattgagcccctcttctgtgccaaccagctctactttcataaggattctagtctaacagaacttaagtatgatgttatttaaaaatatatacatcccagagcactgaaataattctatgatgtcccaagtggaattgctctaggtcatcttgacagaattatgggttccaggagatctgtgagaagactacacataggaaaatgtaccagttttcaaagcagaaaataatatgttctagaaagtagaaatcaacaataaagtattaatgaactagcatttattgagtgcttctatgattctgttctaagaactttacacttattaactcaatttaatcctcacaacaaacctatgaggtaggtactattattatattatttccatgttaaggatatgtaaagtgagacctagataagttatataattttcccaaggtgaaatagctaatgagtgatagagccaggaattacattcagatacgctggctccagattccacattggtaatatttatgtcattattaccattgagcttgtcaaaattctgtacttgattattaaacagcctgtgaacatttagaaagagatacagtggccacaggggtcatctttggctttctgagaacaagtcatatcctataaaactcagtttctattttgccagtaacttaattagttaataggaggattgcacaggacagagagtgtcctcctgcatttcagattttcccatggtttccttgcagacagaagtcatatggagtgatagataaaacataaagtttgtaatcagacaattctgggctcaaatcctgatttcaacactcgctaactatatgatttcaagcaagtgactttttccttcttgtacctccattatatcagttgtgaatggtgagaataactattctacaggattgtcatgaagattaaatggaatcaatgcatataaaatgcctgatagagtgcctggtactcattaatctcatcttacccaacctccaacaaagaaatagacagccttataaagtagtgaggtccccatcactagatgtacccaaatatgggctagattattatgtgccaaagatagtatagtaaacattgaaacactgatctctctccatgagcatgtggcctcaccactaagttctcatccaactgttaagattcccttaattcccagtcaattatgcaacaatgtgcctgttttgtacattgggaattgggattgactaatccactcagaacagcttaaacaacttatgcagcttgtagcttgtttcagagagagagagagagagagagagagaaaaggagagcaagagagtacgtgggcatgtgtgaaggtacctttaaaatggcaattatagtgtgtgggaaagtcaccagtggcttctaattatgtgaccccttctttaatttttgctgtcaccactcttttaacttttcttccaaaaaatccagataagactctgttctttttcttcgtattatctatactgtcagtctctgctcctctgtgtttcattgaatttttattttagtttttgatgtgttttattattttcttcgtgatataattatttgggaaattattttgatgctttgaggggatttttttctctttgactatttactgtggaaaggagcagatccgcttttcctgcaccctctgtcctattgtgccagtctggccatgttctgttgtcccttgtgtcataactgttctttattcctgttgctttcaccatattcaaggggatcagaactaaacaacgtgtaatgatgttgggcagaagacttctgttcagggaagtttctgcatttggacaatttcttcttgcactgaagggtcagacttggaggatgagctatttgggacagcttataaatccaataatagcaacagagatggggctggagcagaaagaagaaggggatttgaaaccagaactcctgagtacttaactttactctgtctcttaactaacttttctaaccattggccagttctttaactttgtccttattttcctcagtgtcaaatcaggctgatgatagaagtcatctcaagaggctttgggagagaaccacctgaggtagtggggaacagtggagtatggggttaagagcatgggtgctagggccagactagaaggcaatctcctttcgcccatgagctatatgaccttgggcaaactttctgtgcttataattatgcccttgtttgcaaaatgagaatgacagtgtatctacaaggaagggaagttgtgagggttaaatgagacaatgcagatgtagtacctggcacatagtaggtacttagtgaatgttggctattaatactattactatatatgcagtgttactaataattcattcagtacttttttatttagaggcaatatagcacattgtaaacaaaagcagagattttagagctggacagcctgaacccaaagccaagctctgccatttagtagcttttattcctggaaaaatttctgttttttcttccaatttttattttagctttagggggtgcatattcaaatttgttacgtaggtaaattgcatgttgccgggttttggtacacaaatgatttcatcacgcaggtaatgaacatagtaccaataggtggttttttattcccaccctcctcccaccttccaccctcaagtaaaccccagtgtctgttgtttccttctttgtgtccctgtgtactcaatatttagctccctcttgtaagcgagaacatgcggtatttggttttctgttcctgtgttaatttgcttaggataatggcctccagttccatccatgttgttgcaaaaggcatgatttcatttattttgatggctttgtggcattttatggtgtatatgtaccacattttctttatccagtctatcattgatcatcatttaggctgactccgtgtatttgctactgtgaaaagtgctgcagtgaacatacgcgtgcatgtgtctttgtggtagaacgatttatattcctttgggtacatacccgataatgggattgctgggtcaaaaggtagttcttttttaagttatttaagaaatatccaaactgctttctatcatggctgtactaatttacattcccaccagcagtgtataagcattctattcctgagaaagcttcttagctgctctatgtctatagttcctcatcagatggggttataacagtacctacattggaggattatttaggttaataaatgcagagcatttaggacagtacatggtacataatatatgctatttaaggggtcactgttgctattattgttgttcttattattttgatgtaattattaagcatgcattctaggatgctggaatatagtagtgagcgaaataaatccagtccaaaccccatgtaccttccctaggatctggagagaaaaggctagagaagagtaactagggtcccctctataaaggggcagggaggaccttatttacaaacaagtgaagcaggctacaatcctgaacagttacattccccagattgcagcatctgtcatttgtagagaatatcctgcaatgtcttactaaggaggaactagctcccttaatgtctcccaattcagacgagcacaaggaaaaaggaggaaggctggcattttattggaaatgataaacttcattaggcaggaaagttgtgatgatccaaatagcatctgttttgagcacctgctcaccgtgtccctgtgaaggcactcagactaccattaacaagtggcatatgggcagcctggttccaacaagaccacaggcaaccagggttcaagaggactttgtccccttgccatgtgcagaggacaaccagaggaaactctggggctttgtcagctgctcttctctggacaatccctaagtgaagcaagaccaaagaagatagagtgctgggcacagcctttaatgggcaggcaaactaaaagctgtgagcagcatggtggctaagtgccaagtgtgtggtatgtcagggccttcacaattggtgtcagaatttggagaaggggagccacatcagcttgagcagtcagagaaagtttatttcaggaataagaatgtgtaagtttgacctcgaaggctaagattggaataggaagcatagttgggccagagagcagctattagtgtgaccccaaatatatatctgttattttggtgacaaataccaccctgtcctgaaaggatgtatagaatttccagggacagtggggcagctatgtaaattgaaaaaatattcagagttacccttgctttgacttatttttactcacaatatttaaattatttggaaagtttaaatgagctaaaggaggtagtgagatgtttttcctttaagtttatcaaaagagggttttaaggactatgaaacactggcccaggagcaagaaagctcagggctgtatttggtggacaagtctggcctcatgtcctggaaatgacatgtttatattagagctttatagctattttacagagtaaggataactgtcttcatttcttagttgaggaaattggggctcagagaggttaactggcttgtccgtaaccatacagctggtaggttaggcagcaaggcatcaaactcagggcttcagactctacatcatgctctttcttttgttccatgctgcttactgcttatagtcttagctactctttctgattggagttcctcaactagtaggtcattcttaattattcctatcacatctttacatttggcttatgacaaatctagcgcctgaaaactcacatttaaccctctgggggaccagggagaacaggcaaagggataattttagtaacacatctctctagccctgtttccccaccacagaagcagaaattctctctagcttcttgtcatccttacatatctaaagaaacaataggagattcaattgatgcttttaatgtagctccaagatcatgcatattctttctatttttgggaactagcaaatgtgttgaaagctctcaatgactatgacacaccaactcggaatgggggcggagcggaaggaggctgcggactgaagttagcaacaaggaagttgaggctgcctgttttaggcaatgtggtccggtgagaatgtgtggttcagatctggctttccaggtttgtatgtattatattatgtatggtaaggcacaattcaaacctttctgagatcgagataaattacattcatacattctgcctagcttatcctgcttttgtacttagattagcctgatagggcccactttttatacatgtgtctcaaaaagtgttcctgagaattgtggaactcagtgtatgggaatcactctatccttttggccaggattgagcttgtgcacactgaacatggtaaaaggaacccaggttctgaaataggcttggggcaacattggccctctctgtatagctgaactcttcctctcctgtgaacttgatcctggggacaaccaatagatcagaatccatctatattcttttcttatttatatgaacaatcattatgggaggaaaaaagtaacatgattgttattttttcaaaagcaattcaacgacatctgtattttccagcctgggcctttgaggttgacagagctatgctgggaaaccttgctatgctgggaatcctgcaaggtagcctttcccagcccaactgaaaatctcagtataccgcacaatgtgaagagttaggattgggaatgtgagtgggcaaaagaagatccttcatagggagcacacagctgagaagtgagtcaagttaggcaattcagtagaatggaaatggtttaattgaactgtaaaatgctaataaaaattaatgagcatttctgactctgtccagctgactgaaagagcagataaagcagagaggagggagagctggcccgaagatatctgtcaggacaggactcataggggccttcctcaacctgactcagccataccacatctcccagcagtggatgtgttctcagaggaggctgagggcagcgccaagaggaggaggggctgaaaggccactccaagatatttataagatctgacattccataggcctatatgtcatttcttccatccctctattttcctttttaacttatgaaatatttgacattcaaaaagatataaaaataatataatgagtacccacgtgtttactatccgcattaagaaataattcattacaaatagttttccttcccaccctctcttctgcttctttttcttccccttcctctcttgcccctccccgttttctgctctgtactgtctggaacgtggcatatatcattgtcacttatttctttataattttctacatacatatgtatctttaaacattatgtggcatttttttgtatgtttttcaaggtaacagatacagatgaggtaaaactatatagaaaggaaaccatggaaatgatgaacataggatttaggatggaggatgccttggagttgtaactttgggattggtggcagattcaccagtactttatattattaaaataagtaagtaaatgaataaatagagaaataaaaatgccatgcatggaccaattatgagtgtctcatggactagggttaggattaatccaattttgtgtctatgagagcaaaacaacaataacaaataggcgacatactgtttgtatccatctacaacttctgtttttctccataagatttgtgacattcatctgtgttgatatgtgaacttctttatttaattttacctccatttctcttggcagactgggccttttctaaaaatccccagagtgctaagtgttagaccccccctaggtaatcctttgccagcagtctgtggcctcctagctactcttactactcagtccccctctgatgttcaggtctcactggcctgcacagatatttgaacacactccaggcaaccagccagctcatttcatacctctagtgggcttgctgatgttttcgaaaaggagaagcccttgctagccgtgtttatgtggcttactgtttcctacctcccatcagcagacttgcacacacgtccaaggattgattctggtgtctgaaatgatctttcgaggtgagacagaggctttttctttgggcatctagttaaccaacctgtcagtgtcagactactagtataacctggccaaatttagaacaaaccaacccccattggtacttcaaaacggtgacagtgttagcattctgctgtgcccctgtgccaactcttctagtactcgccgtgcacataccttcaagaaacctcttccttcccatctaggacctaatccggagagacatcctgtactacaaaggccgcattgacatggataaatatgaggtagttgacattgaggatggcagagatgatgacttcaatgtcagcatgaagaatgcctttaagcttcacaacaaggagactgaggagatacatctgttctttgccaagaagctggaggaaaaaatacgctggctcagggctttcagagaagagaggaaaatggtacaggaagatgaaaaaattggtaagtgacctgagagtagaaagaagaacatggctatgaagaacataggaggtttgaattggtttccattttcttggagtcagagggaagatttctgttgcaaactgacttaagctactttggtggttccttattattaggttctttttggtaagtaccaatagcttccattagtcagtggtaggtttgaactataggttgtcctcccctactagctaagaatatcacactgaaagccagcctcaggcttgattctcccaaacatacatttattagcaaataaacaaaaatcagttatacaacctgttctgtaatcttcataaagcctgagctctctgtcattaggtatatagtttgtactcctgattaggatacttcagatgttaactaaatccccctagactgtagattcaaataatatgcacatacacttcacactttctgtgtggaagtatttaaagtaaattatagaaaatataacaggacttaaaaccatgaccattttcatgatttcaaatcacactgaaacatacttttttgccttacaataagttgtttctcttttccagtggggatatagatagtagagatatttttcatgttgcttcccaactgtgggatttagacgccattggctatagctttgtgacttataaagtactgtctggtctcttgctcatggtcctgcctttctgtcataaaaaataccaagcaaccagacttgttaattccctgagaagacatacagtttctgtctttgccctattgcttatgggagtgaaattgtactttagaaggcctgaaagctcaagtttatggaaattgtctctagaaaaatgggcctactcattgaatcctggtgcaaaagggttctcttatccttccatgtgggcgattgaaattatccagaggtaagaaaggatggtcagaaagacaaatctaactccagtcttctcctcagaacttgggtagagtgcaaattaataactcactttgagtctcattggaatcagactgctttcagtatgtggacactccattgggacatgatgtggagtggcatataaatgttgctggctacttctctcaatagcaagcagcagcagccactgaccttgcctaggctgttagagttattaaaggaatggtcttagtgttcagaccctgaatcaattagaaggcccctgccattcccattggctctaacacaatgtctcccacacaatgccctaataaacctgtgactttatctgcttctaatagaaaagcttctagaaattactttctgaacaggcatatgttcatctttaaaaatgttgaggttttttttttttggtttgataataacagtaaatcacttccattgtaggaaatttagggaaaaagcaacagaaaagtacaagaaaaaaaaaaaacacatgaacatactcagtaataactttcataaacattttgatatatatttccagccttttttatgtgtctaattagaaaaatcaaggtgactgaatcttttttctttctctccccatacctgcctctctatagtggatagatataattttgtatcctcattttcactcatcattatatcattagcatttctatcagatcacttcatatttttaatcattattttatgagggtcatatagttttatcatagcttttttaaacttttactttttaattataaaattaatgcatgaccattataaccatttaaacaaatatggaaatatataaagaaaacttagcattccttccccttctctgtcacttccatactgaatgaaataaccagtgttaacagtgcagtatgcatctttccatacttatctcatgtccatataaacatatacaaacataatacttttatatttacaaaaattatattatatatattaccttgtaggttgcttttttaaacttaatttatcataagtaactccccagataaataatatagaatctaactataaccccttgtatcagttagggttcaaccaaagaggcataacctgtaggagatatatcataccactgctgaaaattgcattacaaggaattggcttatgtgattgtgaatgttgactaagtggctcagaattccatagagcaggcagtcagaaatggaggatcacaggcaggctcaaacccatggacataggccaaagctgtcatctacaggcagtcaggaagagaagctcatgagaaggatgaagtggcacagacatgggctaaagctgtggtgcacaggtagaatttctgccctttctgtgtgagacctaggctctacttttaaggtcttgcaacagattcagtcaggtccatccagattatctaggatattgtcccttatataaagtcaactgattagggcctgtattagcccatgttcacagtgctataaatacctgagactgggtaatttatgaagaaaagaggtttaattgactcacagttctgcaggcttaacaggaagcatcactgggaggcctcaggaaatttagaatcatagtagaaggcaaaggggaagcaagcatcttcttcacatagtggcaggagagagagagagcaagagggaagtgccacatacttttaaaccatcagatctcgtgagaactcacccactatcatgagaacagcatgggagaaattccccccatgatccaatcacctcccactaggcccctcccccaacacatggggattaccattccacatgagatttgggtggggacacagagccaaaccgtatcaggggctttgattatatctgtaaaataccttcatggcaacacctacattagtgaggactacagtctagtcgaatgggcacatcaataaattcatcacacttttcttataaacagctgtataacattccataatattatgtaataaccacagtcatctcttggtatgcacgggatattggttccaggactcccgtgcatatcaaaatccatggatgctcaaatcccttatataaaatgatatagtatttacatataacctatgtacatcctccatatactttcaatcatttctagattatttataatacctaacacaatgtaaatgctatgtaaataattgttatactgtattgtttagggaataaaaacaaggcaaaaatccatatgtgttcagtaaagaagcaaccagccgcttttttctgcatatttttgatccacagttgattgaatccagatgtggaacccatggttacagagggctgactgttcgttttttgctagacattcattttatatttagctttatttcccactacagatattgctgcaataaatatccatgtacgtatctgattgttacttactgatgcttttattcctgtaggatctgtaccctaaagtggaatgactgaatgttaggatgtgaacagttttaatacatacttgcatattaaattctgaaagatttgtagaatctatactcctagcataattttatgagtacccacttccgcatagcctcaccagcactggatagtatctatttgtttcagtttgccatttctcaactagtaaattgaaaaaaagtgttggaaccttttttttttcatatgcttaatggctattttcatttcttttgtgaattgcctcataccctttactcattcttttaacataaatttggaaggactctatattgttgatgtgacactttgtcagtcacgaatttcacgttttcaccagtctgttttttgtcttttgagtttgtttatattgcctacttctataaatatttaaatttttactttgaaaaatgtatctattattccttttttggcccctagtttcatcttgcttaagatctcttgccatccaaactataaaatttcctgattaaaaatatatttttggtttatttttagaacagtaatccatccggaatttacatttttatatgatgtgagaaaggggacctcatttttttcttcaaggtggatagtcagttgcatctgcatcatttattaaataaatcatttattttccacacagtttaaatgccatttttcatatatagtaactctgcatatatacttagatgtgtttttaaactttctattctgttccactcttctgtttgtcatttcttgtatcaagactatgctgtttcaattacagtagattttgagaaagatttaatgcctggtacaatcaattcttattcactcttatcattgcttcttagcagttcttagatgtttattctttgatatgaatatcaaatttatttattctaggtttaaaaacactgccgtaaaaactggcatagaaagcccatttggattctgattggcattatattaaattttttaatatgtaacggcttggcattgttattaagttttcacatttaagacaaggctctgctctcctttcatcaaaatcttgttctgtatgcttcaggaaaatggtagagttttctttagattctgtacatttctgcctctttgtacattacttttgataatttctatttttctgggaaattgttcatttcctctggatttttaatttaatgctatatatctacacataatattttctaattatcatatcttccataattgtagttatctctcttcttttgggttcataatatttcatatatttttattttctcactttaatcttttaatcaggcttatcagggagtattgatcttttttatgtatatataatcattatacatatttttaaggtacatgtgatattttgatacctgtatacaatgtgtaatgatcaaatcagggtaattgcgatattcatcacctcaaatgctcatcttttctttgtgttgggaacattccaaatattttttttagctattttgagatatacaataaattattattaactctaatttccctactgtcctatcacaaactaaatcttattccttctaactgtgtttttgtacctattaaccagcccctctccattgacctgagcctttctttctgagccactgataatcaccattctactctctatctttatgaaatccacctttcagctcccatgtatgagggaaaataatcttatttcacttaacataatatcctccagttccatccatgtttctgcagatgacaggatttcatttttttatggctgaataatataacatcgtgtatatatgccacatttcctttatacattaatccactgatgggcatttaggttgatttcatattttggttattgtgaataatgctgtgataaacatgagagcatagatatttcctcggtatattgatatcctttcttttggatacatacccagcagtggcattgctggattatatagtagttctatttttaatttttttaggaacttttctactgtttttctataatggctgtactaatttacatttggtcgtttcaaagaacgtgtttttggtttgtttatcccttctgcagtttatttctgtttcttcttaattttcacttttatttccttctttttcctactttcaggatttaaggaatattttagatcctttccactctttcattgactgaatacttactttgtttattttgatttttacaaaatcagaaaatcattttagacatgggagggtgtatgtgtcgaggaatttgtccatttcttctagattttctagtttatttgcgtagaggtgtttatagtattctctgatggtagtttgtatttctgtgggatcagtggtgatatcccctttatcattttttattgtgtctatttgattcttctctcttttcttctttattagtcttgctagtggtctatcaattttgttgttcttttcaaaaaaccagctcctggattcattgattttttgaagggttttttgtgtctctatttccttcagttctgctctgatcttagttatttcttgcattctgctaccttttgaatgtatttgctcttgcttctctagttcttttaattgtgatgttagggtgtcaatttaagatctttcctgctttctcttgtgggcatttagtgctataaatttccctctacacactgctttgaatgtgtcccagagattctggtatgttgtgtctttgttctcattggtttcaaagaacatctttatttctgccttcatttcgttatgtacccagtagtcattcaggagcaggttgttcagtttccatgtagttgagcggttttgagtgagtttcttaatcctgagttctagtttgatttcactgtggtctgagagacagtttgttataatttctgttcttttacatttgctgaggagtgctttactatgtggtcaattttggaataggtgtggtgctgagaagaatgtatattctgttgatttggggtggagagttctgtagatgtctattaggtctgcttggtgcagagctgagttcaattcctggatatccttgttaactttttgtctcgttgatctgtctaatgttgacagtggggtgttaaagtctcccattattattgtgtgggagtctaagtctctttgtagatctctaaggacttgttttatgaatctgggtactcctgtattgggtgcatatatatttaggagagttagctcttcttgttgaattgatgcccttaccattatgtaatggccttctttgtctcttttgatctttgttggtttaaagtctgttttaaccaagactaggattgcaacccctgcctttttttgttttccatttgcttggtagatcttcctccatccctttattttgagcctatgtgtgtctctgcatgtgagatgggtttcctgaatacagcacactgatgggtcttgactctttatccaatgtgccagtctgtgtcttttagttggagcatttagccaatttacatttaaggttagtattgttatgtgtgaatctgatcctgtcattatgatcttagctggttattttgctcgttagttgatgcagtttcttcctagcctcgatggtctttacaatttggcgtgcttttgcagtggctggtacaggttgttcctttctgtgtttagtgcttccttcaggagctcttttagggcaggcctgctggtgacaaaatctctcagcatttgcttgtctgtaaaggattttatttctccttcacttatgaagcttagtttggctggatatgaaattctgggttgaaaattattttctttaagaatgttcaatattgacccccactctcttctggcttgtagagtttctgccgagagatccgctgttagtctgatgggcttccttttgtgggtgacccgacctttctctctggttgcccttaacattttttccttcatttcaactttggtgaatctgacaattatgtgtcttggagttgctcttttcgaggaatatctttgtggtgttctctgtatttcctgaatttgaatgttgacctgccttgctagattggggaagttctcctggatactatcctgcagagtgttttccaacttggttccgttctccctgtcactttcaggtacaccaatcagacatagatttggtcttttcacatagtcccatatttcttggaggctttgttcgtttacaggctctaaaattgaggcaataattaatagcctactaaccaaaaaaagtccaggaccagacggattcacagccaaattctaccagaggtacaaggaggagctggtaccattccttctgaaactattccaatcaatagaaaaagagggaatcctccctaactcattttatgaggcaagcatcatcctgataccaaagcctggcagagacaccacaaaaaaagagaattttagaccaatatccctgatgaacattgatgcaaaaatcctcaataaaatactggcaaaccgaatccagcagcacatcaaaaagcttatccaccatgatcaagtgggcttcatccctgggttgcaaggctggttcaacatatgcaaatcaataaatgtaatccagcatataaacagaaccaatgacaaaaaccacatgattatctcaatagatgcagaaaaggcctttgacaaaattcaacaacccttcatgctaaaaactctcaataaattacatactgatgggacgtatttcaaaataataagagctgtctatgacaaacccacagccgatatcataccgaatgggcaaaaactggaagcattccctttgaaaactggcacaagacagggatgccctctgtcaccattcctattcaacatagtgttggaagttctggccagggcaatcaggcaggggaaggaaataaagggtattcaattaggaaaagaggaagtcaaattgtccctgtttgcagatgacatgattatatatctagaaaaccccatcgtctcaggccaaaatctccttaaactgataagcaacttcagcaaagtctcaggatacaaaatcaatgtgcaaaaatcacaagcattcttatacaccaataatagacaaacagagagccaaatcatgagtgaactcccattcacaattgcttcaaagagaataaaatacctaggaatccaacttacaagggacgtgaaggaactcttcaaggacaactacaaaccactgctcaatgaaataaaagaggatacaaacaagtggaagaacattccatgctcatgggtaggaagaatcaatattgtgaaaatggccatactgcccaaggtaatttatagattcaatgccatccccatcaagctaccaatgactttcttcacataattggaaaaaactactttaaagttcatatggaaccaaaaaagagcccgcattgccaagtcaatcctaagccaaaagaacaaagctggagctatcacgctacctgacttcaaactatactacaaggctacagtaaccaaaacagcatgatagtggtaccaaaacagagatataaaccaatggaacagaacagagccctcagaaataatgatgcatatctacaaccatctgatctttgacaaacctgagaaaaacaagcaatggggaaacaattccctatttaataaatggtgctgggaaaactggctagccatatggagaaagctgaaactggatcccttccttacaccttatacaaaaattaattcaagatggattaaagacttaaatgttagacctaaaaccataaaaaccccagaagaaaacctaggcagtatcattcgggacatacgcatgggcaaggacttcatgtctaaaacactaaaagcaatggcaacaaaagccaaaattgacaaatgagatctaatgaaactaaagagcttctgcacagcaaaagaaactaccatcagagtgaacaggcaacctacagaatgggagaaaatttttgcaatctactcatctgacaaaggcctaatatccagaatctacaatgaactcaaacaaatttacaagaaaaaaacaaacaaccccatcaacaagtgggtgaaggatatgaacagacacttctcaaaagaagacatttatgcagccaaaagacacatgaaaaaatgctcatcatcactggccatcagagaaatgcagatcaaaacgacaatgaggtaccatctcactccagttggaatggcgatcattaaaaagtcaggaaacaacaggtggtggagaggatgtggagaaataggaacacttttacactgttggtgggactgtaaactagttcaaccattgtggaagtcagtgtggtgattcctcagggatctagaactagaaatcccatttgacccagccatcccattactgggtatatacccaaagggttataaatcatgctactataaagacacatgcacacgtatgtttattgcggcactattcacaatagcaaagacttggaaccaacccaaatgtccaacaatgatagactggattaagaaaatgtggcacatatgcaccatggaatactatgcagccataagaaacgatgagttcatgtcctttgtaggaacatggatgaagctggaaaccatcattctcagcaaactatctcaaggacaaaaaaccaaacgccgcacgttctcgctcataggtaggaattgaacaatgagaacacatggacacaggaaggggaacatcacacactggggcctgttgtggggttgggggaatggagagggaaagcattaggagatatacctaatgttaaatgacgagttaatgggtgcagcacaccaacatggcacatgtatacatatgtaacaaacctgtacattgtgcacatgtgccctaaaacttaaagtatattaaaaaaagtgaaaaaaaaatcattttagagtatattttcctttgaataaagtctcaactgtatctcagaggttttaatataaaatttcctttttatttatttttagatattttataacttcagttatggtttccttttgatccagggtttattcagaagactattacactgggtacagtggctcattcctgtaatcctagcattttgggaggctgaggtgggaggatcgtttgagcccaggaattcaacaccagcctggtaaacacagggagacctcgtgtctacaaaaaataacaattaaaaaacaattagccaggtgtggtggcatgagcctgtggccccagatactcaggaggctaaggttggaggattgcttaagcttgagagatcaaggctgcagtgagccatgatcatgatcatgccactacactccagcctgagtgacaaagcaaaaccttgcctccaaaaaaaaaaaaaataataataataatagaaggcgattccttccaatatttcagattaggattctagtaatattatgatgtctgttttttgttaagtgagctgtcctttctgttgtgaagcttgtcagattttttttttatcctgaagtttgggaattatactagtcaatatgtagatgtgcatctatgtatgctcatcctgcctgggacttagcaagaccttttattctttccacagtaagtatatcctttttttccccttaaccgagtgttttgttacttatttgttactattttccatttgattttttcctccttcttaaacttttataatctatatatacatttgctgtttgaattatcttttgcctcattatgtccttttctttataattttgcttttggttacaaaatattttttccctatgtcatgctttatttaacgattctccattaacagactcttagcccatgttcataattctttttttggctctctattctgtgttgtgcattttgtagctaagtttttgttcaagtttgtgacaaatttccttagtgaaattcctagaaattactgggttaaagggaatgattttttttttttttgtatttcaagattttttatatgtcttagcaaatctttcttacagaaaagtttactcatttatacactcagtaagggtgtgtgtttctcatttaaaaaatcatatatttttcttttttaggctttgaaatttctgaaaaccagaagaggcaggctgcaatgactgtgagaaaagtccctaagcaaaaaggtaaagctgccccactcagtctctgtgaaagactatggaatcataagctatatgcttacatattcttaggcccatttctgtgctgaggtttacttgggggtggtggaggagtatccaggtccctaggtgtccttgatgacaggtagcaaatggttttaaatgcttaaggctaaggagtgaatagtatagggtattggtatccaaagatagctcattgagtatagcaaaaaatataacctctgttcctcttttttttttttttacttaaaaataagggaaactttactaacaatttatagatcaatggacaacatgatctttatttaataagtatagtttgggcatgatggctcacgcctgtaatcccagcactttgggaggccgaggcaggcggatcacaaggtcaggagattgagaccagcctggccaacttggtgaaaccccgcctctactaaaaatacaaaaatcagctgagtgcctgtagtcccagctactggggagattgaggcaggagaatcgcttgaacctgggaggcggaggttgcagtgagccgagattgtgccactgcactccagtctggcaacagagtgagactacatctcaaaaaaaaaaaaaaaaagtataaagatattgctcagctttctgtcaccggtctggaggcatgtgccaaatcaggagacccaaatcacaataaagaatctcaaactaagccaagacaaaagattcagatattctctttctcttaactacaagccaaagtacttaagaaaaaataccttgcaaatcaatttaaatctgaagttaagctttagtttctcttttctcatgaaccagaacaaaactatcatgctcagccaaacaaagggaaggaactaccttctgcttattggaatacctattcagtgtcagtcactttatatgttatttcatttcatctttatggtaatcctgagaagctggacactattaactctatttctcagatgaggtagctgagggtctttgagtgaagtaactgaacttaatttgacttgactcagagtccactgctttctcctctccatctcagggtcctgatgaagccccatgcttggaaagaagagtttggttttctgtcttgcctcaattactgacagctgcttctattactgatagccatgttcactgtccccaggtgtgggcaatcttaatgagaccttactttccccaggcctttccttctgctttctcagtgggctttgtggttctgaatgagtcaccatccaaaatgatcagattcaagtctcctgaaatttccagcagccatgtaaagcactattttttttccattgaagcttcttttgattgaggctgaatgcctgtgaacatctgatttccagttaagcagtgcacctagctccgctgactagacatgcctccccttcaactgcttattacttcttgctcttgggaggcccttattgtctcttttcctcatcatgcgaatgtgattccccttatatagggaatgaggccagccttaattagccaccaaaaagttgggagttaatttaaggtggggaattaactcctaaccttttgattgctataataacatgtgagagatggtgttagaaagcaatctggagttaatgtcagtaaggatatgacctgtattaacagaacttggtaagattttgctccagttcctcagacagaaatgtgagcagaaaagagcccagccaactgaagttttcaggctgcaaaagggatactgtcctaacagcttgtctcctggacgctctcaactcctgaactttctcactctgatttcctctacttcccccactgtattcttcagcgttctctagagggacagaactaataggagacatatatatatatatgagtttatatgagtttattaaggagtattaactcacacaatcgccaggtcccacaataggccatctgcaagctgaggagcaaggaagtcagtccgagtctcaaagctgaagaatttggagtctgatgtttgagggcaggaagcatccagcatggaagaaaggtgtaggcttggaggctaagccagtctagtgtttctaggttcttctgcctgctttttattctggccatgctggcagctgtttaaatggtgcccatccagattgagcatgggtctgcctctcccagtccactgactcaaatgttaatctctagcaacaccctcacagacacacccagcaacaatactttgcatccttcaatccagtcaagttgacactattaaccatcacatccaccatactgacctttatggtactcctttatccaagcctgggttcctcaagcatatctgagactgaattgtcttttcactgagaacacttcaaacaaaggaatatctataaagcaaccaggagttggttaaccagaagatagccctgctaactcatgccaagcattttggtcaaggtccttccccaccctatgtatctccaggccattccttttagggcctttcttgtctcccagtgtctaaatactgattcacttgaacagttttctttctttaacagcaattctaaagtcttcaaagaaattcatttagtttctgtctttctttctttttttttttttttttccctgagatggagtttcactctcatcgtgcaggctggagtgcaatggtgtgatcttagctcactgcaacctctgcctcctggtttcaagcgattctcctgcctcaccctcccgagtagctgggattacaggcacctgccaccacacccgactaatgtttgtatttttagtagagacggggtttcaccatgttggccaggctgatcttgaactcctgacctcaggtgatcccctcgcctcgtcctcccaaagttctgggattacagatgtgagccactgcgcccagcttcatttagtttcaaacctcccaggattactacaaatctcctcccttatttctatttttggtcttcaagactcctagtccagggctgtagtaactgatatgttttgagactcaagagtgccatacatgtggaagtggttctcaaatgtaggaattcagtagttacaatatgtacatgggaagagcaagaagggattatttaagataaccatgaaagctggcttccttgagcttttcaatgacccatcacaggaagtgaggggcattgttaagaggtctccaatgcggatgtcattagataggtaactactctaatgtccctttccaacaccatctgtaacactgggacattatcaactcagtctactgctctgggagagggggaacctggctgaaataacagtagagaataccagatctagctccaagaaaggccttttcacttgacctttgtctttcacgctgctttcattttaagtattgatatataacttcttgaaagttttatgctaattcctggtacataaacctaattaactagatcagtatagagctccccatggctatgagcacagactccatctccagaggccttggggccagcacaaaatcaaatgagtgccctagaatagcaaaaatgatctcgaaaaagaataaaatgtgagtaatcaatctacccagtttcaacactcattatatagttacagtaaccaagacagcgtaattttggcagaagggtggacatatcagatcaatgccacagaacccagaaataaatgtacacaaatatgcccaattgatttttaaatttattttgtattgatatgtaataattgtaaatctttactgagtacatgtgatattttgatatgcatacaatgtgtaatgatcaaattagggtaattaggatatctatcaccttaaacgtgtatcatttttttgtgttgggaacatttcaagtcttctgttttatgtattttgaaatatgcaataaattattgttaactactgttaccctgctgtgctactgaacactagaacttattccatctatcaaactgtatttttgaatccattaaccaacctctcttcatttccctaacaccatccttccaagcctctagtaaccatcattgtactctctacctccatggaatccacttttttagctcctacatttgagtgagatcatttgatatttgtctttctgtgcctggcttatttcacttaacattatgagctccagttccatccatgttgctgaaaatgataggatttcattctttttgtggctgaataatattccactgtgtatgtatactacattctcttcatccattcatctattgacagatactttggttgattccatatcttggttattgtgaatagtgctgtgataaacataggagtgcaaatatctcttcaacgtactgatttcctttattttagatatatacccagaagagattgtgattataaaagtgtaacaacagggatccttgtgatgatggaaatgttctatatcttgactgtatcctgttataatgtcaatatcctggctgtgatattgtactattgtactattgttttgcaaaatgttaccattgggaaaactgggtaaagagtacacaggatctctattatttcttaaaactgcatgtgaatctgtaatgatttcaaataaatgcttttaaaaaaaatcaaattagtaacaaaattccctctctaatatctgcgtattgtctgttggcattcagtaccctcatacttctgacacttaccaccttgcaaaactagctcttagaaaagattctgatctttctcactgaagtgccagtggctgatgatggcttaaatgatactacttccaggcaaagggacttagtcatcaagcaaaggcaaaaaaagtaactgtaatgttggaatttcagaccctgagtagcagatgaggaaggtatttgggagcagcagagaagccttcctgacatgtctgaattatatgctgtatgtcttgtcctattctgctctgaatgtagatcaggattaaactttcactttaggcctccaggttcctggaatcctccattaatgtggattttgctttgatggttgcaaacctacctacaaatgttgagaaggtttttaatattagtatcatttaagctattccgtttgaaaagacacacacatattccgtcttccttgctccccatgaattataccttctggtagtaagtttactttctccttcacctactaatgtcaattctctattaagtgcaggttcatcactctcaacccaggacagaacactaaatcacttgcaccttatgcttttagaaaatttctcctagaaacctgtcctgaagtcaatagttcttaaccaggctcttttaaaacttccaggggggactggagaaggcgaaatagagtttgttgggttctttgcaggaccaacccctgcataagggattctggtgtcttggaaagagctctgaactgagtagtcaaagaatgtaggttctaacccttgctttgtcgctaacttaccatgtgaccttgggtataacatttcttttcagatatcagtgttctcacctgtaaaacagattatagcaataccccaaatttctttgatacctgactagatgtggaagtgtgtagggttgcaatagtagccatggtattccaaaatctgtttgaaagaggaattctccccttggatgatttgtaaaaccagttcacactctctaaaccagtctgccttgagttgtctgcccagagtggtcactgggtaatttgagaagccctttgttacataacttataccctttccctttgatctctcatctactctaggtgtcaactctgcccgctcagttcctccttcctacccaccaccgcaggacccgttaaaccacggccagtacctggtccccgacggcatcgctcagtcgcaggtctttgagttcaccgaacccaagcgcagccagtcaccattctggcaaaacttcagcaggttaacccccttcaaaaaatgatacctacagggaggcagataattttaaaataaagtaaataaaattatatttatagatggaccttttttcggagaagcactgttgaaatttatacacacacacacacacagagacccttgagtacacatacacacacacacacacagacacacacacacacacacacacacacacacacacagagagataaggaacaaaagtgttttctgttgttttggggaagtgaaatatgtggttggtaggaagaggtaccaatgacttccaaacatgtgattccgtcttaaaagttttccatttttaccctgtcccccttccctttgctttcagaagttgacatttctattcattgcttttcttgttaagataatctctttactcccctgtgagtgattcactgccttgtcattattacgatagatgtgtttgtattgttttttttctgatgatactgatgttgatgaatttttaattttatttgatgtggtagagttgggaggtttcagggttttttcccctcttttactttccattgaggaagggaatgagctcctttctcctctccttcagccaatcattatcaaatgttccttcagccctgcagttgccccaaataaccttttttcagcatcctctgtcctcagtcatgccagtctggacatgctctgttgtgccctgtgacaaaactgctcagtattcctattgcttttactgtgttttaggtactgtgaagggatcaaaaaaccaaacagaagcaagggagtatcagactatgatgatgctggagtggacttctgttcagggaacattttgcattcaggctgtttcttctatcactggggtttcccatgttgcagcacttctgggtcgttgcaattttgcatctaggagttagtttgatcgagttattctcttttttcaagtcacttttgttataggtctccccctaggcctgtctctcccttagcccaaaagatctgaactggaagcagaggttgagattctgcctcccaggagagggatttacctgccccctagtaccagataggtttagggcagtgatctctacagcaatcagttcagtgtcctggttgtccctgctcccatttacagatgtttgggcagcattgatagaagtatggaggggttcaagacagagcccacctgatcaagatcatcagctaccttcaaattattgacctggacagggtccaagtctgatagtaaccttttacaagaaagaacagggatgggaatggaaagagatagccttgatccacagtattgtacctgcattttctaccaccctaaaattgtgtgagacttctcccattgttaacagattgcatggacaatcttccctggcttctttctttccctctctctttcttctttctcctgccatcctagcacaggaggatttttggtattgatatagttaaagctgttctggcactcaaagaaggccgtgtttccaacatcctctcatcccaggacatttggggcaagtgagttaggggcccaggggcaattttccctctgaataacgtgtctgaggcagggatgctaccctcaggctcgcttttggccagctttttgcttgggaaaatctaacttctttcacaaggaggcaggcttcctatggatgttggagtacctgtttttcctccacacatagcccttttcatggatagaccttgaacaacaaaaagggtataagggaataaggatgaactctgctgtgaagagcaagccactgtagtgaggaatgtggagactgggagtctgtcctaaaccccatgggagaagacttcatcatgacaggacttcagcttaccaagcagcagccatagctgtgtggaggcttcagcatagctagcatgtttactgctctatgcctcctgatccagaccaggcattgcccagcctgggaatcttttctttgtgggaatcaaattacaagctatttaagtttatattccatcacaaccaagtcagacttgtattataagtcaaggatgagcctgatctggggagagggccggggctcgggactggccaccactgttcagcacatgacctaactacgtaagcctctttggcaagggtcctggtgcccagcacccaggctaaaatatcctgtctggcagagtgttttggtagctatgcaggcctcccttcagtgtacctctttttccaacttctcactcctccttactaggcttggccttgacatgcttcttcgagggttggcagcacaccgggaggggatgcttggacaagtttctgggcctacatttcttgactaggccctctcatttcctccctccttggggcttctgcccagggctccaggatcagggatattacttctcaacccgcacttctcctctactgaacccactggcatcacctgatgccactaatttgtgaacaacaagaaatcatttccccattggttggagtattccctcagcctatagcatcaaagcagaccagtggccaacagccccaaggggagcccaattaaatacctgggttcagtatcctaacctgttatgtcctgacagcaatggtaaccccagtaattctgtaatgttgtaatttccgcatggccctgagctcccttttcctcaactcagtgaggccaggatttgctctccaaaaggctttgctagtgtgttcaatgggacctgctgtggggagtcctaagacagacatctaattattctctctttttccccccctctctatgtgtatatttctaatggatctataagaacagcaacaagagagttctaacaattctagtgtgaagccaaatagtgatcttttagtgctttggggatggggtgggctggggtggatggatgggcaacagtgactttgattacccttgctgctctgcatttgccagtttattcttttgtttcttttatctgactgactctgtcaaacaagtgtcaaagttgtgtgttaaaaaatgtttaacaaaaaaaatgttgtaatgacacaaagccttatgaaaatatttatggagttcaataaaagaagtaaaaagac

SEQ ID NO: 4643 - DNA, 117126 bp, human
gggatagggccagcaaggcagggatcgaacgagtgtctggcagccgggagcccagcgaagagagcgagcaagcttaggaaaacgagcgaagtaaagggagtaggggagactgagactgaccggtagccaggcaggcggacggacgcacgcccggacagactgagcaggcgccggagaaccactcacaggttccccccgcctttccctttgaaagctaggattttgcctttcccgtggcgcccgagagagaatgctggactctgccgacttcagcgcaagctaagatttctcagctagggacaaacgatcagcccaatcctgagaaggggggaaccaagcaccccgtccccatccccctcccctcccccgactaaactcgggcgccaaacccagcccttctctaaccaccctacttcctcctctcctttctagcatggtggctgtatggacagtctgacagaacagagactgacatctcccaatctgccggccccccacctggaacactacagtgttctgcattgcaccatgaccctggatgtgcaaactgtagtcgtttttgccgtgattgtagtcctcctgcttgtcaatgtcatactcatgtttttcctgggaacgcgctgaatggagtccagccacctgagctgtcgcgaactctcgctttgatttcatcccgagagccaccgagaaaaaaaaaaaatcacagacagagacagggaaagagagagaaagaacaagctttcttactcaggggggaaaacgttttgagcttcaacatggcctcgctgtgatatgtatgacgttggtatattatctctccctaaatcttttgtcgtgtcttgtcttttaagaatgcctgcgcgtatagttgcctattgcttgagtgaaattgttgatgaagaaatgctttctatttaagtgtgcatgcgtgtgtgcatttttaatctatgtggcgttcatggagcaagctctgcgtccttaaacagtggctttgctgtctgtggtgtcttaactcatttccttgaagactacctttaaactccatcagggaattttagtcaaaatttctctcttgccatcaggagtgcatttgggtttgtttgaggggaaaagggtttgtggaagagcatgatgaatatttgacatcataggaaagacagtctttgcagtggatatttagagggaaaataatcgatgcaaggaatggatttagggaaaatgcttctttagtgtctaaggagaagcaagaatttgggaagtgacacgggtgtgttgtgctggcagttggtgactgtgtcctttgaatctcaatttgctctccagggttcacaattttcaattttgaaagaagccacatttaaaacacttcttgaaccttaaagctttaagatatttaaaatgtcaatttccttggaatcatgaaatagtatgtgaaagcattctctgattttttgaactggcaagagaggactttgacaggagctatttgggctccctttcccaaagattgtacccctggatttgagtttggggattttgtttgtctcatcaaaaaaaaaaaaaaaccccacaagaaagaaaaaacagctctttatccaccttgggaataatagtatttggatatggctcctttgggataatctcgtttgcaatgatgttcttgaactacattttaaatgtaacttgataaggctgatgagaaagtggtgatgctattgtttgctcccgtttgttactttaagatcagaggtctctgtaattgaaacattcccataacaaactgaaagtctgtaatgtgctaaattaagagttatcaaattttggtgctaaatttgaccaccaaaacccaaaaacgtctagaaggaaagggatgagagcatggaaaacatgagctggaagcaacattccagtttgagatatgactgcttgtctgtatcagatggtggtggtggtttctgttgttattgctattgctattatttttatatttctgtttcctctgagaaagctcttggcagagccaggaaaaaaaatgtctcatgccagtctgtataatacttgtttttttgcgttttgattttctttctcccctgttaatgtaggcaggctttccccattccattgcttacctggcttgaaataatgccatttatggctcatgtattatagcagtgaatcaggacacatacacatctacacacatgctccccctccacccatgtgggtggctgttcatgtctgatgtgcaaatctgctggcattatgctgtcaagttccatgtccggttgttcagtctctttggaaatgattatgaaaggagaggggctgtgaagggggcctttgaaattgtcttggccacaggacccagagagtattatttaatggcgtcagagggtgttttgggcctcaaagcatgctatccttgacttggtgtgggtgagaagctgaggtttttgtgagattagtaccatggtgtaaacatgatctgggaggtttgctggcattggttcttattaattactctttggtccgtttgtggagaccccctggatggaactgagaacctatttctttgcaaagataatttagtgagtttttttccccccttagcttcattgtattatttaaagtaagcttatatcttttctgggcactttgttttgatacagtgttggagagtggggaatggctctatgctgggcagctgcagacctgtttttttgttttgttttgttttgttttttgttttttccattcagcagctgtttgaccttggacaatttttttcctcctcggtgggtttgggattcccagtaacattggcattttttgatggctccactaggtgacttccaagttcttgcattttatgattttatgacccctagacacttgaagttgtggggggtgggggggatgagctggaaagacaagtgaaaaggaaaagaaaatgttaatcaaagggtgatgggaggaggggaaggatatctggtactacagcctggataacaagtttaagcgaaggggttttttttgcctagttatttgggaaggaaactgggacagcaataagggaatgctttttgactttttttcccccaaggggagaaggggtctctgagactagtctttgatctaggtttatgacttaaatagtgtcacgaaatgccttctcctctgtgagcctgacagacctttggcagaaagcctctgggaatgtatgtgtgtgtgtagggtgtgtggcagtatgttcatgggggtgtgtgggggggagcacactcctgagtgtggatgcggggtgtggtggtaggaatgaagaaagacagtattgagttccacagttctgaatagcctccttgtgctaggacctataaggatttcacaaatgctgggatggatgggtatcacccatgccattcctcttttcaccacctaaaacccctcaggctaaggaggtgtcttgaatgagcccttccattagtaatttagctgttgaaatgggttagcgcttttaaaattgtctccaggcaaataaagggatgttgctagccagatggcaggccaccatctagcaaccagaagggaatttgagagtagagaacaaaaggtagcagtgtgactttttacttgtgtgaatcctaaaggtttggcatttctgcttcagacttgtgaggatatttttctctagcaaaaagagaaaagagtgggagaaaatgagaaatgcagcccagagaagcggaaccctatgcattttgacttgtcttcttttttccttcctcctctgccttctctcttaatctttctccttcttcctttcttcccacccctgacaccacctcctcctcccacctccccactgtaaatgggtgagaagtaaaaaagagaagaggacttttcctctctgatttgtcccaacttttcccaataaagctcctccattcccttccctcctctctggcccctttgagtagaggataagcttttgccatgtaggaggggcaaaatcccagcttagggattttcgctcctggatccccatcaaagaattaaagaaaatgccctctactggtatcctagcaacccctgtatcactgagcacccactgagctccagagcccaccctttaaaggcccaggcaccaataactctagaaaaaggggactagagcctagtgggacttggagagatgcttttggggagggaacaaagaaagaacagaatcccaatttcctgcaaatgcctcggaaacatgtccacagcagacatgtagagcctagcctcgtccagctatgagattatttattagaaaactcctggtttcaaattcctttctagtcagtcccatctccttaagattaactgtgccattttactgcctagctttagtgccagaagctctgccggtcctgaaaaaacaatttttttcaccctaacttttggctgcatcagggagggggtgaagtgatatcttggtgggaacaaactgaacagcattcttcttccattgagacagcctccatctgtcagaacctgcagtgtgcttgtgcagtgtgccccaattttgtctgtggcttggggaatcctgatcagcctagctttatagaatttgggaatttttctttctgtggttttggtgtagtagtttctgacgggggaggctggacaagttgaaagagcaagtttgataatggagctggtaaacagggcttggaccctggctcagagactctcacccaccggtgtgtgtgtgattcagctactagggagctgaaagatcccaaaaaggctgtaggtgaggtgctcttctgcccttgaggtaaggcccagattgagagcaaccagagggcacagtctggtggtttgaaggatggtaacaaagcatgtcttcctctttagcctttgtctgccatctcagtttctggtcccttgacctgcagagtgcttgctctgggcagggatataagaattgagccttttctcccaaaataactgcctcctcagaagacctcctacaaggcatctggatcttgctccagtggctttgccccaagaaatgggatggaggaggggaatcttggactctctagctcttatttccagctctgcaacttgttctaggccaactgagtctctggctttccaagaatccttgatgaaggtttagcttctccagtatctgctcagagtgtctccttctgtcttaggtggatctagctccatagagtatttagtttattgtactttgctctagcacgaaagtacaaagaggaaaaactagaaggggaagaacatagaggggagagaaggctcaggaagcagtccagtaatgacaatactaataactccttatcagtgcacgggcctatagcgtttatgaaggaatttcacatcctttctaacttgagcatcacatcagccttgtgaagtgggtagagatgattgtaattcccagtgttacagatgaggaaagtaaaggtcagcaagattgttgggatgggagtgggtctgcctttcaaatagagaggagagtcagagttggtcattcctaactagtgtgatgttgaatgtagggagggagggcctgacgtggtggctcacgcctgtaatcccagcactttgggaggctgaggccggtggatcacctgaggtcaggatttcgagaccagcctggccaacatggtgaaaccctgtctctactaaaaatacaaaaattagccgggcgtggtggcacacgcctgtagtccagctacttgggaggctgaggcaggagagtcacttgaacccaggaggcggaggatgcagtgagccgagatcatgccactgcactccagcctgggtgacagagcgagagtccgtcccaaaaaaaaagaaagaaaaggaaacaaaagaaagaaaggagatttgggagtcatccctgaagtcatactagcttcctcagctactcacatttttaataactttcatttgtatagcacttttgctcagaattttcattctataaaatgcctttttgtcttgaatatgcatcaaagagttctgtttagttttatgaaaactcactatttgggatcttcaaggtgagaggccagtgtgaattgctgaagcctaaaatacagaatgttttcaaggaactgtagttttaatacaattgttcttctctttgaagcacacttatttttctatatttctttaaaaatctgctgcctagaactgttcatgctactctaggtgccacctgactgagatcaagtgcaaaagaactttgttttgtctgtgaaatgtctaataatgcagccttctactgattctcaaccctcactgaacattcagatcacttgggaagcttttttttaaatacccatgccaggtcccctatctgaaagattctgatttaattttcatgggctagatcccagggagctttatttatttatttttttaatttaaagttccctaaggtgattcaaatgtgcagccagggttaagagttagccttttgagcatgtaggtccaaaccatttactgtctagtccagtcctctactctcttgtgaagttggccacttcagggttttttgaaccaaacttgctacattttatcttgacatgttggtccattattctagctttctgtggattttaaaattttttcttcatgctgtgctacaaattagcagtcccttctagcactgcatcagttaaattctatttgtttggttggactattgttctagcctttgggaggtttttattttttttcttcatgtcacacaacaggttagcagcctcttctagtgttgcattatttgaacaccaaataaatggcattcgagtcgttgattcaaagaaatgtttactatgatatgattaatgctagctcttctgtcacctcaccagagcccctcttggagttgggacttgttaatttttgtatgtatctggtcaaccagtgcagactgcacctggttgtgccagcatttatcctaccagggtgttaatgtgaataacatagcacgatagatttgttgtatgctttgtgggcatcaagatatgctaggttcatagcaagcatctgccaaactgatagccccatcagaaaaagcagtataagttacttggcctcttactcatggtaaatctggttgcaggctccagagcttcttgttttctttctgtgcctacaatgcaaatgtttctaaactgggttcagaacttggctgagggtcagtactacaactgtagtttctgtgtattactttctcctctttgaaaaagcaggacataatggatttagctttaaaacagaatatattttgtgctcaaagagttccggaaattctttgtgtatgtttctcttgttgttttgcttaattgtttccattaacccagtggttctcagcactggctgcacatcggaatcacctggaatattaagagtaacaacaattcctagaatctttgggagagatctgattgagttgatcatagtggtttcctggcatcaatatttttctaagagttccctgaggtgatgggaatgttcagccaggggtgagaatgactgctatggaatgcttcataggaaatgttagctcagcctgtctgacttatcacacatgtgactaggcaagcttcacagatggtgaaattttattctaggactgtgggagcctcgataagtcccaggggcttgtgctcactctaaaaaggaggaatcaaccctagggaatgagtagtctggagacctaattgtatttaaaataatcagctgtgagatggtttgaacacttcaggaataaaaaaaaagtcagttcctacacatttgctgtaatgatggggaagattctgctcatttgctagtgacctcaggcaaattacttctctcctctgaaatttggttttcttcatcagcaaaataaggataggtggatttgatgacttcaaagatttcttctagctccaacaatatgtgcttattttgtgattaatattaatgatcaacacgagtacagatattatttaaatctagcaggtaatccagagatccattttagcaggtttagaatacacagagtggttttaaggatagcagttttgccttcttaattatacttggcttaggtttcttttagaacaagtgaacttaggttgtattctttgagcacacactggccgccaagcaggaaaggagactgtatgaacacgcattggctgccaaacagggaaggaagtggtacagtgaattgagtagctagggtatgccagtttgggattctgtttattaaagagatatgtcatggataattgagaattgcctctcatagatataataccagtctcataggtctgaaaaagatggattgctttgacagctcagagccccttcctgcagtattttaagtagccattcacttggttaataatactacttctattaataagaatttcaacaaataaggtttcctatgtatttcatgggcttcttcctcaaacctaaaagtagttaagaaagtgaggctcataaagattaagcagcttactcagtgtcaaacaggtagtggtagtgactagtggtagtggtagttctagtggcctagaacctaggcgtcttgataccacatcctgcagtgcttctggtatagcctgcatagtggactctgtggtcaggatgcagtcatgactctgagaattaaaggggttttactgacatagagcagtattcaggaggaagctttgaagaaaggagcaaaaggggcaatgtggaggaagaaaaaaggtttagagagggatgtgttcaggccagtttttctcttgcccttatcactcttatgtgctagttccaggcccctgatgggaattggccattgatctttgagcaccaaggttgagtgttggtagcagagaagaaggaaagttgtacatgcatggcagaaggatagcatagggaaggcagacttgcagtaggagaaaaaacaagaaaaggccttaggagccctaggattaagccctggctctgtacctaccttgctgccagatcttgatcaaggcccttcccacctaggcgtcagcttccacgtcactaaaatgagagtggtttcagtagaagaactatgttctcaaatggaatgttagccagaagcttctatataaaacaggaaaaagcacagatggtctggttgaaatgggcatgggacaggtatggaggacagagtctaaagttccagggaaccatcttgcgtatgcagattttggtcattaggggaactggaattagaagagtggagatggctctgccaagcccagccatagtgcttggggagatagagcatccttggatagagttgtgtgatgggggtgggtatttcatttaagtggccaggatttacagagaatcacttaggggcagatattaaagtgcctagtacaacacactgcccccattcctttttttacaagtgagaaaactaaggcacaggaggggaaagggatgggtccaaggttgcagtgatagttctggaattctgattctttagatagggctcttgcctgctgtaacttgctacctcccctataggtttctggctctatgctcccttggctggatcagagacctgaatgctctttcaggtttggttggagaaagcaagctgacgagaggctgggagaacaagagctttatataacctcctggagagggagcaggcctgttagtagtccttggagttccagggagtaggatggggatgaggggaacacagagtctcctgaaggccacattagctctcctgaggcagagcagtagatgcagccctgtgagtggccatctaccctcagggcccagaggaggccagcactgcacatccatagccagctctgggaatggctttggcagctgatttctccgcctgcctgccttcattagagaaaggaaagccatgtacctccgtgcccagctggctgcaggaaggatgtactaagagcccaccccccaccccctcagagtgtggtgcctaaaggcagtagctacttttagctgaacctcccacagcctctcctccacccactctctccctcctccctctgtgaattgtgcaggatggcaagaaggctggggagtaggtgccttggcattgggatagaggcagaggaggagctaggcatctctaggaggggctctgataagccctgcatggcaggagggcttagaacaaaagcaaaatgatgagattgctttgtgcttaggacccaaagggagttgagggatttattaatttcctttggagcatgcaaccagctgaagttcatgtcttgtaaatttagactgaactgcatgggaagacttacactctacttggattaagaggaaagcaactggggctagtgggtactcacttgattcttaactactcctcttgaacagtcttacacttttcagtggattttgtacatcgtctcacttgattttctctgtggccctgtgaagtgggtagggcagagattatctccatttcacaggtgagaaaaagaatgttcaaagacttattgtcacatagctgcttctagcctggccttctgggcttcagctctggaagttacagtgccacttaaagtcactgcagacagctatattttctagaaaaataggtgctggagctgtcctgattctaatctcctcattgtggaagctggggaactaggtccagagaagaaaaggacttgccccaggaaatgtagtacatctgtagtagtgctggaattagaacattgccatgcaaggatgtgaattcctggacctgcaagatgtgcaagccactgtggtctttcaagggttgtttgggaaacctgtgtggtgtgatggaaagcaaagtgtcacagaactaggagtttgttatttttcagttcaggcagaactgtgggtgactgccccagtggaggcctgacactcagtaagccctctataaagatttggttgaatggaagatgtacacatgagtaaaaaggaggtgcaaatgtgaagtcagttgctgtgtgaccttgaacaaatcccattgtctctgtccctcatttctgtctgtcatttttggaggactctttttacttctctcccttggaagaagaaaggccctgtgacccggcccatgtcttgggtgcttggtggaaagctgttttgttttctgatttttgttgttgttgttgtttttaaataagctttcttttatttatcccaagctccatttcccatgcagtcacacactcgctgctatgaagagcagactaactttgtctctcctcatctcctgcaaagttaaaagaggaacttggaagaaagccaaaattaattgtgtttttatttagcaccttcttaagtccatcaagccataaaccacttaggcacatggcaattaaaaaacaattcttggcccctagatccttggctaggatttgtgatggattactgggttttcatgatatgatcaaaaactgttttagaaattgcaggttcttgcccaatgagctgtgtagaacaaatcaacactcttcacttatactcgcattattttgtttggaaacatctcactgatctgggggcaggacaagaagataaagactactgtatagccttctgctcctgacacatgttcttttctccattacactattaggtggccaaagccaagattattttcccaattttatggctaaggaaattgaagctcagagaattgctttgattgactcaggtcagtactgcatcttaaagtcagtggtgagctaggaagaacatagtatatagcgttaggtattatcaactcaccagtaccaagtgtctctaggcaagccatttaagattccctctgtagtttgcttctgtctaagtattttgttgttgttgtttgtttattttttgagatggagtcttgctctgtctcccaggctggagtgcagtggtacaatctcagctcactgcaacctccgcctcccaggttcaagcaattctcctgcacgccaccatgcccagctaatttttgtatttctagtagagacggggttttgccatggtggccaggctagtcttgaattcctgacctcaagtgatccacccacctcagcctcccaaaatgctgggattacaggagtgagccaccacacctggctctaagcatttttacaaaagttaatcaagatagaagaaagaagtaggcatatgctactggataattggataggttggcattgaaccattaattggtattttggtgcatctactggatctacaataaattcatctggatatcacattgtccagggatacatgagaggcctttcaaaatgaagaaaagtggccccagattctgtagtctttggtgacctacttagtttggacgctttctctctgtgggtttatctggccatgttcttaaagactgggccttgatcctaaaagcaggctctttaccattaccagtttctatggtcatcccaaaggatggggaagaatgatttggataaactacatgtcattttgcctgggctttggtggagattgtatgccattccttttactccagttggttcaggccactgggaaaatgagtgtggaatgacaagaatagggagacaaccaatagcttgctgagggttagagggggcctagctgggatgagacatctgcaggtgctaatccacgtgcacatatctacacactgattctttgtggtgttggggggagcaagcagagtttgtccatagtacttcagctgagaagtgactgggtaacagtgagaggaacccaagcattgagctcgttccttcagtgtacttctggggaaactgaggtctaaggagaggcaggaacttgcccagagtctcagaatttgtccgtgatctttgcctattctctctagtcagccaatggctaatttaccttacatttgtgaggctctttagatgaatgaggggtggctaagcctcttgggaaaagcacctgtgattaccacattcaggaagtgacagagatgaaatctgaacccaggtcttttgtcctgcttaagagcagattgacccagacttgaaggaaggctgttagaaacaaattgatggggaagaaaattggttcagctttgctgtctatccatgctctatgcccgtaccttcacatacacatacatgatagatcatatgtgatgcacacttacacatactcagacacatgggatgtatttgggacacacatgggacacacagctggaacatattttcacattaacacacttggaacacacattcagttaaacatgggaggaatattcacacttgcacattctcagcacaggcaggatacacacacaggaacacacatgagggatacttgtacgcatctgcatgtgtgaatgcacatggatgcatataaggcacaattgtgcacccacatacatatggggcatgctgagatgcactctcagatatactgttacccaggacatgcactcctatacctgagatacacactcctaaagactacttgggcaaacaacactccacacttgagtgttgagtcacacttgaacacacctatgggacatatccacatgctccacacagccatgtgggacatattttgatgcagaacacgtccttcccttagggccagccagctgtcactttttcctaagtgggcatgacagggaactggtcccagctggtgggcctccataagtttgctctggctctcctttaaccttgaaattagacttgagagggcagtatgctcagtaataaaatggatgttcaagatggcatgttttgtagcaggctctgtaaggtaaacagggttcagagcagagccctcagatgtgagttaacaggcagatgcagaagaatggaaaacacaaattgggattgatcaatgcagaaagcttgagcctgctccttcatcccccagttcacttacaaaccattgtggagtgatatggttatgaagcaatgtcaaagaaggcctaaagtcactggatattaaagtttatctttcttgggaatgaaataacagtctggactagagcaaagatatctaaattgtgggtgttagggtgtgaggggaagtggtaggatgcataagcgggagatccctttgggcagtggcccatcctctcctgggttagtggtggtctgagaccagcctcatccttaatgaccacaacctagcccctaggcacagcagcttgggtcatctggccccactaatgaatacctgctatttttagagttcctcaagctggaaaccaggtcatggtgtcctggggaagcctttgtggtccttggtacctaaggctgaagctggaaagacagggccctagattgggtctgagtgaagggtgggaagcagggggacacgtagctggggaataccaggctttcctgggagcagcatcctcagagcctcagttgggttactattaactataacagcctcatgcccatttctcagctttggctttgaggtcaagaaacatgagtttcagttgctactctgcctcttacagtgtgtctcagtcacgttcccctctgctgtctgagtcttacttgctttatttataaaacatccagtattgcccttagatgatggaaaggctcagctaggctaagagttgagaaaatgttttgaagatacacttttctccatgcataaagctgcatcatcattgtccctaagctggattcaattcctgccaacaattggacctgactcctattggagtagctgtagacagcaaaggccaaaaaaaaggagccaagagaagacaccctcatggagtcaggttggtcaaagtcatgctgagattacccccacatatacagatgcttttcaatgccaggtcagtcattctgggaaagaaaacagatttgcagcatttaggtggtcatgtagctttggctcctcaggaatctcctaggtaatgagagaaggggaggcatcaggagcagggatttcttcctaaactaggaaatgcaagaccaggtcacctgtacctgccacctgccagaggaggcagcctagagtgccagctctggctctaagagaatcctctttgtgtttgtgctcatggccattttatctggtttgctgagagggagaaggtcagaaactagactatgtagttcaagtttccccctgctgcagacattgtgggcaaagttctcctgaccctcagttttctggtctgtggaatgggcttaactgtagtctctcataagagttttaagtgcaagacttcattgtgacataggatgtgaaaagtgtcttgtaaaatgttgaacatgtgttcctgctgtttggattgttaagatttcatccaggttgtaattacacatagtttggaggtaattgagaaacttcactttatttctctacccctttcccataccgttcttttaaggcattattatatccattttacaaatggggatactgaggctcagagaaaagagaaacaagtctgaggtggcaggattaggtggtggtagattcaggactagaagccatgctttcagattcccaacccaatgtactctggccctgggctgccaccaatgaattccagtgctaaaggaatctgccagaggttacttaagtaaatatatataaagagttagatttttctctgacaagcagtacagggggttctctggggcacagctttacccagcactctccctgcttgcccaagagagacacgctgattgtcccttcatccctcctacagcagctcatgtcctgctgtctcctgcatgttggaagcagtgaagaattggagatgttaggctgttgtgagaagcaatccttctgccggtttaagccacttcaagacaataggaggattcttggaggcacaaaatccaccttggtcacccgcacctcctcacagttttttgggtacccctgacctgcctaaggggttggctgaaagggatctaaggaaatatatttgagggccttgatctctggaggattgtgctaatagttgagggataagattatggaaataatccaagaaccaaaactgggagtgtctctggagaccatttgggctgaatttcacctggcctcaatgaggacattaaaacccagctgggcttaccttttctcccttagtgtggttttcctttgtacaccacagattctcgtgttcagtcagatttcctggagtctttctagcttgcttgtttttgctattctgagcccagaagagggaaggggtgacacattgagtggagtggtgagaggaaagagatggaggaatctgatgagctcaggccttgaggggcaggcattggaggaaaagggcttttgtgtctctcttcatttgtattgctgctgatgcattattttcctatcttccactgattggctgtgggagcctaatccaatctgttgttatcttcacttttgctgctcaaacctccaaaatgactacagtattcattttgagggatgtcttctgtgggattggataagcagtggggcagggaagtggggtggggggaatgcggtgcttcaggaaaaatggggagaggaactttcttttcttcaaatttgagagcccagagaagtgaataggaaaaggttagctggcacagccctgccaagaagtagccatgcagtttcctaatctcttttgaccatagataccttatttttaaaattttatttttggataggaaatatattcacatgtttcaaaattcaaaaggtccaagagagtgcacagtgaaaagtctcccttccactccctgccctctgcagaggccaccaatgagtccttccagaaaaatgttatgtggatgtataaacaaatatgaatatattcctctttctcttttttatggtaatatacaacacatattgttctgtaccttgctatgctttggagattctttgatacttcattgaatttcaccttttggggatgtgaagatgtgctgtggaaagtagaggttaagagcactgattctagagggaaactgtctgggttcaggtttggattctggctctatgaacttcaacagttacttcattgtttttctgaactttggtttccttatctttaaactagggatcaaatgagttattatatgtaaaaacttagatttgtctctgacacatagtaaacattcaataaatgttagccattttttattattaggaaaaaaaccccactggaccagcgccagtagatctaggttttctcctggcctctgtgctcctgggatagctgggtaacttcctttgttcacaaattagtttccttacctttaaaatggaacaactcatccccactctgcttatccccaggatttctgggtgggtccagtgagctcatgaatatgaaggcaacttagcaattgtgatgttctgagcagatggaagaagtgcaacttaatattttcatagacactactttgggtggcttgaacccagtggtctgaactgggtggaaaaggcagtgtttttccttctgccagtggaacccaaaagccatccctgtactggtgttgtattttgagtgggagatagcccatggcaaaattttgaaatactcaggttttgtcttctgaccttttttattccaccccatccctctcctgacttccttgtttcattttttttggggggccaccccacccctgtcaaaacctgcttttagaagcaaagcagcagcatatgtcaaagatgacctcaactttccatttgaaataatttaatacagctggctcagagaggcgctggatctgcccaagttcatacagcaagtccagaatcaagctacacctagagctcattcttcccatcccagtttttattactgacatttgcattttagtgtgaatttgaatttgagattccttagcaaaaatcatctggtcgtgggggagattctggaagtatctttactaatccttcatactgaagtgttcttatcttttaatcttcagggtcagacctgtttgggaccctgagcagggagggaaagtcaggttctggttttagtactgaagggatgatgtctatagagcagtgggagagaagagcaccagaaaatgttgaaagcggtaacctccaaggtgagacttagggagaaaatattagttctttatatattaaattgttaatctcattgttatttaatttctattttgtggagtttttttttataaaacacatactacattaatatttaaatattgggataggtgtttcttgttttgttttttgtaaaataaattttattgtgtatatttgaggtttacaacatgatattgtaatatagatagatagtaaaatggttactgtagtgaagcatatctgtcatttcacagaattacttttttgtgacaagaatagctaaatgtttgtatttttgtttttaacattagaggtacatgatccaaaaactattggctaccattcttctaagactataggcttggtttctaatcttggcagctctgctgctaactaacttgatgccttaggaagcttttctcattggagcctcatttttcttacctgtaagaaagggaggactgagctaggtgtgctaactagttacttggaaatctccaatcctgaccacctctgagtataagaatccactgcctttggggctcttgagctgagacagttaaaaggagttcaagccctgacaccttactagatgctttatccctctatcagctgccttggtttccttcccttctctacccccaccactttcacctagcccagactggtagatgcttccttacataagtttagcgaacctacttgacattgttttgttacaagcacaaccacttttcctgtagacacagacctggtgccatcccttctgagctttgagggtgtgtctgattttgcttctattttgtcctctctggcagcctaggtttagtcgttgtatccctctggctaagtctttggtttcaaggtctgaggggaagccagctcagccagtttgagtcccttggggcctgacccaatggctgctcactgaatccctctgccacttcctcatccaggactgggctagacttttttaggagaacatagtccattcctgagcataaaaggcttctgacatggactagaggcattgctaggtgccttggccttggctggatgtcttttctctcacagtgagccaataggtagagggaaatcattgcaccactggaaactatcttccactttttgatgggctgtttaaatgcagatgtcctctctgggctgtaaaaactccctgggagatacttacattctctttggaaacgtatgccaaggtctagagtttttgcaagcctgtgtccttgctgggcatgctcagtagacgtaaaggtggtttcagttaattgaaatatattcatttttcctgcttcatctctagatataggagcaggtcacagtgctcctaactaaatgttgtttctgttcttgtcactgtaaaccagatggtcacatttaacgacgttaggacccttagttccaacctatctcctcccctgctcctcccgctaccttcagctctcctttctctacaagattttaacacgacatctgacaaatggataaaaaatgaatttccctttttctctctgccttgcccacccaccctctgcctgtggtgttgagtatagaaccatgcatgtgggagtcatggaggacagattcttcttgtagttctagccccctcctcctaccttctggaaacaaaggaaccccacccctgcccagaaaactccaaggcctggcttcaagtcgtagtccaggaaaagttaaagctcccaggactggtcctaaggcgactacatgaagaaattcaggaacccagatgcagaccttaagatgagtttaggtcgcctaagggatctgtggctcttagagcatccctgcatattccctaggtttgtcctggtcagctcccatatctcagggtagtaaggcaacaaaagtctccagtgggtagctggagctcggcattcacaccaagtccaagaagacgagcatggctcccagggcagggacattttgggtataagacccacgctggctcaacagatgggtgaaggtcagggtaacctcaagcttgagatggcatgttctgactcaggaactcatggagagggcattgctgagtccattattattatttttactaaccatctgtctcttagaatattggaggttgccttggggagatttaatacagctctaggaaatttcttccagattatagcatagagagatgctgctaggacttgctgttagaactagtggtagcttcagtgcctgaaggttgggacgggaatgagggtggaacagagcagaagcaaatagtctctcaaggcaggctgggagaaatcctctccgacaggccaccgtaattcctcagcctttctggaatctgacacaagaaggataagcctagagttggagttccagagattctggtttcttttgagtggcccagtgcagtaagaggaaattcctgcaatataaactctctggtcccagaaagattaagacagttggtttcagtgtggcacgtgattcagaatcactctggttgcttgttattaataaatatggtacggtggttctgagcaggggtctgtggacctcacattaagaaacagtgttgtaatgcgtcagaagtgccaaaatatcccagaataacttgacaattactcctgtttccaagatattttgtagatacaagctaatgtttatcagattgggagctgttgtagtatataggaccttctctagccaacatcatctaggttggccattcagaaacatgtcttctctctgatctgtgcaatccttggcccatttggctgcattttctttaaaggggatcattctctaaacaagaccaagttcttaacattgtgaactttgaggcagcagctgggtctcacttcagaaactcctgggcccatttggctgagctactggcttgggtttcttaccatctattgctaaggtccagacaagcaagcaacaacccttttctcatctgttgggtcaccattagagcagagatcaccttttaacttcctttggaagaagtgcaggaagaagctgttctttgttattagcctcagtgagaaaatattctggatggcatcatgccctaaggggcttctctgggttttccaagctaaaatgtcctaaaaggtcctggaaagtgtgaatcggcttatgaccactgttcatattgggctctagatcaggtggtctgtcttgctcaaggctgaccccatctaggcctaccttttgtgtctgccaggtgtggctgaacagtagatctttcattttattaaagtgaaaactggatagtataatgggatattgaaggaaactgatgtgtaatgactcacaaatcacacacccaaattaggaaaaagatgattttgtgtcatgaaaaaatatatgtacatacttccattcagcatatttagagtcattatcacttgagtgcattaattattctgccaagaaatgaaattatttacttgtgggcaatagcaacacccacattgaaactggaaacaatcaagtgcaaaatgttaaaacctgaggaaaagaaaaagcaactcttgggatgtttttgatattcacagtgggatttttcttacctagcatctatctctgcctctttccctggtgatcactgggcaccagtgcagatctttagcaaaaactggcctgccatagaagccacctagcaataaatcctggcaacaatggactggcatatagggcagctgggtacatattatgtaaacaatttccttggccccataaattgttctgccacctgacagagatgcttactctattgctgtgttctgcctcagagtttgcttgcttttagaactcaagtcagaactttaagtggagtatacacattgttcattatggattaagcttatgttttagacctatcattcagaagtatatactctggttatttgaagaataacactctggtcagcaacttgaatagctcttccaaatttttgttttctgcttatcctaggtagataaggttactgaaagaggcagagagagagagaggatgcagcctggagtcatcagagaagggattacggagtaggtcggccacaatcacacagctaggaagaagcagcctggccccagtgtcgctacgtgtaaccattggctaaggatatggccaaatcagaggcacagaagtaggattgatcattattttattggaggcagtagcaggccatccagtgaaatgttgagcaggcagtaggaaatgtgggactggaggtgagtgacagctgatgtcatgagaaggatgcaagagactcattttgacaagagtggtggaaagcccctgccttgttagaggtaaaggttggatccagagatgaggctagattaaggagagctttgagatagtggggagttactgaagcttcttgagcttgaggagtgatactagcaaaaatgctttaagattcgcatcattaaggcatagcttgaggaagggacagacctgtaagggccaaggaagccggttgggagacagtttgagctgatgaggaccaggataagacagtgggaatgaagagaatgcgttgtatctgagagggagagacatgaagaagaaagaaatagcagggccagaagattttccttaaatgggaaaaattgagaaggagggagaatgggggaatatgatgaattttgcattttattggaggtggtagcaggccatccagtgaaatgtggagcaggcagtaggaaatatgggactggaggtgagcgagaactgatgtcatgagaaggatgattcatctgaagaactaagtggagagaacaaaaagcaaaggtccctattgacttttgaatgcggcagtcaagggtttaagtgggaagcccacttctcaattttcccaggtagtctgactgtgttgccagcaatgcttgagtgagttatcttcaggaaaaagttctcatttttttgagcagaaagcagtaaaagcatcctatcaagcacaaagaagggtgaggagaattaagctgcaataatgacatccccgtcctttgcagagtaagtgttagcctcagtagaataccagagctggaagggacttgagaggtcatctgtatggttccagtctgtcacttgacatgtaaaaaaactgagacgggctgggtgcggtggctcacgcctgtagtcccagcactttgggaggccaaggcaggcggatcacctgaggtcaggagttcaagaccagcctggccaacatggtgaaaccctgtctctacgaaaaatacaaaaaattagccaggtgtggtggaagatgcctgtaatcccagctgctttagaggctgaggcaggagaatcacttgaacccgggaggtggaggttgcagtgaaccgagattgcaccactgcgctccagcctgggcaacagagcaagactctatctaaaaaaaaaaaaaaaaaaaaaaaaaactgagacagggaaagggacctgtccaagatcatttggtgagttactggcagattttcttccaatagccaatctgagtctttactgtacaccatggtacctcatagctattgttggggcagcctggttcacaccttcccaaaaatagggaggatgattatccttcaacactttgggcaagatagccagagcgttttcaaggctgtattaaaaggaatctagctttttcaggagagagcataaaatctcagcttgttttagatatgcttaagggagcaagggaaaataatttgctcttgcccaagtttagctgttcaggagaagggggccttctgagaggatacgggcagacaccaacctgagaaaacctcataggcaaacccctgtcatgtccctccttttcctcctacggagcttcttggaaggcaggtccagctcatctaccttcatggcaattggcatatttgctattccatacatgtgaggttcacattttttaacccattctcccttctgctgcttcttattaaaacactaatatttctgacagccaccaaggctaattaaatgtctattttgggggtggtgctgttgaactagaggggaagaacaagaagttgtagataagtggcatggctctaaaagactgggtgacagccataatcccaagttttttcctgtgttaacacagcctgacattgggcatgctgcttacatgaccccaaatacccttttgcagacatttaccaacaactgaggaaggccttgtagataggaagggagtgctggaggcagggagcacaacatatggtgtggcatggggaaatctgtgaagaatgaggcatcagaagaggcaagggtagggcctacactaggacagtccattagggcagtggttctccagatgtgattcccagaccagcagcatcagtatcacctggggatctatttgaaatgcaggttctcaagctgcacttcagacctacctaatcaatactcaaggcctatgtggcccagcaacctgtgttttaacaagacctctgaggaactgagaatcactgctgtaggtcattcacagggtgagctggtccccctccctgccatttgactggttccatgggggactggcaaatagcaaagctgtagagtaaggccaactggagatttaaatctgctccaccacctactaactgggtaactgtgggttacttgttttatctcacaagtcatcttcagtaaaaatggagatgttaatgcttacattggagaattatagaggttgaaatcacaaaagaaagccctttatccagtttgcagcatatgttttctacaagtataagcttctcttgcttcgtccttccctttataactcttttactttccttctgtctttcccatttcttcttctgttcccactgaaagggtccactggccaccccaagctcactgcaaacacacatgccttttttggtcacagagaccagccttagatctcagactcccagtgcctccagggtatagcaatcatatttctaggttaaaaatcaaggcacatgacagctgataaacagatatatctactttggggagcaattagatagaatatttgatattaggattgtcttcggaaatctggatacaaagaaataatatcctattctgtctttaagcataatgcaggactcttaaccctccccatcctcttattcatgtccaaaagttttgttgatgtgggagtgggaaacactatgtgtcccactcacttgtaagtctgagcaagagcttccctatatttagtgcttcctctgaaatgtcctggggattgggaattattttgttagaagccacagtagtgctgtcctaaggctcagagctctttgagtaccttgctagaatgatgctgctccatcttctggctttatgataggcttgcaagatgaaggatggtaacagttggattttggcagggagggaatataaaccagtttgggaatagagaatataatctctgctatagctactcccaaatggccttttcttggttttcttttttatagctctgtaccatttgataatgttgatgagctcttgctgcttgaaactcttgtctttgacttttgagagatcatgctcctttgtatcctaatgatgtgctaacagcttcttttagttttatttatgtagctctttttctgttccttacctcacattccatctttaagcataaatcttgatttcccaaggcttctggccttagcacttttttccagggcaaactctgattttcacaatttcttctgggccattgattcccaaccctgtatatataccctaatctctcttgagcttcccacccacctgcatgtcctgctggccccccatatttaacaccttaaagagaaaatttgtcatcacttcttttgcaaagccaagccaatatttcctcctaatttgtcctatgctttaattgacgtttgcacccaaaaattaactttgacctttttcttttcctcagactagattcaaggtccttcaaacatgacttcactcacctttttagccatcactccctccactcccctttcccaaccctaacctctccaaactccactacttgttcaccatcacatttcccagtcttcttctctgagacttggcttaatctcatttctctgcttcaaatgcccctccctttcctcctgtatctggtaccatcctacccatcctttaagggctatcttcattgccacacaaaacctttctatagcccaatacccatgtgtaatcaacctcctttctctgaagtcttgtactaggccagcacatgccaggcactgtatatccaccatctgagttcaccctctctataaccctgcctgtgaggcaaacattattacccccattttgcagatgaaaaaactgagacccaaggttgtatagttagaaactctttggcttttgtgaaattatactcctagatgtcataattacatgctgacaattacatttaagtttgtgtttctgactcctcttctattcctcacctcctattgtcattgctactttctaaagtagtaaagcccagaatcgaaggtaggtatgcgtgcccataaaaccacctttgcgtcctgctggaaagatatgcattgttggtacctggaaaccctttgttcttcaggtaaggactgcagctgagtcacagtgagcagatccctgcacacagtaggagctcaatgaatgaatgttggatggaagatggatgagcagagcaaagtgcattttaacaaaaattgtagcaagttaaaagttaattctgtacacaaatggaagatttggaaccaatttccaggttaagtttagtttacattttcaaaacaactcagaagatgagggaggaacatccctttgctccggcttgtgtttgtgaggagagaacacagaagccccacacagctgttaacgccttctggattagcgttcctctcacctccatgcacatacctgtcagctctcagttcagtgttttataccctacaaagcagatggtagagtagaattatccccattttataggtgaagaaactgggacccagaggcagaatagtttataagttaagagcagagtctctagagccagactgtgcctctactggaataatggcttcagtagttattggctgtgtgaactgcaaattatttaacttctttgagcttcagctacctcatctgtaagatatgaatagtaatagtttttccttaaagggctgctgtgaggcttgaatgaattaatgtatataacgtgtttagaatagtgcctgacataatagcgctctttattagctaacatcatcataattatcattacacctttagctagtagtataacaaggtcttaaattcagattattttttctacctgtattccctctctgtggtgttatgttagaaaaaacactagtccagaaggctgaccatttgatgactgtaggcaagttacttttgttaaacctcatctataaaatgagggcatgaaggtgatgatctttaaaattctgtccaattctgacagtcattgattctaagtaggccctgacaacaggcttgcaagttggttagttgtttttgtgaccactaggtcctagattggctttgtccagggtatagctgagccttgtgacctgagggcccaggtatatcagctggactaaatgggggacaaaagtcagcgatctgcttctgggaaaagccaggcatggagttcctgaaaagaagactgcaaagtaaaaaagtatagacagtggaatcagccagatctgggcctgggagacctcaaagagcaccacagatagtgtcctgagcagaaggttggtaattgatactgagatactctttgacccttgataaaaagctatggatatagctttaaactacaggtcttaatggtgctctgggttggggctgtatgtgcttactgagttctaacaatgcccacttgggacccatcttttccaggagaggggagacttctctataaaaatttactttagtaagccagtgaccagcttttctttttcttcactgaggccaaaacaaggagaaattgacttttagtacaattggaagaaagcaagttcaacataaaaatgaatgtcctcagcatcaggggcacctatgattaaaggtggctgtgtacatctcctgtagggttctttaagaataggagccaactggcttatgatatcatagatggagttcagtatagataatgagtagacattggtagtacagtttgataattgtaagagcacacaaagttagaagacccagcttcataatgtattacttgtgttattggctgaaggactaggtcacctttctgagcctcagtttcctcatctttaaaatataggtaaatggccaggtgcagttgctcacacctgtaatcctagcactttgggaggctgaggtgggcagatcacttgaggtcaggagtttgagaccaccctggccaacatggaaaaacccccatctctactaaaaatacaaaaattagctgggcatggtggcgtgcgcctgtagtcccagctacttgggaggccgagacaccagaatcgcttgaacccaggaggtggaggttgcagtgagccaagactgcgccactgcactccaacctgggcaacagagagagattccgtcccaaaaaataaaaatgaatgaatgaatgaatgaatggtaatagtgaggcccagttgattccgtaaggatcaagtgatgtagtagatgtgaaaacacttagcaaagcgtaaagcatgaggtatttgaaaggtggtgttgtgaaaggtcctgctggaaatttattttttatctatcctgaagagctcaccctatgccttaccttctgtggaaggcacaaagatgaatcctgagccatgacagatgcatctggcaggacctgaacaaaacatgttaacttaagtcaaagatcagcatgtgtgtatgtgtgtgtgtgttcatatatatgtgttcgtatgtgttgtgcatttattttgagaacctagggttattctgtggctagcatgttggagggtagatatatgagacaggatgtatattctatagactatttctattgtcttaaagttgttttagttttggtcttatggagccattattgccttgagcaaagtaggctgatggaaaagctgacttctagaggacttgttcagaaattcaatgcttgggagagagtgcttgagtctctttgcctgataggccatgtgttctctattctggaatctgttaccccaaatgctgagaagactgatggcccatacaagctggaacagttgagggaaaaagaacaaataacacagtgagcaggatggtaaagagaggcagactacctccccacccccaccccatccctatcaccgtgcttagatgagtttcatgaatgtctgtttgctggtatggcagtggaatagatgtctgcctgctcttgtgtggagcccagtcctgctagccgtgaagtctagtgagcagggttagcgtgcattccatgcacaggtcctgccttgccagctgatctccagctcatcacttgcttgttcagttttgccatccatcaaatgcagaattcaacccagacctctccccctactgtatctcacaggatggttgtacaaatcactgagagaatgtgtgctaaagttgagtttcttgggtacaaggcatcacagaaagccatattctttcctacccatgacctctctggatggcatcatgtgtgagtgagaggaggaggctgcaggactggggtccattatgcgtgaggaatgttatggtctgttaccccaggaggagggtcacggtggggttaaataatgtaccaccaactctcaattggtcagttccaaggaggaggaggaaagggggaggagcacagggaattgaaagcaaataagcttgagtctcattttagccattgctgtcagcctctccacccattcctgacctagagctgccttgaagcaccaaggagagatggactggagctttctttgttctgcacaggagaagttcatgattagggataaaaagcatgaggcatatgtagtacatattcatattctgggtcattccatgcactggctaacagagagttgacagtattgtttgtcttgcggtctaatggaacttttgttccagtgccatccccctcacccctatctctcaccacttgagtatatgagtttctctgtaagtagtagagctctgtgggtgggggaaggggcaagcaaggtagctgtgtggactgaacacattctcattttgtctcctaagctgatcactggagattccatcgttagtgctgaggcagtatgggatcacgtcaccatggccaaccgggagttggcatttaaagctggcgacgtcatcaaagtcttggatgcttccaacaaggattggtggtggggccagatcgacgatgaggagggatggtttcctgccagctttgtgagggtgagtgtcagtcttcactctcctctcctatttccttggctgcctgtacctggcttccccttcaccagcctctgttctcctgtttatttctctcctggtggcttttctcatatttttttcctttttttaaaattgtctcatacagagaacctgggcttcctttaatctgtgcccttttaatttttagacttttcatttgtctcttgtttaacacccccgccccaccacctcccacctttgtacaaatcacttaccttgtctgggtcttggtttcctcttttggggttggccttggtggtttttgaataagactttttaaccctatattgctgtgaacttttgtctttcttatctctcttttttctgctttctatttctcatcttttttttattctttcttctcgtagtttcttcccatctcctcctcttgctcctctgctcttctctccttcctgtctacttctttgcctctcacacccctgtgtgttgtcactgtgtattcagatgttaatataagagtgtgagctccctgccccccaggcgctagagcttactgatatcaaattttacttttttcaagagaatcaagtggctgggatctaaatgtgctgggggtgggaagcaagtggcatgtaaggtcttgcaagccttctgcctctttgacattgtaccatgaagaacctggcccttaacagagaggctcttgggaggaatttctcagcagtttttgctttttctgggtcactgtaaaggaagtgatcccaatgtgcttatgacctcagggtgctatgggagaataacattggttaggtgtctcagctcttattttttcttggaattgtgagctggaatcagctatttgactattttgagctctgattttcctcatctgcacaatggtcttgacagttctttaatgccagggcatgtcacagtgaatgagataaaacatgcgaaaactgctttgtggcaagacaagtactgaagctacatgagggtgtcttataactatccttacgacagcctatcacgttttgttagtttctcctgtaaaattaggctgaagtcttctagaccccaaacaaaaggtcagaagggctagctagggctcctagaggttgaagggccccaatattagaattatggcaatgtgatataaagaaaggaacagggcatttggagttagaaaactctagatacagttttactaccttctagctctatagcttttggtaagatttttaacttccctgagccctgatttcctcatctgaaaaatagggataacagactttttataaggaattagatcatacatgccaataaggtgtctagcacagtgctagacagatattaggaacttagcaaatggtaacttattttatgattatcatcataattataatcatcaccactacctttttagctccaagaaggtccatgtatcaaggcttcccttgaggttgatagaggcctccttcctcaaggtaaaaaatccagaaagtattgttacctggttgggacagtttaggtgagggcactgcctagaagcagaggaatggacaaaattacctctcattcccttctatcatgagaatcttctaatgaaatatccaatcttttcttctcttcagtcagagtctgcaaatgccatctgtgtcccatctcatctttgctggttaaagaatcagtcccagggatagtcagaaaaagcgtatcaataaccacagaccttcaggactaatgtgaggccctgtacgcatacagctggtatgtcttgtgcttacagacctccctctttaaaagaaggattaaactgtaccaaatgatgatgtcacccaaatccaaatgcatttcattttcaaggaaatgttacttttataataaatagtaaatccaaggatggggggaaatgattgagcaagccaggatggctcagggaagcaaatgacagagccagacttcagaatatcagtgggcagccattaatgcccctaagtccaaggccgggaggagtgttcctacaggaacaaagccccagcagccagagtctagctcaagtggttctcaaccctggctatacaacagaatcacttcagtagcacaaaaaaaaaaaaaaaacaaaaaacaacaagaagaacccaaacaaacaaaaacactaacacccagcctccaggctagtaaaataagatcatttgactaaattggtaactgacatggtgaggtatcttcattccctacctggaagtctcattgctgacatttgaaccctaggatggataatcaagggtggttagtgtggttctgttcaagttagccctacctgttgttacacattaaaacccaacctgcagtctgggaaacccagatgcttgcctcagttctattattagaaatgcaacttgagcagcttcctatgcatcttcaaatatcagttttcttccttgtaaaatggggacaattcagtcttgtaaaaatgctttgttacctgtgatatgctggatacttgtaaagaggaattataataccatttagccactgtacaggaacttaccaggtatatgtgtcttgacctattcacacctgtctcctctgttgttcagaatttcatacttgtatgtgcttatgtgtgtgtatatgtgtgtgtgtgtgttctcaggttctttcctttctgtactggggatatggcttcacaagagcaatgtaggagctgatataccttcccagtagttggtaaggttaaatgaattaaacttgctgaacatcagtcctcatatctagttgtcgacatcgtcagctgttttcctgggctggtttccctgctaggagctaagggtagactgctaggatatgattgtgtctctaagtagcaaatcccacctctgtggtgggcctccttttgtctaatagaccctaacttcaagtcattcaggctcttttcctttgtcactgtgcacaaaatgaaccttttttttctgactttgggccatggcctgaggagagcttgctgcctaattaagggtaggttgtggacaggacacatgacaacctgttactgatgggaggtgaggctcgtgtgacaaggcatgggtttggtcagaaagtaaagagcttgctgaggtgtcatcaggagctggatatatacttttcttgttctttcaaattctttatttctctggtttctggcctgcttggaagtatggagatgaaaggatcacctaagccaatcattaccatcatttcttggctttctacagaccagatgtcatggaaacccaacttttccttttcaaaggaaagcccattgttccagagtgtgacctggcttttatttatgtattatctctttttggctgcaaaaagagatacttgggaaaagcttttcacctctatgaaaccctagattcactgtagatttagaactgaaaataaccatcttagccaagagtggccaacttagatgcttacaggggccaattaagtgagtgaaacaaattgagacaaggggtaagtgggcacctgtgtccaactgggagatccatgccccatctaaagacagcaaaagtgacttggatggttcccatcattagagtgggatatagtggagaggaaagcccagaggggccagatcttctagtatttcaagaaaagccgggaattggatttttatgtaaaactctttatatttaaaaaaatgttaatgaggaattcatatttttaaagaagcacagtgagagtcaaacaaaacacatctgtaggataaattatctcccaaggacccagcttgttgccattggtcaccctacctccacgttgtataaatactgaggcaacatgggcccagaaaatggaaatgacttgctttctcatgtagggaattagtggcaaagccaggacttgaacccaggcctcctgaatcttaagacaattttactagacagtctttgtctaataagtttaatgtcttggcttcctttggtatgttttctgccaaattatttttttcctgtgaataggtcacatgttcctgttttcttgtaggccttgcaattttttgttgaaaacttggcattttcaatattataatgtggtaactctagaaatcagattttcttctctccccagggttttctactgttgattgttgagggctgtggttgtccatttgtttagtgactttttccaactatttttgcaagaccgtattcttgttatatatggtcactgaagtctctgttcttttatctcattggtcagccaataacctgacatttctttaaacatctggatccaagaagaaacaaacaatactactttcctggtttttgtagcttgactctgagctggagtacccacttgagactgtgccaggtcatcaactcttctgtctcagccttctcctcctgtttgtatgtagatcacacatcctccagaaatataagcctatggtcctctgaggtttttttctgagcatgcatctggtcctgggcatgcgtgttatagtgtgacttccctggtatgcatggtggcccttatgaatccttattccccaaagaaacttcctttttagcttcctccttcctgtgctattgcatgtgtttgctatttgtcctgtccacaatcccttgtcccaagtgggcatgagcagtgtatgtctttaaatctttcaacaaaggcagccacagcctggaaagcctctccagccagaggtcaacctctgtgctagtccctcagtgccaaaaaggtcaaaatgcacagctacaatattgtaaagaacaaggtcattatctcctggcaccagcaagccacaccaggaatgtgggccactgtcacctcagccactggggaatggggaatggtaagaggataagcaaaagtgcttcaatgctctcttaccaaatttttgctgcccttttctgcattacacagtcccctgtaagttgctgcaagttttggattagattctagagttccaaaacaatgtgttctgtcattcattgccagtttaaggttgtttcagtggaagaactgattctttgtgtgccctgctccaccacttttagtgatgttgtccccttctgaatcttaatcctgtgctttctggcctatagcataatcaagaaagggcaggcttgggctgctaacaagactgttaacacttgaggacttaccttccattccagactaaaggcaatagtgtttttgcgttcttgagaggagtttcactataccaacccttgtttatccattcaagcttcaaagtgttcataagtctctagtcttaaacatttatatcatttatgtagaaggtcttgcttgtggccctagaggtaacacattataggttgtgagtttaggctgacattaacagggagagtctttctccctggattatggctatttctctcccctgtactagaatttcaaatgacattattataactcatttgcattcacataatccatcttaatggcttctcactatgcacattttttggattacatcatctagtacatcatttggctaattggaggttttttatttttttcttttaatatggagacctcttcagctcagagagaatcttaaatgtagctgttacatcacccagatgattcctccaaattaggtagcacaggtcaccctcatagaaatcccaagttgaaagcaaccttgagagtcatatagcctatccctcagcctccaggcaggaccagagctaaaattaccctgggcttttgagaacctggccagcatctgtaaaccaagcttgaactactctgttatttccagctactagcccttatgctgtagtctgagccaatttcttgaaacatgttgcttttttcaataggaagatggtatttaagagttgacaccagtaggagacattctgaatggttttcttggctctggggctttccaaggccctattgttgacccatagcatggatttgtaacctggttggctgcctgagttgaggctatgatcttgggcctggcacctgtttttctctgtgtaatcaacccccgggtttatttggggattagcttagaccttcctagcatcgtgtatatactgccttggtggtgtgatgacttgaggagaggaggaccatgactgagtacctggagatgaggtctgtttctgtggctctttgtaaagtacaacatttttggaaaatcatcatacttgtatatatatattttcttttttcatcagtatatttatcattatgagtaagagtgaaaccacttatctttacatggctctagtgctattaatatcttctcaccagtatttactaagtcctgaacaaaagtgactgtctagcacttagcaacagccacctcctggagtggtctagacaagtactaagggtatctggcatcttgagaggtctgttgtcctctatattagagggtcactagagaaacaatactcagaagtgggttggtctctttttttagttttcagaagtgaaaactgacagctccatacctcttcaggccaccagttatacctcaggacagatctgaaatagtttgtccttaagttgaactagaatctgtctttctggagcttctactcatgggaagggtgtaaatgtccaagagaactggctctggagataatctttctggattagaatcagagcctttccatttattagcaaagtggccattgtatgcttcagtgatctcatcattaaattgaggatataacaacacctatctcattaagttgtcaggagaactaaacaaaatacaggaagagcactgacaatgggatctgacacataggaaacactcaataataatactggtaatacttgcagcaaactcttaatgtaaatggtagaaataatgtcctcatttttccctgctcctctctcaaaccctcttggaatatactgactctccactctgtctatagcccatcagagatctgaaacctcagaccaggtcagccaagcctctcctgtcctccaggcttctgagctttcaccttttagccattatttggatgaatcagtttcttgttgctgctatgtgtgagtggctagactgaggccatccgggcatgcaaggcccactccattcagccacttgtatgagaacatgggctacatggaggcctggacatgctgacactgccaggctttcaagactaataggaatgatattacaactaatgaccctgctgaacatgtaattggacaatgttctttcttggctgttctgacctctaccaagaggcataataatgttactggggccatacatcagcagttagcttccatttaggaacaaataaatggtggaacattgtgttatatgtaggaacccaagaatggattgaaaaacttctttttaaaatatactggggaaaaaagccataataatagacctgaacattctgcccattggtccaactctttgttttgataagcttattaaggtagtacagttattgacattgctgctcagtagagcttggccctgaatgccatgtgccatgtgtgcgatggactcattcccatatttatataaagtaagcatagcttactgttaagcgtacatttaataaagatgctatatacgggacagggccagcagtagccctgaaaaacagtgcagccagatgaacttgaatttggggcaggtcctagaggttcactttcccttgtgggttgggataggctgagagtgtgtgcgcagtgggtaaggtccctcccaactgaaaatattgggagaaagtccagcccagtaggtagagtgtagcatcagtaggcagcagacagagggtggtttgttgtcatgacaagtgactggtattattggtccaacgtcaggttgtttagtgtgcttcaataagcaggtaaagcatggtgaccaggtatccagaggcagggagtatgcagtgaaaatggtttcttaatttgtagaatgaaggacttaataaaaattcattcacccaacagatgatcatcaaatggctactgagaagatacagaggtactctagaacttcagcccatcctctaagagtctgatagtagatgtgaaaacttatgcataagggaggtgatttgccaaagctctgtcactttagtcaagttctttacctttgccaaatctcacttttctcccctgaaagatggaggggttggaacagatatactccaagaacttttctagcccattctccataatttcttcttctttttttttttttctttgagacaggatcttatgcttttgccctggctggaagtgtagtggtgtgatcatggctcgctgtagccccaaactcttgggcccaggcagtcctgccacctcagcctcctgagtagctgggactacaggcacctgccaccacacccagctaattttttgtattttttgtagatgcaggatttcaccatgttgcccagactggtcttgaactcctagactcaagcaatccacctgcttcagcctcccaaagtgctgggattataggtgtgagccaccaccctggctaatcttgttttagttgaggtaaaataaacataacatcaccttccccatttcaatcattttaaagtatacaattcaatgcatttgcaatgttgtacaaccatcaccactatctcattccagaacttttttatcaccacaaaaagaactccatacccattcacactcattcctcactcctctctcctctcagtctgtagatggtataatgttttgtacaaatgttagcaggtagaaaatacaggatagttagggaagggattaaattcataggaactgaggtcaggaagaggcatatgacttcagtagctataggagactacatcagcctggatacaggctaaaaggagtaaaaaacataagacagatgttgcgggaaaagcctcaatagggaacaggtgtcatctaaggcattggtactatcctggaggatcagaaagtaaatgagaccctgccagacttgcctttaacttgttagtaaatggcatagcccaaacaagatcacattccaactccaaagccagtgtttgccacatcaccatcctgaagtgttttttttttttcttttctaaatgtctgtcaaataattgcaagctttctgtgagatgggtaactcaggtcagcttgatttcagcattctgcttagcgtggctttcatcatgaaatcggtacttccatatctgaatagcttaaatggaagtcttctcttcattttagctcaaatagaaagaaaatcaaaggaaatacagaataaatgaacttctaaaggtcctggcagagcactccttttttggctacttaactaattaacctaaattctatcaacgtctaagcaggataattccatgaaaaccaatgaaaggagaagacttaggggtagagtggagtgtagttcttattagaggcatctagttttcttgactgggaaggaagctatgttatctgtgaagggtttccctacactccaatccacccccattctagcttgagttctcactttaagaagccttgtcatgggcagaaatcatcaatacctccagcctcgactaagtaagtctccattcgttgggaagggtttttgagtctggttgtcaaggaggtggcatttggggtataagaaatttgggacaattgcaaagcaattacaaaagtacttcctaaaactcttccctgactagagaggacaatgtttctcatatgttgcttcattgttctaggggcagatgatgccaacctaggggataataacaagaacagctaatatttgactctgtgctagaaactgttttacatgcacagtttaataaggattaaataaactaccttatttaatcctcacaacagccccatgagatagatagatattatttctatttcagaggtaaggaaactgaggatcagaaaacttaaagttgcttactctgtgttactcagaggtagttgtagagccaggatttgaaatcaggatcccgagtcttcaccctttaccactgtcacagactgtctctcctaattttggcctaagagtccagagactttgcttcaatcctgactgccactttgatgcatccccctgtctggccttggatttctcatctgggaaatggaaataaaaaggtttgcttgcctgccttgcagggctgttttgaagtccaagtaagagagttcgtgggaagacactgttcttgaactaggttttcagagaagccagggacaaaagaagaatgatagaaaagagtagggaaggccttcctgaagaaggagtagggggcaggctttagaaggatacaaggtacagaggtgtgaataaacagaatgtgttggaatgaatgggaagggtagcttgcctgaggtcacacgtctgtgttgaagagcagtgaaactcggtgggtcggtcccattttaatgtgctgatgggaagccatgaatgcaaaaacagtatattcacacaggtcttttctttttctctttttgtctgttatataacaaaaattttcattgctctggttgaagctccttatttctcattgtgttggtgctggagagggagaacaatttgttagcagccttcttattatgatacttcatataattagtgagagttattaaatcttcccttgaggggtagaggagtagtttctgtgtctgactgtacataccgtgctgattgtctttgtgccaggcaggaatgctaagtgcttcctggcatgcacattcaggaatccctaagcacttctgatcctcctgaaagctgagactggggctccaaaactgggtgtgtgtgtgtgtgtgtgtgtgtgtgtgtgtatgtgaagtgggagctctgcttgcaactaaccaggttcctctcagtccctcacattcacctttgtatccacacttcaccattgcttcactgtggtggcagagaaaaggccttttggtgacctttgttattgaagagttcacgttccctccaatctctcctttatctgtgttttgcccttttgtagtgtttgctgagatttttggctggcaactttattcagacagagacagagctcatgattagaatgattagaattatctgaaaaaggaaagggctgccttgggagacagtaatctcatcattcgttgtgttcaagcagataggctgtgcaattgctggcagggtatgttgtcaagggagtttatgtattgattggggagcaaggggtggcatggactagtccaccttccatttcctttataaactgattctatagctctgagagtctattgttcaataagactggcaataacccctcaccttctcaaaggatgtcttgctttttactcctctctggttgattagatttggcctttgaaaatatcaaggtgagatttagacaataccgcttacccattctcttctcagaaatattacactgctggagacaggggccggctggctttctaagacactccttgagcctttattgactttatgaaggaattactggctggatattatggtagttttcttttagaactactgatccatttgcagggaggggctactaaagatgttgaagaggttgtaccaagggctgggtaatcatcactttatcatatggaacaatggtgagtctattggaatatgcatataggtatataaatgcaaggagagaggttgacaaggatttcacacaaaatccataaccatggtttcctcaggagaggtagaatatggttaggatgaggaacaatcaggggaaatttcaccttatctagacagttttagctttttatgtatttattttaatagagatataatttccataccataaaatttaccattttaaagtatacagtttagtgggttttagtatattcacaaagttgtataaccatcaccattgtctaattctggaacatatttttaaaatcatttttaatagataaaactgtatatatttgggggatgtaatgttttgatatatatatatgtatacacatattgtggaatgattaacatatcatcatctcgcatacttatcattttttgtagtgagaacatttaaaactgtactttcttagcaattttccaataataatagtattctattacataactatgccatattttggtttatccattcatcaattaatgaacatttgggttgtttctacttttggttgttatgtataatgctactatgaacatttgtgtacaagaatttgtgtgagcatgtgtttttatttctcttgagtacgcacctacgagtggaattgttgaatcatatggtaactatatgcttaactttttgaggaactgccaaaatattttccacagcagctctaccattttacattcctgccagcagtgcgtgggagttccaatttcttcacatgctcgtcaatacttgttattgaccttttaaattattacagccattctaggacgtgtgaagtggtatctttttatggttttggtttgcatttctcagatggctaatgatattgagcatcttttcatgtatttattggccatttatatgtcttctttggagaaatgtctattcagatattttgcccatttttaagcgagttgttactttattgttaagttacatatattctgaatactacatctttatcagatatatgatatgcagatatttttcccattactgggttgccttttcactttattgatggtatcatttgtagcacaaagtttttaattttgttgaagtccactttatttttgcttggttgcttgtgttctaggtgtcatatctaagaaactattgtctaatgttacagattttcctctatgttttctttaatgacttttataatctgattccattcagatatttcatccattttgatttaatttttgtgtatagtgtaaagtaggagccaaagttcattctcctgcatgtggatatccagttgtaccagcaccatttgttgaaaaaactatattttcccccttgaataatcctggcacctttgacaaatatcaattcagcatgaatgtaggatatatttctggactcctggttttatttcattgatctttatatctattcttgtgccagtcccccattctcttgattactgtaggtttgtagtaagttttgaaatcagaaagtgtgagtcctccaactttattctcctttttcaaaattgttttggttatcctaggtcccttgaaattccatacgagttttagtaccagtttttcaattttctgcagacaccaggtgagattttgataggtattgcgttgaatctgaattaatctgaggagtattgctatattagcaccattaaatcttccaatccatgaataggagaggtttttctatatagttcttctttactttctttcaataatgctttgcagttttcattgtataagactgcacttcttttgttaaatttattcctatgtattctttcttttcctatttaaatgtgatcattttcttaatttaactctcagattgttcattgctagtatatagaaacataattgatttttatatcctgcaacattgctgaacttatttattcattataaaaggtttttttttggtggattccttatgatttcctgtatatcacgttatatgatctgtgactagagatagttttacttctttctgatgcaatgtcttttatttctttttttgtccaattgctctggctagaaccttcagtataaggttgaataaaagtgatgaaagtgaatatccttgtcttgttcttgattgtaggatgaaagccttcagtctttcaccattaaatatgatattaactatggattttttataaatgttcattattatttggagaaaagttcccttctatttctagtttgtttagtattttttttttaatcatgaaagggtgttggattttgcaaatgccttttctgtgcctgttgagatgatcatgtgggattttgtaaccttatttcactcatatggtgtaatttacatggactgattttcatatgtgaagcaaccttccattcctggaatcgcatctggtaaggtgggcaatttgtttttaatatgttgctggatttggtttgctagtattttattgaggatttctatatttttgttatttggaagggtttgtgaaagattgatgttagttattttttaaatgtttggtagaattcaccagtgaagccatctagtcctgaggttttttttttttttttttttttttctcccatgtgggaagttttcaagattgaatgaaattatttattaaatctttttcttgttataggtcttctcagattttctacttcttcttgagtcagtttctgtaggttgtgtctttctaggactttatccatttcatcaggttatgtaatttattggcatacaattggtcataatattccctttaattcttatttctgtaagactggtagtaatatttcttctttcatccatgattttaataattttaatctattttttctattttaactttttgcaaggcaaatgtgttcttgtataatgtataattttaaaaatagaaaaaaaaatggaaggcacaaaataaaaatgcacattaaagatatgggtatattgctaactccctggctgtctctgtgggtatcagtttctttattacgaaattgagaggatggattactgttgctgaagtttttgaaagcctttggactatagtatttctatgtttgagcatgggattaaaggacatagatgagaatatttgtggacggaaaatagaccagtctgggaggaacccaatattcctaaaggaagtagtaggaagtaagagtggaaatacagattggagtcagattatggtaatattttaatgtcagggtgagggatttggacttgctttataatcagtggagagctattaaggattttgggtttatgggattagccagtcaatgtgatagtcaaggaaattggtctaatagtggtatgtgggaagggtaaaagctagaggatcacccagggacttgttcaggtataaaagtatgagagcaatgacagtgaaaatagaaaagggagtaataaagaccagagattgtctccaatttggaaagcactccgtggtttagaaggaggagggaggagtgagttgtcttgctcatcctcatgtccttcacagttagtggttaggcacagaataggtccaaagtatttgttaaattgaactgcattaatcagccttgcttcggagttcagtgaagttcaaaggctggtttccccagcctttaagcactctaagaggacttccaggacagcctttcaacctggcatgttccaggcattgtctatcttcttacttgtcacccaggcatctatatgtgctaattgcagcatcaatgaagaaaaggtacacattagcctgcacggattgttgggcagggttgataatggctctctggtctgatatttcaaccagggcagataagcatatgggctgacctgtgtcagtgcactctgacatacatgcagacaaagaccttcctctgtacagaacagataagctctcaagagcagaggacttagaggttagaccagaaagtcttatcattaggcccgggggatgttttgtgggaacctgggatcaggagaaaaacagttaggccttatatgccacctttttctaggctaagaaacatcttccctcaaatgtcagctctataaagggcagtgatttctgtcttttttatttgctgttgtatccctaatacctggcacattatccacacttggcatagatttaatgaatgaatgaatctgttagtagttctttgggatgaaagcagcatcttaacctaaggaatgggcttctggggttgttgcagtagagtagatgaaggtgtcttctcagaagctccttatgaaggaccctgctacacaggcctttagttataaccagaaggacttctctaccaaattctttataaggaatctgttttcacttggctgcagttgccttcgtcttttctcattgttatttggaacgacagtgtcatggtgtatagcttgaacctaaatgtggttctatttctgcctttacatctgcttcccctttccttcatatcctgtcttcattcccactagaattgttcaaaatattcatcttattccagctatccaaaagtgaacatttggacctgacttttcttaaactcctaagaagaaaagaaatgattcttattccttaaaggcctgcctatgttaccctttccatagcagagtttagcttgctttgtgagaagcagggaaaagctaatggattattaagagggtgaggttttcattggtacaaatagacagcatcatgtatatgagatgtttgtttcagtgccttaaatcactttttttttttgcccaggtctattcttttgaataattatctctcatattgcttactgattgcattaaaggacagctattagcatattgaagacacaaagctgaccttttagaagctggaaagatatttataatggagcacttgcagagggtgataggttttggatagagatacattttgcaaatttggctgtatatacaaaatacataaaaacagagtgagccctatttactttggcctgtgacaattcagtgagatatacgctggtgacatctctaagttcactgagtggtaatcatgccccctcacctcctgtgagaaaaagaaagaaggaagaatatacagagttgggaagtaactaccatccttctagttctatcccaaagcctcttccccccgagtgattacccactaaaaggcttttctgatggcagaaatagggatgcatctaaattgtgtgattttagcttcttgaggcaggaatgtggaaaaaactggggtttaaggagggaaaatatggaaaatatggagaattgattaaacctgttgagacaactggcaagctctttggctaattacccctgacagattttgtcactctgccaagcgggcccacccttcgtttccttcctgcccccatggtttccccacttcctaggactgtggggggtggcgggaagggctatcttcttgggccttcttgattttcagtcaaagtcatctagaatatccagagacatctcactcggccgtcccaaaggttttttttttttttttttttttttagcttcccactgccttcatgatttaggatggacagtctcaactgttagcgaatttatcagtttctgatgattctaataattgtctgcccaccttggcccaagccctttccttttcttttcctgtcttccttagaaccagaggcacaaagattctagcacagtgtttaaaagcataggctctagagacagactggctcctatcccagctcctctgcttcctgtgcgacttgggatagattacttaacttctctgagcctcagtctccttttctgtgaaatggtgataatagtggtacctatctagcagggctgaatacagtatattgcaagctcttagcacagtgaatggtgtatagttggtgccaattaatagctattgctagtatgtggtggggaagtattctcccatccctatcccagtcttgaagaggtagagatctttgcatgtccaaggcactttacagtcaaattttgatgattatttgtatatcccatcacagaaatcaacactaaactttgttttcaagacacccactctagtatttaactttggcctctatacttgcaggtgcataaatgctgtgttttgacagcaatccaaatgtggcactcaagatgtatagcttaacctttttaaaaatccagttgtgctacctagatgtgctccagcatgaatgaatttagtccctccactctatttacagataggtcaccagagacctagagaagattaaacccatgcccagggcaaaaagtcaccctagagccaggtttcgaattctacttgcacaggtctctggttgaaggttctctgaatacctgagaagttcagttcatcctttttctacttgcctggaaacctcccaaagaaggaagctaactcattatttttcttttgcctgcttccacagctctgggtgaaccaggaggatgaggtggaggaggggcccagcgatgtgcagaacggacacctggaccccaattcagactgcctctgtctggggcggccactacagaaccgggaccagatgcgggccaatgtcatcaatgagataatgagcactgagcgtcactacatcaagcacctcaaggatatttgtgaggtaaccatggtggttcatgtggaggcacttccacgaagaaccagcaaccctcctgggccctgcctgtgacagtcccaagatgttggaaagggcacatagcctcccagattctgttcagtgaggtgaaactgcttccttagggtcagtgaggtaaaactgcttccttagggtttctcaatctctgtttttcacatttttctctctgtctagttttaatatttattcatttatattcattgtctctctgtctttaccctttcttagtcttcctccttctctcccctgcatctctacctttatctttttggtatctgatccagttacagccatctcatgtaagggcttaacctcactcattaaagcaaaatgcatctcccgccaagccagtgattcacagacttcaatatgtaccagagtttctgggggagcttgttaagcagccctctcactcttgtcccccaagtcatgaattatcagtctcaggtaaggcatgagcatttttaggtttaatgagcatccctggtgattctgatgctgctggtcctactctctcacttggagaacaccggttgtgagtttaagcagaaaagagcttggagacaggactccacagaagatggaggctggatggacaaacctgggctccttcagtatgtcactttttttccccaagagctgtctctctacattccctaaccccattccttccatctctctgtcctaaatgaagatgagagccttcactctcgtactctcttaagcttagtagctgcaagttggcatttttaaagggcattttactgaacaggaagggaaaaccaatgggaaatgaaggcagcgttttaaaaggattaaacacacacacacacacacacacacacacacacacacacacacacattctctcttatatctttcttcttgactcggaaaactctgcattgaatctttttgtctccttccttccagaggaggggttaggttctattttctgtcccccagcctagggtccactgtggagtcagtagtacagctccaacatttttcaaagttcttatttctctacatcagtactgcccaatggaacttcctgcaatgatgaaaatgttccatgtctgcattctccaatatagtagctataagccaacaatttatggttgttgaagagttaaaatgtggctggtatgactgagaaatggaattttaaattgtatttacatttaattaactttaatttaggtaaccatatatctgtaatgacagccacattgaacagtatagctctggaaacaccaaggccaaggattttgtgcctgaactttctttatctcaactcattttctcacccctttcaggaagattaaaagttatcttttcccactgccccactccctgccctgccatgaggcagatagagtagaaagaacaagaggtctggggacatggaatgctggtttttcacattctaacttggtcattaattaaccctgtgggcttgaagataccccttaactcctctgacattcaattttcttatttttccaatgggcttcattatagcaatctcttaagtttgttgaggaaattaagtaaatagaatattgcaataacctatgctgtatttggaaaaaggtaattttcttttttgcctcctttttaaatttattcacccatccatccatatgtctttttcttcttcctcctcccttcacatcaatggctgatgctaaaaaaattccccctcggaatgtgctacatggcattcagcatcaaaccactgacatttcattcattcggcaaacttttagtggaattctgttctgtgccaggcctggacataacttctagcctcaaagtgtcgtactttagagcagcatctgcatcacctggaaacttgttataaatgcaaaatctttggctccaacccagacttactgaatcagattatgcattttaacaaagttactatttgatgtataatacatattaaagtttgaggagcattgctccaaaatgatacctatattacaatgtcatagtgtttttcataaaattaagtacaatctattcttcgcttggtagctgagggatgctgtcaagatctaagtcaggtcatatcactcctctgctcagaaccttccaatggctcaccatttctacctgagtaaaagtcaaagttattattgtttacaggggcctgtgtggtcaacccatccttgcctctatgactttcacctcctgctcctttctgctatgctttcgttactactccagctatactggcctcttgcttttccttcagcattactaatatattcctcccttagagcctttgcactggtttttccctctgcttaaagcattcccctccccaccccacatttacatggctcccatcctcagctccttcaagtctttgctcaaatatcatcttcttgagacttctctaagcattctattgaaacctgtaaccttgcactgcctctgcccctttcctgctttatttctatctgttacatttatctatctgacatattatatatttaacttatatattttgtttattgtctgtctcctctactggaatgtactttccatgaagggcagggattttcatctattgatttactgatatattcccccagcacagtgcctggtacatagtagatgctcgataaatattgcttaaagtcaaaattaaatataattgctcacatgtatgtactgctttgattggcaaagtacattcacatcatatgtcatttgatcttcaaacaggacaaaagttgttattgttattcctattttctagatcaacagatttaatctctaagaagcaaaattattttcccagagctctcaggtactagcccagtggaagtccttagaagtttctctcaactcccacacatcttggcctcttcctatgggacacagactcaggacagcaatggaagttatttgtctttccagaaagtagggggtgatatgatcctgctttaaggagtttccaatccagccaacccaatcaaaccttttgttgacaatttgctggttccttatttttcaacaattattggtgctgaaggtaagtatttaaatgggagctatctccttttctcaccctataatcacgggcatcaaagggaagtggagaaagctgcatctagctggatcagaagacagtagtttagcccaggattgtgtaatctttaaaccaaaagctgtgaggagcgaatggtttatcagaaagaataccagactcagaattgggagtgctgggttcaggacctaccttggtcactaactgactggggaatctcagatgagtcttttcaccctagggcttgtaccccatctctaaattgcataggttggaggagctctttaagttctgtttggctcttactttttctctagttctgtaagatgtagatatgccctcactagagaaaaactgtgatagcgagccaggctacttctgcattttctgcttcttccttcttggtaccattggaagcatgtcttactcaagcatggatgtgttaacatggcataaaccactctttctgtaggttatgggagagctctaaacacttcctacttttgtacttgttgaaggggaaagggggaaaattatattcaatataaaaaaagtcacactatttattagaggacattctttttccctcctgggagcagaaagtgctttacaaacatttaagttataacacccttattttacaaatgaagaagtaggaaataaaggggtttttaattgaagttattcaatgaggtcagtaagagacataatcttttcaaatgagttctctgcagattacattcttctttctaaacccagacagtggtataaaataccttcagtttagttctagatcaccttgaccaacaattggtgatattgcctcttataaccttagaactcaaagtacaatcaaggaaactgaggcaagagtaagcagagctaacgatgctttataaagctgtcttgtctgctttctcttgaggaagataatctcagccatctgatacctatgaaataccttctgtcttcaaatgcctccagagaagctggcctagctttcctcactcactctgtattagtgatcataccattcactatcaagaaattcttccttaggcatgctgtagcttcaagtcatttccatttggtatattttaagcctgaggttttcaaacgtattagccatttgggttttcccttctgcaaattgcctatctcaatacatcccaatagtctttacatcttggcacatagaaaatgataacacattgtataagatagtaatatttgtacagtatcctaggataaaaatatgagtcagctagtcagcctaaaatgccaagcccaggggtttctgcctgccataggccctacctgtccattctgtctggacattctgtgctgtgttcctatactttgcccattttcatggagtttcttatgtttttttcttgctgatttgtaagagttccttgtatattctagatatgaactccttgtcaactttccatgttgcaggtatcttctttattctcttgtttttgaataacttttttacttcatttgaagaaagggtttcctatctcaaagagaggaagaaggaaataaaagaaaaccaccaatttgaacattctgcttctaacttacctttgatcatcaccagcatgggaagaactaattagcatttagttgacaaataactgagcagcaactatatgccaggtattctgttaaactttgaggatacggctgtgaataacaaccatggtcattatctcctaattttcttaaaaatgtcttcaagatgtttgtcaggtcgcctatcaggcctcaggttccaggcaaaaaaaaaaagacatatgaaacccctagaatgtcagaactgaaaggatccatggacatctttttcgatgtcttcattttagagacagagacactgaggtctaaactttttgtgagggcccttccctaaagaatttcctaaaccccagatgatccaggggctgtttggttcatcctattttctggtagtttctaggatcttttctggagatcttgggtattgtttatatcccatatcaaggcattacttctagatcaatgcactaggtctcaactcgtagatcagccctggtgggtttaagaacaaagtgaaatagatgggcagctttccttgctgttaccataacaatgccagagctaatttatgccagttgtgactgatttgataatacccacatttatcttagctactctctggcctgccttcccacccatgcccactttactcctaggagacagagattaggctctaggaaactgcctcccttgagccatagtaccctgttccctgttaccattcagatggggcgttcaaagcatacctggcagtaagagccacagaccccttttgttccccctgccctgtgacaggccttcaatgggccctgagtgttatctaagacaaacaaattttatgtcttccatcattcttcatgatgttgcttttcaggcccctccctaccctgctcactcccctctggctgtgtgctattttcttggtgttcctctgaaaagagggtggactcaaaatttaattctgctctcctgcagtggtatgactaccttccaattgcctctcccatttttgcctctcaatatatttcttcttttttctaactgaaaatggtattaggctttttgacaatcacatttcactgccaactcattttaaacttacataccttcaaaaatgagtgaatgagagtagacaagtattgattgaccccctaatctaccctctgttcaccactgatgtggaaaatttgatagccatcaggccagccaaaagaaggggataaaaaaagcaagactccagggagctaatcatttctcctggcctttctttttccagaaacttgtgtggtatagaggtcgagggtgaccctttggggttatccagctactcccatattcttatgtctcatcgcttatttttttgataagggcagtttacatctattatttgtaatctttagcaagtgactatcttagatactatggctgcaggagatcttgagaagacattgggtcttccctcctctttccttgataatatttcattccaggcagccttcttatagctgcattttcttttctttacactctctggcaaagacttttatcccatttttgatcatgaagacaattaaaaaacagcattagaggaagtttaaaaataggaacaaaaaccagccagaatccatcaactataacagaattatttgcacttttgcataatcccttcaaatctgtccatatgtgtatatatttacagagttgtaatcacactgatataccattttatgtcctactttttaacattgtatcataaacaattttccatgtttctacatggtcttcctaattatcattttaactgctatgtaatatttcatcaagctaaatgtaccagaatatatttataatctatcattggctttaaaaataagagttgataaaacattctaaggtcctaccatcctgtgggcattcttcctaatatatcccctgccataacatacataatataatagaaagaaaatgatttccttgagagtggcaataaataacatatttagggacttaggaagttggactgaattctttattcattgtcttttcctaagatcactctcttagttttatttctgttatattttatgctgatgttgacttctagtatcattgttgaattctggtgattttatggtgttttgtttcttccctgagacttttcaaataggagcagtggacacaactattaaatattttctgaactggcttctcagcagataaatgagctatctacgctgccctcttctgtctctcattgtggtcactcatcagtacctattgcttacccagaagtaatatgttgaatgtgccactgttactgttttcccccagctgtgctcctcagcctgccttagggaaaaaaaagtgggagaaggggtaaggaagccttcactcccatttaatgttgagatgatatgctcactgctctccctgctccattgtagctaagacacgtccagagatggtagggtgaaagagacagatagacaggcacacaggcacagaccaacccagacatactaggctctgggaattacatattaggtagggaagggcctacaggagtttattgccattccttctggtagtcaatgtaaaactttctagggaggcagaatttggggagcaacctctgtaaaggtagtggagccaaaagggtgttctgggaattttcttcctgatcaaaaattgcatatgaaagaatgcaggaaattttcaacatgtcagtcaatgagggcacaaatcattagttaaacagatgtcaacacaggcatagactattaatttgccaactatttaaagacacctactaattaatggctaaattggagagtgagaacagatatgggaaggggaagtgagatttgttgtagaggtcagtaaaagacattgaagccagggatgaggatcttcttggagtgtgcccagatgacctcattggtagctgtgttaagggagacaaagcgaggatagggacagggctatatgtggtaaatcagtccctgtaaaactcttccttaggggttcaacccttaagaaaagtgttaagataatttcacttagctttttgatgaaagcaaatgactataatttcttctcaccaagaacatttttatgtgttactgatttctaatgaggacagtaactatcaagtgaaaacctatgatagtaggttccaaatggaagatgcaatttagattggggctgtttttgtcctgacttaagtatgccttgagtctggtttatgttaccccaatgctttcttactagaccaagaatctctttcatcctttttttctctttcatcagtggttatctttattaatgtgttttatgtgtttagggcacatttatgtgtttaagacacatgtgttaggtgttaggacatattaacgtgttaggacacatttatttataaatatatatatatatgatatatttataaatttatatatatatatataaatttataaatgtgtcctaaacacctgttctgttaaaaacaccatgtccaggcacacataggcttgttggctgagctcatctaaatgatcactcctggccagctacctcagatagttgagaaatttgctttgagaaatggtttgacagatatttgcataatgtgaatagtatgaatgcattttcttaaagtatgtgaagacatgaatgtctaagaaaatattgtatgtgtactttgatgtacacaacagggaaagtctaaaatgataaacaactattattcctggttatttcctgacattaaagttcatgaggaaacttttttttgaagaaatggttttgttttgtcaatttctgttcccttgtgggaagtttttctgttctggcctctgttcccaattttttgtcaatgttattaagacctttggtttggtcctataaggaatagaactttagagatgtgaatggatccagctaaaccagtagctaataagacctgtgaaaatgtgctcaaccagcttcttggaaagggatatttgactttgggggtcttcttcatagaggatggagggaaaagactttggagtctttgcactcttaagacttttgctggcaacccagctttcctaattactcactgggggagtgacttccttctgtaaacctcagtttcctcatatgaaaaatgaaaataattattccatgcctacttcttgggaccaaaatgaggctcttaagtgcttaggaagtgtaaagccttctggaagtcagggacttcctcagcctaggctttttctttgtctacagggctatctgaagcagtgccggaagagaagggacatgttcagtgacgagcaactgaaggtaatctttgggaacattgaagatatctacagatttcagatgggctttgtgagagacctggagaaacagtataacaatgatgacccccacctcagcgagataggaccctgcttcctagagcacgtaagtatcttatccatttggggagggttttgagaggtgttaggaaacaatggaaggagcgtttgagctgtctggttctgttcagctcctttttcctgcagtggggaatgggttcctcttgggccttcattttgacccctggtctctagccaggaaacaaggacttagaaaagtgctgtgatttgccctataaatgttaagcatgtgtatgacctgctggttccattcccgaatgtatattccagagaaactcacagaagtccacaagggagcacatacaaggctgttgttgattgcatggcagtgtcgtatgtggtggagtaccattagaagcaacctaggattctccttctttaccattcccctcccctctccctttccttcttggcagttaccagtagaatttttcttcatcttcccttttttgtttctgttaagtttccatgagactcagtattttgggaggaattcaaaatattcactgcacagagaatcaaggaatctgagaaataacaaggaccatggttagtaagaaagtggtccctgcaagacatttatgggaagggcactggagaaggtgaagtgacaaaaataggaaaagaacacatggacttcgaggatggagctctgggaaacaggatagtgacgatttgagtcctgtatctgtagtgtctgtctgggttactttgggcaagtccttcatgggctttggtttgttcatctggaatgtgaggttacactgtatgatctctctggttctttgacatcatctgagtctcattcacaggtgacctagttgttttgacagcatgtttccccttttaataaagtatttatttttaaagatttaatatgtgcacttaatataaaattcaaatgacacacaaaagcatgcagctaaaaataagccttcttggaaatattcctgttttacttctgagactctgtgttggggtgggttccctaagatcactcttatgtttagtgatttggactcagaatatggttatattgaatgtggtttaggactcagaacatgtttatactcatagctatgatttattatagcaaaatgattcgaagtaaaatcagcaaaaggaaaaggcacacagggcaaagtgcagaggaaaccaggcacaagctttcaggagtccatcccccaatggagtcacacaggatgcacataaatcccctaggaatgagttgggacaacacatataaaatgttgtctgccaagaaaactcattagagactcagtgtccaaggttcttattgtgggctcatcatgtagacaccttctgcctagtgtgtactaaaattacagactcccagaaggaaagcaggtatttagcataaaccacattgtttgtacaggcagtctggacacagtgagccactcttatcagggaatagtgggggaaccctcttgagaaccaagtttcaagatgccagtcaaggggaaatatttccagcaggtttttctgagaacagcaatttcaggcctgatacgataactcttttctgtatggtatgtaaactcattcaaccattctagaaagcacctgggtagtatttataaatgttaaggatgtgtatgaccttctggttccattcttgaatgtatattccagagaaactctcacagaagtccacaagggagcacatacaaggctgttgttgattgcatggcagtgtcgtatgtgttggaataccattagaagcaacctaggtatttatcaccagggagatatataagtggatggggtttgcttattgtgaggtattatgtagcaacaaaccgaagactagatgtatgtaccttatagcaacatatatcagaaacatagtattgaatggggaaagtagaatatagaatagtggttctcaaccgggggctgccctgtacattgtaggatgtttaacagcattcctggtctctagccactagatgtctgtagcaatgccttgctacccagttgtgacaaccaaaaatgtctccagacattgacaaatgtcccctggggaaaaaaaagaatcacttatgttttgaaatgataacatacttttacctttaatctgttaatgcagtgaatttggattgaatgattttcatatgtgaaatgaacattgtattactgggatagaccccacttaaacactgtgtgttatctcttttaatgtattattttaccttttaaaattaattgtttacccttttattagttctagaatttcatttttatcagctttacgtagatataatttacatacaataagattcattcattttaagtgattttaagtgtatactttaaggagttttaacaaatgtatatagttgtgtaaccaccataataatcaaaatataggacatttctataactccacaaagtcctcttatctagacattgcaaacaatctgtgcccctactcctggctactggcaaacattgatctcctttttatttgaaattttgctttttctagaatgtcatatatgtgaaatcatacagtatataatcttttatgtttagcttctttcatttaacatagtgcctttgatatccatccatgctgttgcatatatctttcgtttatccttttttattgcttagtagcactccattgcatggatataccacctattcacaaattaatggatatttgagttgtctccagttttgaactctaatgcataaagctgctatgaacattctagtacaatattttttgagaatatatgttttcatttttcttggttaaggacttccagggttagggttgctaggtggcatggtagattttttagcttattagataatgccaaactattttccaaagtttctataccattttgcattttcactactaatacgtaagagttgaagttactccacatggtcatcaacacttgatattatcagtatttttttttttttttggagacagagtcttgcttcgttacccaggctggagtgcagtggtgcaatcttggcttgtagcaacctctgcctcccaggttcaagcaattctcctgcctcactgtcccaagtagctgggattacaggcatgtgccattacacccagctaatttttgtctttttagtagagatggggtttcaccatgttggccaggctggtctcaaactccttacctcaagtgatcttcccacctcggcctcccaaagtgctgactgggattataagcgtgagccatcgtgcctggccagtcactatttttttttttaattttcgccattctaacatgtaggtgtgtagtggtatctcattgtaattttaatttacatttccaatgtatagtgatgttgagcattttttcatgtgtttatttgccatctatataaaaactggtgaagtgtctattcatgtatttttcccgttttaagtgtattgtttgtttttttattgtttagttttgagagttcttttattaaaaattaatatgtaatttacttatttatggggtacatgtggttttttttttttttttttgagatggaatctcactctgtgacgcaggctggagtgcagtggtgctatctcagctcactgcaacttctgactcccgggttccagcaattctcctgcctcaacctcctgagtagctgggattacaggcatgtgctaccacgcccagctaatttttgcatttttttagtagagacggggtttcaccatattagctaggctcgtctggaactcctgacctcgtgatccatccaccttggcctcccaaattgctgggactacatgtggtgttttgatacatgaatacaatgtgtaatgattaaatcagggtaattgggatagccatcatctcaaacatttatcatttatttgtgttgggggcattccaaatcttctagctattttgaaacaagcaattaattattgttaactacaattgtttttataactattttgaaatatgccattaattattgttaactgctgtgatatcaaacactagaacttatttcttctatataactgtagttttatacccattaaacaacctctcttcatccttctctccccacaaccttcctaacttctggtaactactactatactctccacctccatgagatcaactttgatagcccctactcacatatgagtgaaaacatatgatatttgtctttctgtgcctggcttatttcagttgacataatgtcttccagttccacccatgttgctgcaaatgacaggattttctttttatagctcaataatattccattgtgtatatatagcaacatgttcttcatccattgatccatcagtgggcacttaggttgattccatatcttggctattttgaatagtgctgtgataaacaagggagtgcaaatatctcttctgacatattgatttttcttcttttggctatatacaatatatacccagcagtgggattgctggatcatatggtacttctgtgtttagttttccataccattttccataatggctgtactaatttacattccgatcagcagtgtatgagagttctctgttctctgcatcctcttcagcatttgttattttttgtctttttgataataaccattctaactgcggtgagatgatatgtccttgtgattttgatttgcatttccctgatgattaatgatgttgggcatttttcatatgcctattggccatttgtatgtcttcttttaagaaatgtctgttcagagcatttgcccacttttaaatcagattatttgtgtttttttgctattgagttgtttgagtcacttacatattttggctattaatgttttgtcagatggatagtttgcagatattttctctcattctgtatgttgttgcttcactctgttgattgtttcccttgctgtgcagaagctttttagcttgatataatcccatttgggtatttctgcttttgttatctgtgctttagaggtattactcaatagagtctttgtgcatatcaatgacctgaggcatttttccagtgttttattctagtagttttatagtttcaagtcttacgtttaagtcgttcatctattttgattttattttttcatatggtgagagataggggtctagttttattcttttgcatatggacatccagtttgtccaagaacataagttgaagaggctgtcctttctccaatatgtgttcttggtgtctttactgaaaatgaattggctgtaaatgcatgggtatattttgggattctctattctgttcaattggtctatgtgtctgtttttacttcagtaccatgcttttttggttactatagctttacagtgtattttgaagttaggtagtgtgatgcctccagctttgttctttttgctcgggattgctttggctattctgggtcttttgtgggtccatatgaaccttaggatttttttcccatttctgtggtgaatgtcattggtattttgatagagattgcatttaatctgtagattgcttttggtagtatattttagcaatattaatttaacaatattaatttaatattaattaattgcatttaatctataggttgctttaggcagtacattttaacaatattaattcttcccatccatcaatatgggatatctttccctttttgtgtgtagttgtcaatttttttcagcagtgctttttatttttattttagagatctttcacttctgtggttaaatttattcctatttttttttaaatcctgttttaaatgggattgcttttttggtttctttttcagattgttcactattggcaaacagaagtgcacctgctttttgtatgttgattttgtatcctgcaactttactgaatttgttgatcatttccagcatttcgtgtgtgtaggtagtctttaggtttttctaaatataagattatatcatctgctaacaaggataatttgatttcttccttttcaatatggataccctttatttcattctcttgcctaaattgctctggctagaacatgcagtactacactgaacataagtggtaaaagtgggcattcttgtcttggtctagatcttggaggaaaggcttttgatttttttcctgttcagtatgatgatagctgtgggtttgtgatatatggcttttattattttgatgcatgttccttctgtacccagtttgttgtctttttctcatggagggatcttgaattttatgaaatgctttttcagcatctattgaagtgatcatacaggttttgtccttggttctgttaatgtaatgtatcacgtttatttatttgcatatgttgaaccaaacttttgtccctgggatgagacccacttgatcatcgtgagtgatctttttaatgtgttgtttaattcagtttgctagtattttgtttggaatttttgcatctatgtttgccagtaatattggcctgtagttttctttttttgatgtgtttttgtctggtttgggtaccagggtaatgctggcctcatagaatgagtttgaagtattcctcctctttacttttttgaaataatttgcatagaattattatcagttcttttttaaatgtttggtggaattcagcagtgaaaccgtaaggtccttggcttttctttgatgagacactttttattactgttttgatcttgttacttgttattggtttgttcaggttttctatttattcatggttcaatcttggtacgtcatatgtatccaggaatttatccatttcttctaggttttccaatttgtttgcctgtagttgttcatattctctgtaatgatcctttgtatttttgtggtatcagttatattctcccttttcacctctgatttcatttatttgagtattctttttttcttagtctagctaaagatttgttgattttgagtatcttttcaaaaaaaacaacttttcatttcattgatcttttgtatttttcagccttaatttcatttatttctgctctggtgtttgttatttatttccttctactagctttgggtttggtttgttcttgccttcctaattctttgaagtgacttggtagattatttatttgaagactttctttttcttttttgatgaaagcttttattgccataaattttcctctttgtactgcttttgctttatttcataggctttagtatcttgtgttttcattttcatttgttttgagaaatttctattttttaaaagaattttgttatttacccactgatcattcaggagcaatgtatttaatttcggtgtatttgtacagtttcttaagtgctcttcttactgatttctagtgttgtttcattgtggtcagaaaagacacttgatattaatttgactttttaaaatttgttgagatttgtttatggcctaacatatggcctgttttcaagaatgttctatatgctgatgaggaaaatgtgtagtctccagcagttggatgatatgttctgttattttcagttacgtacatttggtctatagtacaactgaaatccagtatttctttgttgatatcttgtctggataatctgttcattgctgaaagtgagtgttgaagttccctattattatggtgttgtagtctgtctctctgtttaaatctactaatatttgttgtgtatatttgggtgctccagtgttgggtgcatgcgaatttataattgttatatcctgtagctgaattgacccatttattattatataatgacattctttgtcttttcttacagtttttgacctgaagtctgtttcgtatgatatatgtgtagccactgctgctcttttgtggtttctatttgtacgcagtatctttttccatcccttcacttttagtctctatgtgtcttattcactagaaattcacttaaagaagtgaacttcttgaaggcagcatatagttggatgctgttttttttaatccattcagccactctcttttaattggagaatttagtcccatttacattcaatgttatttttgaaaggtaaggacttactactgccattttgttattattttctgattgttttgtaactcctgtcttccattattttactactatcttcctttgttgtttagtgatttttctctggtggcatgtattaattatttgcttttgttagtgtatcttttacaggtttttgctttgatgttactgtggggcttagaacatcttattataaactgatgacaacttaactttgatcaaaagaaaaattaaaaactaaaatctctaaaatttaagtccattacttccccattttaactttttgttttctcagtttacatctttttatattgcctatcccttaataaattgcctttttgttttgttttgtttttgagatggagtcttgctctgtctcccaggctggagtgcagtggcacgatctcggctcactgcaacctctgcctcccgagttcaagcgattctcctatctcagcttcctgagtaggtgggattataggcacgtgccatcacactcagctaatttttgtattttttagtacagatggagtttcaccatgttggccaggctgaccttaataaattgtcattatttttgatagatttttttcagtcttcatactaaagttgtgaacggtttacacaccacaattcagtatttgtctgcatagtttattctgaatttgtctatatacgtttaccagtttattttataacttcaggtgttttcttgatacatattagtgttcttttaagattgaacaactggcttcagcagttcatgtaagacaaatcttctgttgatgaattccctcagcttctgtctgggaaagtctgtatctctccttcatgtttgaaggatggctctgctgggcacagtatgggaggtttttttgttgttgttgttttgtttttttcattcagtactttgaatatgttgcccccctccctcctgccctgtaggacttacactgaaaactctgttaccacaggaattgaaactcctttatatgttatttgcttcttttctcttgctgcttttaagatttccctctttgtctgttaacctttgagagtttgattattatatgccttagggtaatcttatttagattgaacatgtttggttgtctttaaccctgtacctggatatttatatctttctctaggtttggaaaagtctctgttattattactttgaataagctttctaccttttgttctttctcaacatcctctttaaagccaatgaccctttgacttgctcttttgaggctatcccctagatcttgttggcgttcttcatttttctcattattttttctcttcttattgtgtattttcaaatagtcttagggctcaccggttctttcttctgcttgatcaattctgttgttgagaccatcccatgtatttttcagtttgactattgtatttcttagctctaggatttctgtttaattttttaaaatttcaatttcattgttaaatttctgtaatacatttctgaattgcttttctgtgttacattggcattttctgagtttcctgaaaattgctattctgcattcttgatctgagagctcacacaacatcatctcattagggtcagtcactggctccttattttgtctatttgggaatgtcatggtttcctgtttgctctttctatggatatatgtctgtgcatttgcattgaaggattagttctttattccagtcttcactgtctggcttggtttggtctttcagaagtatgtctgtctagaggttttgtgcagagtgactatttagttcccttagcctgagatcactgcctccttttcaacactagatggcaccctgaacccagatttgacatagtctttctcaatttcagagtgctactcatcctggatggggaggaatcccaaagataccccagctctgtgggaaagctggatggaggtttgttcccagaggactgatgaagtgtgcttcctgcaacgtgatgctgttaaacagcctttctgatttggtgtcttttttgaggtcagatgaagggaagctggagtttcatgcactgggtgttgctaaccccacccccaccctctaactctagctgcctttgggattttttactctgcaggcattcaagaggcttcttacaggttgaggcaggaataatttttctggaaaggaatctaagatggtggggaagctagctgtccacttttattttttccagtattataggaaccttgattttgagggtgcctttctacacagtgcctggcagcttggggaaggagctattttaccttttgcttgcagtttttcagttctctgtggcctctgggattgtcacaacttcagtcattgagttctggaatattccttttgataatctgggcagtggctagttctttttggttttctgtggaggagagtaaagctacatatactgtgctattttggtgacattctcagttatgagaattatatattttgttaacaagtcctttgtcagataagttatttgcagacattatatcccagtctgtggcttagcctttcattttcttaactgtgtcttttctaagttgtgcatatttatggagtatgtgagaaatttttaacatatgtataatgcatagtgatcaagtcgggttttagggtacaatgcattttttttaagtatagtcatcctactctgctattgaacattgaatgtattccttctatcttatgtttgtaccctttaacccacttatcttcatgttctcccttctcacctgctcacacttccgtctctgttatttttccaccctctacctccatgtgttcaaattttttagcacccccaaataaatgagaacatgtgatatttgtctttttgtgcctggcttatttcacttaagacaatgacctctagtttcatctacgttgatgcaaatgacataatttcattctttttatggctgaatactattccattgtgtagaagtaccatattttctttatccattcatttgttgatggacacttagattgattccttatctttgctattatgaatgttgctgcggtaaatatgcaagtgccagtattcctttgatataatgatttattttctttaagtcaatacacagtaatgggattgctggattgaatggtaattcgatttttagttttaagagtatcttaattttattgaaatccagtttatcgctttattttattttatgggtcatactttttgtttcctactttctttgcctatctcaaaatcataacggttttctacttttttaaaaatagaagttatatagttttattttttacatttaggcctatgatcccttttgtggtaatttttatatatggcacaaaatacagatcaaggttaattggtttctgtatggatatttgttaaaaaatactgattcccctattgaattgcctgggcacctttgtcaaaaatcaattaagcatatatgtgcagatctatttttaggtatactcttctgttctagtgatctatatgactattcttgtaatagtaacccactttcttgattaatataggttcatagcaagtctttaaatcagatagcataactcctccaacttagttctttttcaaaacaattttagctattttaggttatttgtatttctatataaatttaagaataatcttgccaaattttaccaaaaacaagcaaacaaaaaccctatcagtgttttggttgggattgcattaaatctgtggatcagttttgggaacattgatatgatgagtcttcaaatccatgaacatttaactgtttatttcgatttttttgtgatttctcccaggattgttttttagttttcattgtatgattttgaccttttaaaatttgattgttttaaaaaatatttaaggtataaatttaagatgtacaatgtgatgttttgatataaatgatgaagtgatgactacagtcaaacagattaacatatcatctcacatagttacttttttgtggtaatagtatctaaaatttactctcttagcaaatttccagtgtataatacaataatgttgactctagtccccatgctgtaggttagatctctagacttttcctgtgtaactacaactttgtgccctttgacttatatcttcccattttctcccaccccctcacctctggtcaccaccatcctaatctgtttctatgtattcattttttttttccttttgattccacatataagtgaaatcatgcagtagttttctttctgtgactggattatttcatgtagcataatgtcctctaggttcctccatgttgtgacaaatgacataatctccttccctccttctttttaaagtctgaataatattctattctgtgtctctgtatgtatatgtaatatatatataaataaattaaaaatagaggtaatttattaaaatataggcaacatattacatatacatatacacccgacagtttctttacccatttatccattaatggacactttgtttgcttccacatcttggctattgttaatagtactgcaatgaacatgggagtgcagatatctttacaaggtagtgagtgcatttcctttgggcatatactcaaaagagggattactggataatttgataattctatttttgatttctttgggaacatcttaaaggtattattttccacagtggctgctgtaccaatatatattcctactaacagtgtacaagggtctccttttctctaaacccttgtcaacacttgttatgtcttatctttttgataatacccatcctaatagatgctaggttatttctcattgtggttttgatatgcattttcctgatgattaatgatgttgagcatcatcgtatacctgttggctatttttatgtcttttttggaggaatgtctattcaaattctttgctcatttcttaattagtttatttgtttatttgtttttttttgctgtgaagtgatgtgagttccttatatattttgaatattaaccactttatatattttatatatattaaccactttatgtatattttgaatattaaccactttacagtttgcaaatattttcactcagtctataggctacctttgcatgttgttgactttttttttctgcatagcagctttttaatttgatgcagtcccacttgtttctttttgcttttgttgcctgtgcttttggtgtcatataaaaaagcacagcagtagtgcttttagtagttttattatttcagctcttatgtttcagtctcttatgcattttgagttgatttttgtgtatggtctaaaatatgggcccaattttgttcttttgcatatagatatccagtttttccaacaacatttattgaagagactatacgttccccattgtgtcctgttggtgctcttgtcaaaaattagttcactatatttgcttcggtttatttctggactctctattctattacattggtatatctgtttttatgctagtaccatactgttttgatttccatagttttctaatattgtttgaaatcaaagagtgtgatgcctccagatttatttttatttctcagagttgctttggctatcaagggtctagtttggttccatagaaattttatatatgtttttgtctatttccatgaaaaatgccattggaatttagataggggttgtgttgaatctctatatcactttgagtagtagggacattttaacaatattggttcttccaatccttgcacatgggaaatctttctatttctttgtgtcttcttcagtttctttcatcagggtgttttggttttctgtgcacagatctttcaccttcttgaataaatgtattccttaagtatttcattctttttgatggtatcataaatatgattttttaaaatttctttttttgatacatcattataggtataaagagtgcaactgatttttgtacactgattttttttttgtatcctgcatctttactgaattcactttttctaacaggtttttttctttttaatttttggagggagtcttttgggctttctacatatataatcatcttatctccaaatagggctagtttacttctgatccaatttggatgcattttatttatttttcttatctgattgccatggttagtatttctagtactattttgaataaaattggcaagggtgggcatccttgtcttataccagatcttagaggaaaagctttccatttttcaccattgattatgatgttacctgtgggcatctcataaatggcctttcttatgctgaggaaatttttaatattaatacctaatttgtgaagatattttatcctgaaaggatgttgaactttgtgaaagctttttccacatctattgaaataaccgtgtggtttttaaattattccttttgctaatgtaatgtatcataataattgatttggatttgttaagccatacttgcatcccagggataaatcccacttggtcatgatgtatgatctttttgatatgttactgaattgggttagctactattttattgagaatctttatacctatgatcattagtgatactggcttgtagttttcttttcttcttttttttttttgacagagtctcgctctgtcacccaggctggagtgcagtggcgcaatgtcggctcactgcaagctccacctcctgggttcacgccattctcctgcctcggcctcccaagtagctgggactacaggcgcccgccaccacgcctggctaatttttttgtatttttattagagacggggtttcaccatgttagccaggatggtctcgatctcctgaccttgtgatctgcccacctcggcctcccaaagtgctaggattataggcgtgagccacagcgcctggcccttttcttgtatttctgtctgactttagaatcatttgggagtattccctttagttcttttatttatttatttatttatttatttatttatttatttattgaagagtttaagagggattgctactaattcttatctgggtatttggtagaattcagctgtgaagccatctggtcctatgatcttttgttgttaggagattttaaatgactacttcaatctctttatttgttaatgttcaggctctctatttcttcttgattcaatcttggtaggttttatatttctaggaatatattcatttcctctggtgtttccaagttgttgtcatataattgttcataatagtcccttgtaatccttttcatctctgagacatcttttgtaatatcttcatgttcatttctaattttatttacctatattctttttctctaaaaaccaagtcttagttttgttgatttttttccctaagtttttctgttctctgatttatatctgctttgatcttttatttttttccttctgctatctttgagtttactttgttcttctttttctagttccttgaggtggaatatcagattgtttatttcagattttttttaatgctatcaacgcccctcttagaactttttttgctgcatcccaaaggatttggtatgttgtgctttcaatttcatttgtctcaagatattttttaatttcccttttgattttttctttgacccatttgttattcagggatatgttgtttaatttctactgatttaagaatgttctagttttcttcctgttactgacttgtagttttatatcatcatgaccagaaaagatacttgatatgatgttgatcttcttaaatttgctaagacttattttgtggtatagcatgtggtctattctggacagtattccatgtgtgctttagaagaatttgtgtgatagcctgtctgcgtgggtcagctttggtaacatgtggtagtgagactagaatccctagtttgggaccctagggctgtttgcaggtacatgcatggtagctgtgctgggtcactgggccagagcatccaaggaggtagtacttgcttaagtacctagagaatgcaaaggctcctgtgctgagtccctttgccaaggcacctgtggtaggagtagctcaggcagctctgggcatgggggagggaaagctctggtggatcagggatctggagaatgtgaaagctgttggcctacatcaccccttcccactgggctatagtaaccacagcagcagttgggcagctctgggtggctccaggaagtagagaagaagaagggacatggctcaggcatgttttttgttgttgttgttgttgttgttgttgtttgtttgtttgttttttctcctaaaactcaaaaggaagaaaaaacaacccatggacccttagcagtataagctgcagggcgtctgctgatactatactagcagttggttttctcagcaggaaaagctgaaaaagcttctggggtctgtgactgtgaacactgaagaatcttgagaggtaaaatctacaggaggtacccagtggctatgagggctattgaggtccttgacagagaggcctactggggccctgtgccaaagaggccacggcagatcactgcgactcctgctactttgctgatactgatataaccaatccctattctttgctctctgctgtttccagacatctaggctatatctgtcttttcagagatctgggtgggatgaaactgaagctggtcattagggcagtgtcccataaagctggggaagctggttgtacactcctgtctcctccctgtatgtaggacacaagatccaagatccaagttgctgtttcataatgagcagtaccagctatggggacggggtgatgcaagcaaaatgaaactgtttttcctactcgttttgtgtatttgttttctgactttttctttcactatattgctgtggcttcttaagtggacccctaagcttttccagaattattttttgttcatggatagctaccaaattgttgttgtttgctgaagaaaggaaggcgatatttcctactctgccatcttactgacatcctctcctaaaagttgatttctaagtatttaaaattttttcggctgccattgtaagtggtattttaaaatgtcaatttcctatagtctattactattacacaggaatacggttgatttttgtacattgactttgtgtcctgacacataaccaaattcactaattggttccagtattttttttgtagatttcttaggattttatgcatatacaattatgtcatctctgaaaaaaagagtttaatttcttcttttttcagtctatattctgtctatttccttttttatcttatttcactggccgggatatacagtacggtgttaactagaaatggtgagaacaggcatctttgtcttgttttgatcttaggggcaagcattcaatattttaccaagtaattagcttaacgtttttcatgggtgtcctttattacattgtggtagtgtctttctatttctagtttgctgatgtctttgtcataaatttattttctcaaatgcttattcagcattattgaaacgatcatgtaatttttctcctttaatctgtcaatgtggtaaattacattgggataagtctgtcctgatcatggtatattattctttttatgtgctattttgcttgtttttcaacccttatataacaactctatcttgattttttgttgatcagtttctattgcctattgtttctcttgggttttataaatattttctattctaatgtatcaggttatcttttattaagtacttgtcaatatataataaaaattatagagtttttttaaaactttacttggaattaatttcaaacttatggaaaggttgaaaaataagaaccatacaaaaaatacccagattcccctgttgttaacattttaccattttgtcttatcatttgagtgtgctctccctctctctcctgactctctcctcttcccctctctttatgtacatatttatatgtccatacatacatatacacacactcatacatttttttctcagccattagtgttttaacttgcatacatcttagattccttacctctaaacacttcatcacattgtgtttccttagggacattttatggagataatatcaggctctggattgtgtgattccttcaaacagatatttatttatatttttagcttttccagctactctcagtggcagggtttgcctgcaacaacttagtctgtcattgccagaagtagagtcactgatctcttgctttttgtgatccagtcccagagttttatttccatgctgtgttttactcttattagggccagtgttcccttattacccttcttttacagaatgtccctactattcctatgtactcatttttctataagaaatttacagtcagtttgtcttgttactgaataatttgttttgatatttattattaaattatgaatcaatttaagaataattgactcattatcattttaatatttctgcctaagaatatgatctgtctttccattacttcaagacttcttttggggtccttggtagacttttcctttcctttttttcttttcccacagcaagatggattctggatatactctgagtattgtaacaaccacctggatgcttgcatggagctctccaaactgatgaaggacagccgctaccagcacttctttgaggcctgtcgcctcttgcagcagatgattgacattgctatcgatggtttccttttgactccagtgcagaagatctgcaagtatcccttacagttggctgagctcctaaagtatactgcccaagaccacaggtaagggatcgagggagtcaggagtgaatgagggaacttcctctatctgttggttctcattgagaatacatgtccttttgccctttctgagcttctgttaacttatctgcaaaacaggatgatacattcttgattgcctcatagccaacagggtacagaaggcagagctatcactggctttgttactcacacaaaaggagggtcctttgccactatatttgggttaaaatctgaaatctgcctagggctccagaaccactaaagcatataagatatgatttgttagagaagcagcatcaatccaaaaacgaacccaaagatgtaaaccaaaccaactggcccacacccatggctcatgcatctgggtctgaaagttagccccaaggagaccaagcaatggagctaaatcatacttgtggactgataatattcactaggtaaattatatatggcataattcatcttaaaagttccagaaaaaagtttttaagcatagctcaaagctatgttagtttcttaggccaaaacaacctcagagctttttgggggtttggtgggcaccaaaaagataggacattcgcctgggatttgccatttctgtacactttcaccttgtgactggaactcctgcttcaaagtcctcttgccatctaggtccctgattccctctcctctcaccccttgcgctccagagtgacagtagagtagctcaggcagtgtcaggcgacatcaatttctgccctttctcagagtgacccgttgggcccagcacaactcccacgacatagacaaccccttttggcaggtctcaggaatctgtattaagatgatggctcctgccatgcatgtcaagagtagctcggatttgaaggcaactaaaggctgatgccagcttggaagcttagtaagataggtgttcagataggtagggctgaaatacaggcagtcagaatggcccctgagggagaagattagatgaagaatgataaatagagaagaatactgactttgcttacagatgattgatataattccctaccctaccttccttaagttgatgagaatgaagactgcatgtaagagggaggctagctgacatgtctggaagtagaaaatctttgttctgttgttctccccaataagaggctgggcccagacctcatctgagggctttgaccagggttaggctggaccacagctattcctttcttctcctgccgactgctaaaactagtaggacaggttagagatgggcacattccccctctagccattttgagaaaggcagccagctaaagatggcaaaaataggcagtatgggacactgacagtgaggaatccatgactgagtagtcttggtgtagaggaaatgaacattgtcatgccaggactgcccagtagaactttctgcaacaatgcaaatagtctatatttgtgttattcaatatagtagttacccaccacatgtgactacttgagtactaagaaacatagctagtgcaactgaggaactaaattttaaattttacttaattttgattaaatatggctaatagctaccatgttggacagtacagctctgtgctttacttccaagaaagtggtttagagcactgatctcctcaaatcagagaaaggaaaggtacaggggcagaaaatgggtccaaagagcaggagcacttacttatgttagcagcttctgtgctgcaatcttcccttctgtcaccactctacctccttctaagtgtcaggctcagacatcttgccaaggagaaacttcggtgatgtcacagagcccaaaagatccccatacattggagcaactaactgtaaaagaatgaaatgtaacagaaacaaatgtagagtgtttccattgggtctaagataagaaataaatagctcacggacaggctgagagagatacagcttctagagtgtgttttgaagagacttaggaagtgttagttggccataagctcaatatgggtcagcaatgggatccagaagaaaaactgataatagctaacattcactgaggctcagaataaagacttttctaacatatttgtcttgagacagaatagactggttaggaagtatagtgaaaagcctttcactggaggtgataatgtaacattgtttgagagccatggctctgacaggtgtgcagatcacagattggagtgagggatgtgaactaggaggaggtactacgtaggatctgccctggcaattagaagtccctttcctctgcctttctttggtccatcaacccactattcaatgttgtgggtgtgcagttgtgcagttgtgcaaagatgtgcggttgttgcacatctatttttttctccttccttttttaaaaaatggtactgagagattaagcagactagtgaccacaaggcattttcagtttctctaaagaaaggtgttaacactgaactgtaaggcatcctcttgtcttctcagtttatttttgcccccactgaatggctgagatctcactatcaatctgcctttcccaagagccatttgattgcaaatcagaaaagaacagcagaaaaaaactggataggatatgtaactctcaacacgtctgctatccagagtcccaggatgtggggccaagggttacacgtctgagactaggggttttaagaggcatcccatgtgatggctctactacggaaatgtttgatttgtaataatagtactgctaacatttgttatatgccaagagtaaaatagtttacatggatgattgtatttaatttatgaaaccttcaataaactatacttttccccattttacagatgaggaaattgagtcaatgagagagggagtgaggcttgccaaaggccatactgctagtcagtgagaaaaactggcatttgatcccacaaagtctggcttcagactttatgctcttacccactgtgctacattctgtttctatattgtgcaaaagcaaacgtgaggatatttcagagtgattttgggcagaagctccatagaaatagatgatggaagagatgataaggtggtctatactgtgtcatgtgtgaggctcccttcttggtccttggctggctgtatcagataggacacaaaaaaagtgatgtaacaaaatagtggtccatttgtctctcatgtaaaagaagtatgtattctgaagtttatgactggtatggtggcctcatggtcatcagaaacatgagcaccctacagctatctactatcctatacctagggtattgaccttgtccttatggtccaagatggctaccagaggttcggccatcacatcaacattccaagcatcaggattgagtaaaggctaaagaagcgtatgctctctaccttaaaggtgatttctcagaaggcctacctgatagagcaggagcaccgtcatcttggacaaacactgccacttcaagttccagctccctttctagcctcatgcatttcaaggaaatcacttcttttctaactacaagcagccagaaagagcagacagtaagagagctcaggcacagaaggaggtaggggggaaagtctcttgagtaactgccaaacttcaccctcatacaatgggccccagtaaaacagtgggcgttaataaacacattccttttccttcaggtgcactaagatagagaagatgaaagcagactcaggggatatgcctgcagctgcaaaaagatgtatgggaacagacacacaactctctcttcccagataagcacaacaaagaggcgcaaaagcagtctatgcctctgataaagtctcccaccctgaatccttaaaaactcttagtctgtaagaaagtgtggctctgacctaactcggccagccgctcctctcaggtttatttaaaatcaacctgtccctgttgactgaaaagccatccttcatgtttctctcctctttctttaattcttacactacgcaacacttctatttacatatcagtgtacaaaacttacttgcatagtcatttttgctgaaacaaaagatagaaaatgtagtctttaggtggtgtgggttcccatctgaaaatcaggactctgttactaaggaggtagaggagagtggatgttaagattggcacctagcacattggttctttggcacattggttggttcaacttgcactcttttgttttcacagtgactacaggtatgtggcagctgctttggctgtcatgagaaatgtgactcagcagatcaacgaacgcaagcgacgtttagagaatattgacaagattgctcagtggcaggcttctgtcctagactgggaggtaggaaacttaccaaccagggtattgggaaatctgaatagcttggcaaaagcttcccatcttagctaaggacaggtgaagagaaattacatttgaagagcaacagtaaggatttagattagactcaaggtaaaatttcttgctaatgagaagtgttggatacttgaataactttctaagaagcttggagaaatttttgtgatgatacctcattaagaaatgaaaggttcatttcttcaggtattgccaaggaacaattagggttgattcagtagcctttcaaagctctttctggatttatgaccaacagattcacacttagataagaaatagtatatactaatttacttccagacacagaatacgaggttggttctcctgttcccaaccatgcaggacagccaacatacttttttttttatcggtgataccacctcaccctagcacatctattaggtctctctattaggcctgtacactataggccacaaccatcatccctgccaaatccacagttttcacatctgtttttaaaataatccctgattatttcattgcagacagccatgacttctctgaattctgaaagaccttcccttcctagatgcccaccaaaagtatcaggagtaatgacatttcacatatgtcttgcaggcccaggttgtgcaatctgatagtctgctggctaaaataaccaagataggagaggctggacgtgctactagggagggattagcaatcttaagccttgtggtcacaatatagaggtagggtctgctccctattccactgacctcaactcaagtgtcattttcagtgattaagaggtagtatttctcttaatacttaaagtattttagcccgttccaagggaaccaagcatcatcctcacaaacagctgcttaaccaaggcccagaaaaaagtcactttccttttattctgctacctctgtcctaccttaatgtagattgctgaaaaagaccacaattctgatcagctgacatccttttgggctatatttgaaggataatgttcccatataagtagaacagcactttgatttgcagagaaaggaatttgtctagatgaagagaccctcattctcttaagcagaagccagcactgggccagacttactagaaaattgtgggtccttttttccttgtgttggcattgctttggccatttgcctgattaaaggcagagagctggaccaaatgacttctagcaagcccatcaactctaagacactctaaaattaaggtggattagctggccttattctctctcgttggcagggttttttgtaagagaaggtgcccagcagcagttgtcttcctattccctggagcatctccccaacttcccaatgcctagaagactttctgattcccctgtgtgctctgggacatcagtccttggagcaggagccatggggaaccaaaaatagcatgaaattacctggcctactcagggagcttcagtagcaccaagctcaataacactgagctatgatttaaacactcagcatctcagaaggaatttcctgcatgtatgtctgaatggggccacaaaaacacagttctaacagtgtctgcctcctttattagcctgattgattggtactctaatctcatgtaagcccacacatcccttgtacgctcctgcttggtgaagcctttcttcatctaaattgacatcctacttcattcaggctgctataacaaaataccatagactgggtggcttataaacaacagaaatttatttctcataattgtggaagctgggaagtccaagatcaaggaaccagtagattcagtgcctggtgagggccctcttcatagactgttgtcttctcattgtaacctcacatggcagaaaggatgagagaactctttggggtctcttttatgaatgctattcccatttaattcatgactgcctcattctcatgaccatcatcccccaaggccttacctccaaataccatcacagtagagattatgtttcaacatgtgaattttatggggatacaaacattcagcctatagcaatttgtaagaagaaaaattcttcatggtcttcttgtcagactgaggtcactgtggaacttgccagttccagcgaagttgtcctctaggaagtcttttctctagtaaagcctgatggatatatttcaaaggccaagcctaaagtttctgtcatatttgccatacctgtgttaaagacttctagaatgtcagaatcaccaaggctcttagaggactccccctacaaccctgacgattcttgtgtgtatacacatgcacatatgcacatgtacacatactctcacacacttactctcaaacaccttgcaatgatggtgaaagacagagaagcagagagaggtttatttcctaccaaggccacacagcaagtcagtgacaaagctggaacttgaatctagtcccctgattccttgtgtggtattgttttcagtaaggtaccacatattccttcaaccttctgcctctcacagcccaattgctgttctttgtgatatttcagcgacttgctttttgtatgtagtaaagagtttatatttaaataagacagtgagactaccttggggaggtcatccaaatcccagtcaggtggtgggtgagtgctggggagtctccccaagaaagcaatgagacatggatgctccatggcttgatgatggttaggattggtggcccaatttcacaggttccctggtataggttctttgtgcattccacctgcccaagaagttgtctaggcaaggagagacattctgccagattgccgaggactgctgtgaacagaccgtgcaaatcaagaaaaagatgccatattttgctgtctctgccaccccccttgtctcccagatgtttgaacaaacagagtggctgtcaaaagcatctgcatgataatttcagcttcatttgtcaaatgaaaaagaggagtcataggggaaaccttcagagcttaatctcccttgaagaggaatttggagggtagcatgcaggcaattagtgtctgctcaatagatcagagtgtctggctagagagcaggaagccctgcattatatcaaggcctgacccttctcttagcttattccgtgaacattcttggtctctttgcccaactctggttattatccctgccctctaccattctatagggactagagttcctgaagtaactttccttttaccccaccccccagggctcctgaaaatcaaatggatgagtaaaagtgtcagtcatctctctactaatcaatacattagagcagtatgcgggagcagcagggagaataatctgttcccagggactgcagtttctgggaaatttctatttctaatttccatgatgctgaggtttggttgagctgtcactttgccaccttgcacactcatttaatccacttgaaaacaagggaaaggtaacatatcctggatagcttctttttaatctttttttttttctggagatttgtagcaggaacctaacattgtagctcatatttgggagcttgattgtgtgtggttgtaatttcctctttgtgggatccctctcctcccagcctggttgtgtaatacccaaggacctgttccactttgctatttgatgactgaatccaaagaagttggaggaaacaagaaaacccaacatgatgaaggcagcaaaagcatctacttaaaagctaaagtggcttgatgaggcatactcctgggacaagaagatcaaatgtagggctagatggatttgttactcctctgccttcctgtcagtaggcagcattgaaaataaactagttaaaaagtatggcattccccttgtcctttccctggatctgctcagattacagccccacatcaattggcctataattagaatggggtgaaatcaggcagaatggggtgaattagaattagaatggggtgaggcctcttcgctcgggctctgaccccaaggaaggaaggtagataagctggcaagaaagctttgggtagtttttggtggccactgttcattccacacctattgatttagttgtcaaacagtatttattgagtatttaaatatcaagtactctgtgtcagaccttattctaggttctgcaaagacatcagtgaacatgacaaagtttccactctcattgatttatattccagtagggaaaagaggcaacaaacaaacatatatcatcaggtagatgggcctctgaagaaaaataaagtaggataacaggttagggagtaatgtggatactacctgaggaagtaacagttaagaacagacctgaaggagaggaaggagcaaaccatgtggttttcttggggcacagaattccagacagaggggaaaacaaacacgaagaccctgaaatataggagtgtgtgctaaaggaacaacacggaagccagtgttgttactctacccagagtagagtaagtgagtgagagagtgggagcaaatgaagttagggaggtgactggaggtcagatcctgtcttcataagactgactgttagtttgagtgagatgggagccactggagggtttttgagcaaatacgtgaaattatgagacttatgttttgaacatttcccctcatatgccaggccctatgctgggcaatgaggatattgagatcaatgagatgtggccttgaacatctagtgcggacaaacatattccagcagagggaacagtgtgagcaaaatcctggagggagtgaacagatccaaaggcccacggttggggatttttggaaggagttgtacttttgggggcaagacaaagagatgtgttatataagtggagcagaggaagcaagggtgagatctctaaacaatgagagggctgtctcctttccatgaactcatttgacgctctcaaacagccatgtgaagtgggtcaaacaggaactgttttaatattccccctctacaaatgaggaaacagatggcgagagtttaagctagtttctaactcaagagtgagttggtagcagcattggactcagagcccaggtcttttgagattctcaccttagaaatcttccatggcatctggttgttcccctgggttggtgacagtaggaggagattgggtgggggccatcattctaatgtggtttggtggataagagcataggctttggagggcttctgacctaggttctgcccctttgggcaaattacttccaatttctttgaccctggttttggggtaataacaaaacatcacttactgggttgctatattactaggagacaggataggtatggaaactggggcacacagtaatagtcaagaaaataagtatcacttatgttgagcttatagtgtgatgtgtaccttctaggcactttatatgttttaatttaaataatcctcacaacacccaaatgaagttggtactgttattatccccatgttaatgatgaggcaactgagttatagagagactacgtgtgttgctcaaggttagtcagcttggtgagcatagaggagtattattttaattttttttctaattggtggagttacatgttgcaagtaattaaaatataattgatgctgggcaccgtggctaacatctgtaattccagcactttgggaggctgaggtcggtggatcgcttgaggtcaggagtttgagaccagcctggccaacatagcaaaaaatcatctctactaaaaatataaaaattagctgggcatggtgtcacacacatgcctgtaatgccagctacttgggaggctgagacacaagtatcgcttgaggccaggaggcagagtttgcagtgagccgagatcgtgccactatactgcagcctgggcaacagagggagactctgtctcaaaaaagaaaaaaaaaaatgtagaattgagatgcccctggctggtggagtggatggaccagataatactgggtagccctcctggtcgtatcatccacatttagtaaattgtatatttaaaagtcattctgaccatcttcttatggcattggctctcttttatggctttattggacttcatacatattcaaagtggactgtagcacatcttcctagcctgcatcagggtgggaacctctctcagcttcccatccctccagcaggaaatcgctgtactgctccctaacctggtggctttctttcccagtatcaggcctccagaggttctgtgctagtatgtcagcccctctagaaggagtgtttacctagttcctggataatattgaggctaagtcgggagcctaaagttgaagcagtatttctaagctttttttcggcagtggggtggggggttctattattagaaaataattctactgagttccccctttccttcccatcctttagactggggaaaaaaatggtatgctcgaatacaccatttctagatgccccactctctggcctactaccctgcctgatttgtgtttgcctctgattatttctgggaggtataaaggtctccatctctaaccttgccttgaagcttttgggtgaaaggctgagatcttagcatcaaggtatcagccctatcatgaagatcatcctcatactacatctgggaaaactgacacctagagagagaggaaggaacgggttctccaatgcctttttggcctaaagacagtataatatagtacaaggagtgagcatattctatggagccccagaggttggagttgggtcatggacctgtagctaactagttgggcaactttggcttatcacttgatctttttgtacctctaactgtaaaatgggagcaagaatatctacttcccagggctatcgcgagtctcagataagatagattgaaaatatctggcgcactgtctgactcatataggtgctcaggaaatattaattcttctgtgtcttgggacactactctttgtccctatcttcacataggccctggaatactcacccctgtgcccacaacttcggtgttggtttgccttgtgtttcatgagttttgagcatacctgcattcgtctcctccatgaagacataagctccttgaggacaggggccaggtctaccttgacatctgacacacacctgcaacatacttctgacctatcagagttgccataaagaaggagtaggacttggaaactctgtagaattgaattagctaggacttaggtgtcttggtgcctatttgtgtcagactctttgtagcaaggaggataagtagttctaggctttctggataacagaccaaggaatcatgtggcagttaagtttcttattcaatcagtagattttagtgaactgagaggagaaggaaaaacaattataagaggggagtgggttctttttctctccctctgttatcatcttccttcttgtcctcccgtttccttctactcatgtgggaggcagtgagattaaggcctgttcttcaagtattagaaagagactgagggaccagagcagggattgagagactgggacagaaaaagagatttatagagaagagagatggagaaatatatatatgtgtgtgtgtgtgtgtgtgtgtgtgtgtgtgtgtatgtatatatatatgtgtgtatgtgtgtgtgtgtgtatatatatatatataaagaaaatctctctctctctctttctccacacacatatatatgtgtgtatgtagagagagagagagagagagagaggcagacacagagagagacagacagacagagaacttataggaccagagggtaactggtgtagaaaagctgtagcagtcccgggtggcagggcacatttggccttggggtgaataagaaaatgggtcttcctagctcacagagctgtaaagctttttgaggagtcccaggagtccctctctccctctgtctctaccaggccctttctggcctcttcctatcccagtctatgcccagccttgggtgcctccaggcaggtgatggtgccatccttctgcctggctgcctctcatcatcacatgtccttcccagggcgaggacatcctagacaggagctcggagctgatctacactggggagatggcctggatctaccagccctacggccgcaaccagcagcgggtcttcttcctgtttgaccaccagatggtcctctgcaagaaggtaaccctgcccccttcttccctgagggagatgggtacctaacagggtaccggaccctcctcttcatcatccccaggctcccaacaaagtgggcaaatactgatggggggaaaacagacaggagattggcagcaattctgtatcaggaacactaatgtggcatgaatgtcacaggcagggttggcttgtgggcagtgaaaaactctgaagtcggtgcattttgtcttggtattttttttaccctttgccctaatgaccctggggtgctccttctcactttcttctacccagagctgctggtctgcaccatttgtaaaaaatattgaaatatgtctatcttagttggtaaatagtagtttccctgagcactttccctcatttccactctaatggctctggccatgtggcccctctctgccctgggaaccaacgaggagcctcctacttttgccctgacaggtaggtacctttgtgatataggaattttttccatgcctctacctatttcctatacaaggtgcactggttccccacaacccccaaccgtgctcttctccactcttccttctttgtaatccattagaggagaggtcttactcttgtcactgactctggataactctgtgtatgttggtttctaggactcttctcctttgtgaggctgggaagggtagcatatgttctaagcgtcactcctccttatgggatactcttacccctacttcctcactcacagtagagagttcagaccagttttggctccaggggctaactgggaagaattggggaccaaggaaagtaaaaatggaagaagaaaccagaatgcttagagtgactttacaaattcaccatgctaccctttgctcttttgccatcatctagtccctttgtcctctccttcacccagtagtgaatgcctctgaagaggagtgctgagtcacaaaacaccagagtaaatagtgttacatttttctgggctggaacatgaaccacacagttttaagccccctgtcctctgtgtgtgtatgtgtgtgccatatcttgtattgaatctttatccatttgctttgacagtggattgaggggaaaaacactgagcttaggttcagactgcctcagtgtttggtgataagctctgaatgtccactctagaaccaatagccagtcagttaatggggataataacttacctcagtatggagctaaccctcaaacagagaacttttatgaatctgaaactcagccaaacactaatgcttctttttagctcccccaactcttctcaggactttcataaaatcaggaggtaggatttttgagggttaatttaggtggccatggaaattctcagcatatcagccatgtcaccaacactaatgtgcctgttcttcccactaaggtgtttacactcagaacaagtagccatagaggcagtaaacaaataggaacctggcttattttatagttctgcaccccctaggccctgttaattttggcatctgttagccaaggctgggattactttaactaaattgtgaaactaggctctagaaagcagtggctataagagatagaccaggatccagaacataaaacagtgagtcagaagccaggaataaaggggaagaaacaagataaacaatgggtttaacttagaactcaacgggcagtggaagaccaagatggagtaatgagccatgtctaagccagatagtgggagccaatgattaggaagaaactagaagtcaagccagggctggggattcaaaccagctaagctggcagggtaggggaagcatataacagggatggtgaaaacaagagaaacctcgaagcagtcatagcttcccacagaagggagctttcttgttttcacaagaaccataggctttcttcccaagacacagccagcctagagtctggagtataaaggctaccaactccatatacctgggtgttcttgacactggcttcccagaacacgagcagttatagcctaattgttcaaaggccattaaaactacctgatgtttgttttgaagatttccatttgttatctacaataagactttccattcaacaagtagggataaacttttgaaaaatgatcatgggaccaaaagaaggtatgcagagagacaaggtattttgtctgctgggttgtttagggaccttttgccattactacaaaagactctcttcttgagatagagctgggaggaatggactaggctctctggaggtgaaaattcctttgacaaagagaatccatggaggaaaggaagggaatgtctggattgggccaaggtgagtgaggctgtcaccttgttcacctcaggcacacaatttaattggatgtccgaaagttcagtaatcctttttaccaggaagaaaggaggtgaggatgctaaataatgaaatatggccacattaagctttctgatgatctcatatttaaaaaggaggaaacaaagacccctaggaagtggctaaataatatataatattttacatatgatataatatttaacaggggtgacaaaagagtttcatgaatcctagaatgagtcaaaattagtttttaaaaatgcttaattttaattacttttaaagctatgttcaaatgaagaaaaaagaagtgatagtctgacaaccccctgtttgaggcagatggtttactgataacaggggaatataaattccttctctatcaaggaaaagaagtcataaacttgtttcaaagggaattgaagcccaaaggatctgaggttgtaagagagtactttactgctctgaattctttcatgctatagatattgagcccctcttctgtgccaaccagctctactttcataaggattctagtctaacagaacttaagtatgatgttatttaaaaatatatacatcccagagcactgaaataattctatgatgtcccaagtggaattgctctaggtcatcttgacagaattatgggttccaggagatctgtgagaagactacacataggaaaatgtaccagttttcaaagcagaaaataatatgttctagaaagtagaaatcaacaataaagtattaatgaactagcatttattgagtgcttctatgattctgttctaagaactttacacttattaactcaatttaatcctcacaacaaacctatgaggtaggtactattattatattatttccatgttaaggatatgtaaagtgagacctagataagttatataattttcccaaggtgaaatagctaatgagtgatagagccaggaattacattcagatacgctggctccagattccacattggtaatatttatgtcattattaccattgagcttgtcaaaattctgtacttgattattaaacagcctgtgaacatttagaaagagatacagtggccacaggggtcatctttggctttctgagaacaagtcatatcctataaaactcagtttctattttgccagtaacttaattagttaataggaggattgcacaggacagagagtgtcctcctgcatttcagattttcccatggtttccttgcagacagaagtcatatggagtgatagataaaacataaagtttgtaatcagacaattctgggctcaaatcctgatttcaacactcgctaactatatgatttcaagcaagtgactttttccttcttgtacctccattatatcagttgtgaatggtgagaataactattctacaggattgtcatgaagattaaatggaatcaatgcatataaaatgcctgatagagtgcctggtactcattaatctcatcttacccaacctccaacaaagaaatagacagccttataaagtagtgaggtccccatcactagatgtacccaaatatgggctagattattatgtgccaaagatagtatagtaaacattgaaacactgatctctctccatgagcatgtggcctcaccactaagttctcatccaactgttaagattcccttaattcccagtcaattatgcaacaatgtgcctgttttgtacattgggaattgggattgactaatccactcagaacagcttaaacaacttatgcagcttgtagcttgtttcagagagagagagagagagagagagagaaaaggagagcaagagagtacgtgggcatgtgtgaaggtacctttaaaatggcaattatagtgtgtgggaaagtcaccagtggcttctaattatgtgaccccttctttaatttttgctgtcaccactcttttaacttttcttccaaaaaatccagataagactctgttctttttcttcgtattatctatactgtcagtctctgctcctctgtgtttcattgaatttttattttagtttttgatgtgttttattattttcttcgtgatataattatttgggaaattattttgatgctttgaggggatttttttctctttgactatttactgtggaaaggagcagatccgcttttcctgcaccctctgtcctattgtgccagtctggccatgttctgttgtcccttgtgtcataactgttctttattcctgttgctttcaccatattcaaggggatcagaactaaacaacgtgtaatgatgttgggcagaagacttctgttcagggaagtttctgcatttggacaatttcttcttgcactgaagggtcagacttggaggatgagctatttgggacagcttataaatccaataatagcaacagagatggggctggagcagaaagaagaaggggatttgaaaccagaactcctgagtacttaactttactctgtctcttaactaacttttctaaccattggccagttctttaactttgtccttattttcctcagtgtcaaatcaggctgatgatagaagtcatctcaagaggctttgggagagaaccacctgaggtagtggggaacagtggagtatggggttaagagcatgggtgctagggccagactagaaggcaatctcctttcgcccatgagctatatgaccttgggcaaactttctgtgcttataattatgcccttgtttgcaaaatgagaatgacagtgtatctacaaggaagggaagttgtgagggttaaatgagacaatgcagatgtagtacctggcacatagtaggtacttagtgaatgttggctattaatactattactatatatgcagtgttactaataattcattcagtacttttttatttagaggcaatatagcacattgtaaacaaaagcagagattttagagctggacagcctgaacccaaagccaagctctgccatttagtagcttttattcctggaaaaatttctgttttttcttccaatttttattttagctttagggggtgcatattcaaatttgttacgtaggtaaattgcatgttgccgggttttggtacacaaatgatttcatcacgcaggtaatgaacatagtaccaataggtggttttttattcccaccctcctcccaccttccaccctcaagtaaaccccagtgtctgttgtttccttctttgtgtccctgtgtactcaatatttagctccctcttgtaagcgagaacatgcggtatttggttttctgttcctgtgttaatttgcttaggataatggcctccagttccatccatgttgttgcaaaaggcatgatttcatttattttgatggctttgtggcattttatggtgtatatgtaccacattttctttatccagtctatcattgatcatcatttaggctgactccgtgtatttgctactgtgaaaagtgctgcagtgaacatacgcgtgcatgtgtctttgtggtagaacgatttatattcctttgggtacatacccgataatgggattgctgggtcaaaaggtagttcttttttaagttatttaagaaatatccaaactgctttctatcatggctgtactaatttacattcccaccagcagtgtataagcattctattcctgagaaagcttcttagctgctctatgtctatagttcctcatcagatggggttataacagtacctacattggaggattatttaggttaataaatgcagagcatttaggacagtacatggtacataatatatgctatttaaggggtcactgttgctattattgttgttcttattattttgatgtaattattaagcatgcattctaggatgctggaatatagtagtgagcgaaataaatccagtccaaaccccatgtaccttccctaggatctggagagaaaaggctagagaagagtaactagggtcccctctataaaggggcagggaggaccttatttacaaacaagtgaagcaggctacaatcctgaacagttacattccccagattgcagcatctgtcatttgtagagaatatcctgcaatgtcttactaaggaggaactagctcccttaatgtctcccaattcagacgagcacaaggaaaaaggaggaaggctggcattttattggaaatgataaacttcattaggcaggaaagttgtgatgatccaaatagcatctgttttgagcacctgctcaccgtgtccctgtgaaggcactcagactaccattaacaagtggcatatgggcagcctggttccaacaagaccacaggcaaccagggttcaagaggactttgtccccttgccatgtgcagaggacaaccagaggaaactctggggctttgtcagctgctcttctctggacaatccctaagtgaagcaagaccaaagaagatagagtgctgggcacagcctttaatgggcaggcaaactaaaagctgtgagcagcatggtggctaagtgccaagtgtgtggtatgtcagggccttcacaattggtgtcagaatttggagaaggggagccacatcagcttgagcagtcagagaaagtttatttcaggaataagaatgtgtaagtttgacctcgaaggctaagattggaataggaagcatagttgggccagagagcagctattagtgtgaccccaaatatatatctgttattttggtgacaaataccaccctgtcctgaaaggatgtatagaatttccagggacagtggggcagctatgtaaattgaaaaaatattcagagttacccttgctttgacttatttttactcacaatatttaaattatttggaaagtttaaatgagctaaaggaggtagtgagatgtttttcctttaagtttatcaaaagagggttttaaggactatgaaacactggcccaggagcaagaaagctcagggctgtatttggtggacaagtctggcctcatgtcctggaaatgacatgtttatattagagctttatagctattttacagagtaaggataactgtcttcatttcttagttgaggaaattggggctcagagaggttaactggcttgtccgtaaccatacagctggtaggttaggcagcaaggcatcaaactcagggcttcagactctacatcatgctctttcttttgttccatgctgcttactgcttatagtcttagctactctttctgattggagttcctcaactagtaggtcattcttaattattcctatcacatctttacatttggcttatgacaaatctagcgcctgaaaactcacatttaaccctctgggggaccagggagaacaggcaaagggataattttagtaacacatctctctagccctgtttccccaccacagaagcagaaattctctctagcttcttgtcatccttacatatctaaagaaacaataggagattcaattgatgcttttaatgtagctccaagatcatgcatattctttctatttttgggaactagcaaatgtgttgaaagctctcaatgactatgacacaccaactcggaatgggggcggagcggaaggaggctgcggactgaagttagcaacaaggaagttgaggctgcctgttttaggcaatgtggtccggtgagaatgtgtggttcagatctggctttccaggtttgtatgtattatattatgtatggtaaggcacaattcaaacctttctgagatcgagataaattacattcatacattctgcctagcttatcctgcttttgtacttagattagcctgatagggcccactttttatacatgtgtctcaaaaagtgttcctgagaattgtggaactcagtgtatgggaatcactctatccttttggccaggattgagcttgtgcacactgaacatggtaaaaggaacccaggttctgaaataggcttggggcaacattggccctctctgtatagctgaactcttcctctcctgtgaacttgatcctggggacaaccaatagatcagaatccatctatattcttttcttatttatatgaacaatcattatgggaggaaaaaagtaacatgattgttattttttcaaaagcaattcaacgacatctgtattttccagcctgggcctttgaggttgacagagctatgctgggaaaccttgctatgctgggaatcctgcaaggtagcctttcccagcccaactgaaaatctcagtataccgcacaatgtgaagagttaggattgggaatgtgagtgggcaaaagaagatccttcatagggagcacacagctgagaagtgagtcaagttaggcaattcagtagaatggaaatggtttaattgaactgtaaaatgctaataaaaattaatgagcatttctgactctgtccagctgactgaaagagcagataaagcagagaggagggagagctggcccgaagatatctgtcaggacaggactcataggggccttcctcaacctgactcagccataccacatctcccagcagtggatgtgttctcagaggaggctgagggcagcgccaagaggaggaggggctgaaaggccactccaagatatttataagatctgacattccataggcctatatgtcatttcttccatccctctattttcctttttaacttatgaaatatttgacattcaaaaagatataaaaataatataatgagtacccacgtgtttactatccgcattaagaaataattcattacaaatagttttccttcccaccctctcttctgcttctttttcttccccttcctctcttgcccctccccgttttctgctctgtactgtctggaacgtggcatatatcattgtcacttatttctttataattttctacatacatatgtatctttaaacattatgtggcatttttttgtatgtttttcaaggtaacagatacagatgaggtaaaactatatagaaaggaaaccatggaaatgatgaacataggatttaggatggaggatgccttggagttgtaactttgggattggtggcagattcaccagtactttatattattaaaataagtaagtaaatgaataaatagagaaataaaaatgccatgcatggaccaattatgagtgtctcatggactagggttaggattaatccaattttgtgtctatgagagcaaaacaacaataacaaataggcgacatactgtttgtatccatctacaacttctgtttttctccataagatttgtgacattcatctgtgttgatatgtgaacttctttatttaattttacctccatttctcttggcagactgggccttttctaaaaatccccagagtgctaagtgttagaccccccctaggtaatcctttgccagcagtctgtggcctcctagctactcttactactcagtccccctctgatgttcaggtctcactggcctgcacagatatttgaacacactccaggcaaccagccagctcatttcatacctctagtgggcttgctgatgttttcgaaaaggagaagcccttgctagccgtgtttatgtggcttactgtttcctacctcccatcagcagacttgcacacacgtccaaggattgattctggtgtctgaaatgatctttcgaggtgagacagaggctttttctttgggcatctagttaaccaacctgtcagtgtcagactactagtataacctggccaaatttagaacaaaccaacccccattggtacttcaaaacggtgacagtgttagcattctgctgtgcccctgtgccaactcttctagtactcgccgtgcacataccttcaagaaacctcttccttcccatctaggacctaatccggagagacatcctgtactacaaaggccgcattgacatggataaatatgaggtagttgacattgaggatggcagagatgatgacttcaatgtcagcatgaagaatgcctttaagcttcacaacaaggagactgaggagatacatctgttctttgccaagaagctggaggaaaaaatacgctggctcagggctttcagagaagagaggaaaatggtacaggaagatgaaaaaattggtaagtgacctgagagtagaaagaagaacatggctatgaagaacataggaggtttgaattggtttccattttcttggagtcagagggaagatttctgttgcaaactgacttaagctactttggtggttccttattattaggttctttttggtaagtaccaatagcttccattagtcagtggtaggtttgaactataggttgtcctcccctactagctaagaatatcacactgaaagccagcctcaggcttgattctcccaaacatacatttattagcaaataaacaaaaatcagttatacaacctgttctgtaatcttcataaagcctgagctctctgtcattaggtatatagtttgtactcctgattaggatacttcagatgttaactaaatccccctagactgtagattcaaataatatgcacatacacttcacactttctgtgtggaagtatttaaagtaaattatagaaaatataacaggacttaaaaccatgaccattttcatgatttcaaatcacactgaaacatacttttttgccttacaataagttgtttctcttttccagtggggatatagatagtagagatatttttcatgttgcttcccaactgtgggatttagacgccattggctatagctttgtgacttataaagtactgtctggtctcttgctcatggtcctgcctttctgtcataaaaaataccaagcaaccagacttgttaattccctgagaagacatacagtttctgtctttgccctattgcttatgggagtgaaattgtactttagaaggcctgaaagctcaagtttatggaaattgtctctagaaaaatgggcctactcattgaatcctggtgcaaaagggttctcttatccttccatgtgggcgattgaaattatccagaggtaagaaaggatggtcagaaagacaaatctaactccagtcttctcctcagaacttgggtagagtgcaaattaataactcactttgagtctcattggaatcagactgctttcagtatgtggacactccattgggacatgatgtggagtggcatataaatgttgctggctacttctctcaatagcaagcagcagcagccactgaccttgcctaggctgttagagttattaaaggaatggtcttagtgttcagaccctgaatcaattagaaggcccctgccattcccattggctctaacacaatgtctcccacacaatgccctaataaacctgtgactttatctgcttctaatagaaaagcttctagaaattactttctgaacaggcatatgttcatctttaaaaatgttgaggttttttttttttggtttgataataacagtaaatcacttccattgtaggaaatttagggaaaaagcaacagaaaagtacaagaaaaaaaaaaaacacatgaacatactcagtaataactttcataaacattttgatatatatttccagccttttttatgtgtctaattagaaaaatcaaggtgactgaatcttttttctttctctccccatacctgcctctctatagtggatagatataattttgtatcctcattttcactcatcattatatcattagcatttctatcagatcacttcatatttttaatcattattttatgagggtcatatagttttatcatagcttttttaaacttttactttttaattataaaattaatgcatgaccattataaccatttaaacaaatatggaaatatataaagaaaacttagcattccttccccttctctgtcacttccatactgaatgaaataaccagtgttaacagtgcagtatgcatctttccatacttatctcatgtccatataaacatatacaaacataatacttttatatttacaaaaattatattatatatattaccttgtaggttgcttttttaaacttaatttatcataagtaactccccagataaataatatagaatctaactataaccccttgtatcagttagggttcaaccaaagaggcataacctgtaggagatatatcataccactgctgaaaattgcattacaaggaattggcttatgtgattgtgaatgttgactaagtggctcagaattccatagagcaggcagtcagaaatggaggatcacaggcaggctcaaacccatggacataggccaaagctgtcatctacaggcagtcaggaagagaagctcatgagaaggatgaagtggcacagacatgggctaaagctgtggtgcacaggtagaatttctgccctttctgtgtgagacctaggctctacttttaaggtcttgcaacagattcagtcaggtccatccagattatctaggatattgtcccttatataaagtcaactgattagggcctgtattagcccatgttcacagtgctataaatacctgagactgggtaatttatgaagaaaagaggtttaattgactcacagttctgcaggcttaacaggaagcatcactgggaggcctcaggaaatttagaatcatagtagaaggcaaaggggaagcaagcatcttcttcacatagtggcaggagagagagagagcaagagggaagtgccacatacttttaaaccatcagatctcgtgagaactcacccactatcatgagaacagcatgggagaaattccccccatgatccaatcacctcccactaggcccctcccccaacacatggggattaccattccacatgagatttgggtggggacacagagccaaaccgtatcaggggctttgattatatctgtaaaataccttcatggcaacacctacattagtgaggactacagtctagtcgaatgggcacatcaataaattcatcacacttttcttataaacagctgtataacattccataatattatgtaataaccacagtcatctcttggtatgcacgggatattggttccaggactcccgtgcatatcaaaatccatggatgctcaaatcccttatataaaatgatatagtatttacatataacctatgtacatcctccatatactttcaatcatttctagattatttataatacctaacacaatgtaaatgctatgtaaataattgttatactgtattgtttagggaataaaaacaaggcaaaaatccatatgtgttcagtaaagaagcaaccagccgcttttttctgcatatttttgatccacagttgattgaatccagatgtggaacccatggttacagagggctgactgttcgttttttgctagacattcattttatatttagctttatttcccactacagatattgctgcaataaatatccatgtacgtatctgattgttacttactgatgcttttattcctgtaggatctgtaccctaaagtggaatgactgaatgttaggatgtgaacagttttaatacatacttgcatattaaattctgaaagatttgtagaatctatactcctagcataattttatgagtacccacttccgcatagcctcaccagcactggatagtatctatttgtttcagtttgccatttctcaactagtaaattgaaaaaaagtgttggaaccttttttttttcatatgcttaatggctattttcatttcttttgtgaattgcctcataccctttactcattcttttaacataaatttggaaggactctatattgttgatgtgacactttgtcagtcacgaatttcacgttttcaccagtctgttttttgtcttttgagtttgtttatattgcctacttctataaatatttaaatttttactttgaaaaatgtatctattattccttttttggcccctagtttcatcttgcttaagatctcttgccatccaaactataaaatttcctgattaaaaatatatttttggtttatttttagaacagtaatccatccggaatttacatttttatatgatgtgagaaaggggacctcatttttttcttcaaggtggatagtcagttgcatctgcatcatttattaaataaatcatttattttccacacagtttaaatgccatttttcatatatagtaactctgcatatatacttagatgtgtttttaaactttctattctgttccactcttctgtttgtcatttcttgtatcaagactatgctgtttcaattacagtagattttgagaaagatttaatgcctggtacaatcaattcttattcactcttatcattgcttcttagcagttcttagatgtttattctttgatatgaatatcaaatttatttattctaggtttaaaaacactgccgtaaaaactggcatagaaagcccatttggattctgattggcattatattaaattttttaatatgtaacggcttggcattgttattaagttttcacatttaagacaaggctctgctctcctttcatcaaaatcttgttctgtatgcttcaggaaaatggtagagttttctttagattctgtacatttctgcctctttgtacattacttttgataatttctatttttctgggaaattgttcatttcctctggatttttaatttaatgctatatatctacacataatattttctaattatcatatcttccataattgtagttatctctcttcttttgggttcataatatttcatatatttttattttctcactttaatcttttaatcaggcttatcagggagtattgatcttttttatgtatatataatcattatacatatttttaaggtacatgtgatattttgatacctgtatacaatgtgtaatgatcaaatcagggtaattgcgatattcatcacctcaaatgctcatcttttctttgtgttgggaacattccaaatattttttttagctattttgagatatacaataaattattattaactctaatttccctactgtcctatcacaaactaaatcttattccttctaactgtgtttttgtacctattaaccagcccctctccattgacctgagcctttctttctgagccactgataatcaccattctactctctatctttatgaaatccacctttcagctcccatgtatgagggaaaataatcttatttcacttaacataatatcctccagttccatccatgtttctgcagatgacaggatttcatttttttatggctgaataatataacatcgtgtatatatgccacatttcctttatacattaatccactgatgggcatttaggttgatttcatattttggttattgtgaataatgctgtgataaacatgagagcatagatatttcctcggtatattgatatcctttcttttggatacatacccagcagtggcattgctggattatatagtagttctatttttaatttttttaggaacttttctactgtttttctataatggctgtactaatttacatttggtcgtttcaaagaacgtgtttttggtttgtttatcccttctgcagtttatttctgtttcttcttaattttcacttttatttccttctttttcctactttcaggatttaaggaatattttagatcctttccactctttcattgactgaatacttactttgtttattttgatttttacaaaatcagaaaatcattttagacatgggagggtgtatgtgtcgaggaatttgtccatttcttctagattttctagtttatttgcgtagaggtgtttatagtattctctgatggtagtttgtatttctgtgggatcagtggtgatatcccctttatcattttttattgtgtctatttgattcttctctcttttcttctttattagtcttgctagtggtctatcaattttgttgttcttttcaaaaaaccagctcctggattcattgattttttgaagggttttttgtgtctctatttccttcagttctgctctgatcttagttatttcttgcattctgctaccttttgaatgtatttgctcttgcttctctagttcttttaattgtgatgttagggtgtcaatttaagatctttcctgctttctcttgtgggcatttagtgctataaatttccctctacacactgctttgaatgtgtcccagagattctggtatgttgtgtctttgttctcattggtttcaaagaacatctttatttctgccttcatttcgttatgtacccagtagtcattcaggagcaggttgttcagtttccatgtagttgagcggttttgagtgagtttcttaatcctgagttctagtttgatttcactgtggtctgagagacagtttgttataatttctgttcttttacatttgctgaggagtgctttactatgtggtcaattttggaataggtgtggtgctgagaagaatgtatattctgttgatttggggtggagagttctgtagatgtctattaggtctgcttggtgcagagctgagttcaattcctggatatccttgttaactttttgtctcgttgatctgtctaatgttgacagtggggtgttaaagtctcccattattattgtgtgggagtctaagtctctttgtagatctctaaggacttgttttatgaatctgggtactcctgtattgggtgcatatatatttaggagagttagctcttcttgttgaattgatgcccttaccattatgtaatggccttctttgtctcttttgatctttgttggtttaaagtctgttttaaccaagactaggattgcaacccctgcctttttttgttttccatttgcttggtagatcttcctccatccctttattttgagcctatgtgtgtctctgcatgtgagatgggtttcctgaatacagcacactgatgggtcttgactctttatccaatgtgccagtctgtgtcttttagttggagcatttagccaatttacatttaaggttagtattgttatgtgtgaatctgatcctgtcattatgatcttagctggttattttgctcgttagttgatgcagtttcttcctagcctcgatggtctttacaatttggcgtgcttttgcagtggctggtacaggttgttcctttctgtgtttagtgcttccttcaggagctcttttagggcaggcctgctggtgacaaaatctctcagcatttgcttgtctgtaaaggattttatttctccttcacttatgaagcttagtttggctggatatgaaattctgggttgaaaattattttctttaagaatgttcaatattgacccccactctcttctggcttgtagagtttctgccgagagatccgctgttagtctgatgggcttccttttgtgggtgacccgacctttctctctggttgcccttaacattttttccttcatttcaactttggtgaatctgacaattatgtgtcttggagttgctcttttcgaggaatatctttgtggtgttctctgtatttcctgaatttgaatgttgacctgccttgctagattggggaagttctcctggatactatcctgcagagtgttttccaacttggttccgttctccctgtcactttcaggtacaccaatcagacatagatttggtcttttcacatagtcccatatttcttggaggctttgttcgtttacaggctctaaaattgaggcaataattaatagcctactaaccaaaaaaagtccaggaccagacggattcacagccaaattctaccagaggtacaaggaggagctggtaccattccttctgaaactattccaatcaatagaaaaagagggaatcctccctaactcattttatgaggcaagcatcatcctgataccaaagcctggcagagacaccacaaaaaaagagaattttagaccaatatccctgatgaacattgatgcaaaaatcctcaataaaatactggcaaaccgaatccagcagcacatcaaaaagcttatccaccatgatcaagtgggcttcatccctgggttgcaaggctggttcaacatatgcaaatcaataaatgtaatccagcatataaacagaaccaatgacaaaaaccacatgattatctcaatagatgcagaaaaggcctttgacaaaattcaacaacccttcatgctaaaaactctcaataaattacatactgatgggacgtatttcaaaataataagagctgtctatgacaaacccacagccgatatcataccgaatgggcaaaaactggaagcattccctttgaaaactggcacaagacagggatgccctctgtcaccattcctattcaacatagtgttggaagttctggccagggcaatcaggcaggggaaggaaataaagggtattcaattaggaaaagaggaagtcaaattgtccctgtttgcagatgacatgattatatatctagaaaaccccatcgtctcaggccaaaatctccttaaactgataagcaacttcagcaaagtctcaggatacaaaatcaatgtgcaaaaatcacaagcattcttatacaccaataatagacaaacagagagccaaatcatgagtgaactcccattcacaattgcttcaaagagaataaaatacctaggaatccaacttacaagggacgtgaaggaactcttcaaggacaactacaaaccactgctcaatgaaataaaagaggatacaaacaagtggaagaacattccatgctcatgggtaggaagaatcaatattgtgaaaatggccatactgcccaaggtaatttatagattcaatgccatccccatcaagctaccaatgactttcttcacataattggaaaaaactactttaaagttcatatggaaccaaaaaagagcccgcattgccaagtcaatcctaagccaaaagaacaaagctggagctatcacgctacctgacttcaaactatactacaaggctacagtaaccaaaacagcatgatagtggtaccaaaacagagatataaaccaatggaacagaacagagccctcagaaataatgatgcatatctacaaccatctgatctttgacaaacctgagaaaaacaagcaatggggaaacaattccctatttaataaatggtgctgggaaaactggctagccatatggagaaagctgaaactggatcccttccttacaccttatacaaaaattaattcaagatggattaaagacttaaatgttagacctaaaaccataaaaaccccagaagaaaacctaggcagtatcattcgggacatacgcatgggcaaggacttcatgtctaaaacactaaaagcaatggcaacaaaagccaaaattgacaaatgagatctaatgaaactaaagagcttctgcacagcaaaagaaactaccatcagagtgaacaggcaacctacagaatgggagaaaatttttgcaatctactcatctgacaaaggcctaatatccagaatctacaatgaactcaaacaaatttacaagaaaaaaacaaacaaccccatcaacaagtgggtgaaggatatgaacagacacttctcaaaagaagacatttatgcagccaaaagacacatgaaaaaatgctcatcatcactggccatcagagaaatgcagatcaaaacgacaatgaggtaccatctcactccagttggaatggcgatcattaaaaagtcaggaaacaacaggtggtggagaggatgtggagaaataggaacacttttacactgttggtgggactgtaaactagttcaaccattgtggaagtcagtgtggtgattcctcagggatctagaactagaaatcccatttgacccagccatcccattactgggtatatacccaaagggttataaatcatgctactataaagacacatgcacacgtatgtttattgcggcactattcacaatagcaaagacttggaaccaacccaaatgtccaacaatgatagactggattaagaaaatgtggcacatatgcaccatggaatactatgcagccataagaaacgatgagttcatgtcctttgtaggaacatggatgaagctggaaaccatcattctcagcaaactatctcaaggacaaaaaaccaaacgccgcacgttctcgctcataggtaggaattgaacaatgagaacacatggacacaggaaggggaacatcacacactggggcctgttgtggggttgggggaatggagagggaaagcattaggagatatacctaatgttaaatgacgagttaatgggtgcagcacaccaacatggcacatgtatacatatgtaacaaacctgtacattgtgcacatgtgccctaaaacttaaagtatattaaaaaaagtgaaaaaaaaatcattttagagtatattttcctttgaataaagtctcaactgtatctcagaggttttaatataaaatttcctttttatttatttttagatattttataacttcagttatggtttccttttgatccagggtttattcagaagactattacactgggtacagtggctcattcctgtaatcctagcattttgggaggctgaggtgggaggatcgtttgagcccaggaattcaacaccagcctggtaaacacagggagacctcgtgtctacaaaaaataacaattaaaaaacaattagccaggtgtggtggcatgagcctgtggccccagatactcaggaggctaaggttggaggattgcttaagcttgagagatcaaggctgcagtgagccatgatcatgatcatgccactacactccagcctgagtgacaaagcaaaaccttgcctccaaaaaaaaaaaaaataataataataatagaaggcgattccttccaatatttcagattaggattctagtaatattatgatgtctgttttttgttaagtgagctgtcctttctgttgtgaagcttgtcagattttttttttatcctgaagtttgggaattatactagtcaatatgtagatgtgcatctatgtatgctcatcctgcctgggacttagcaagaccttttattctttccacagtaagtatatcctttttttccccttaaccgagtgttttgttacttatttgttactattttccatttgattttttcctccttcttaaacttttataatctatatatacatttgctgtttgaattatcttttgcctcattatgtccttttctttataattttgcttttggttacaaaatattttttccctatgtcatgctttatttaacgattctccattaacagactcttagcccatgttcataattctttttttggctctctattctgtgttgtgcattttgtagctaagtttttgttcaagtttgtgacaaatttccttagtgaaattcctagaaattactgggttaaagggaatgattttttttttttttgtatttcaagattttttatatgtcttagcaaatctttcttacagaaaagtttactcatttatacactcagtaagggtgtgtgtttctcatttaaaaaatcatatatttttcttttttaggctttgaaatttctgaaaaccagaagaggcaggctgcaatgactgtgagaaaagtccctaagcaaaaaggtaaagctgccccactcagtctctgtgaaagactatggaatcataagctatatgcttacatattcttaggcccatttctgtgctgaggtttacttgggggtggtggaggagtatccaggtccctaggtgtccttgatgacaggtagcaaatggttttaaatgcttaaggctaaggagtgaatagtatagggtattggtatccaaagatagctcattgagtatagcaaaaaatataacctctgttcctcttttttttttttttacttaaaaataagggaaactttactaacaatttatagatcaatggacaacatgatctttatttaataagtatagtttgggcatgatggctcacgcctgtaatcccagcactttgggaggccgaggcaggcggatcacaaggtcaggagattgagaccagcctggccaacttggtgaaaccccgcctctactaaaaatacaaaaatcagctgagtgcctgtagtcccagctactggggagattgaggcaggagaatcgcttgaacctgggaggcggaggttgcagtgagccgagattgtgccactgcactccagtctggcaacagagtgagactacatctcaaaaaaaaaaaaaaaaagtataaagatattgctcagctttctgtcaccggtctggaggcatgtgccaaatcaggagacccaaatcacaataaagaatctcaaactaagccaagacaaaagattcagatattctctttctcttaactacaagccaaagtacttaagaaaaaataccttgcaaatcaatttaaatctgaagttaagctttagtttctcttttctcatgaaccagaacaaaactatcatgctcagccaaacaaagggaaggaactaccttctgcttattggaatacctattcagtgtcagtcactttatatgttatttcatttcatctttatggtaatcctgagaagctggacactattaactctatttctcagatgaggtagctgagggtctttgagtgaagtaactgaacttaatttgacttgactcagagtccactgctttctcctctccatctcagggtcctgatgaagccccatgcttggaaagaagagtttggttttctgtcttgcctcaattactgacagctgcttctattactgatagccatgttcactgtccccaggtgtgggcaatcttaatgagaccttactttccccaggcctttccttctgctttctcagtgggctttgtggttctgaatgagtcaccatccaaaatgatcagattcaagtctcctgaaatttccagcagccatgtaaagcactattttttttccattgaagcttcttttgattgaggctgaatgcctgtgaacatctgatttccagttaagcagtgcacctagctccgctgactagacatgcctccccttcaactgcttattacttcttgctcttgggaggcccttattgtctcttttcctcatcatgcgaatgtgattccccttatatagggaatgaggccagccttaattagccaccaaaaagttgggagttaatttaaggtggggaattaactcctaaccttttgattgctataataacatgtgagagatggtgttagaaagcaatctggagttaatgtcagtaaggatatgacctgtattaacagaacttggtaagattttgctccagttcctcagacagaaatgtgagcagaaaagagcccagccaactgaagttttcaggctgcaaaagggatactgtcctaacagcttgtctcctggacgctctcaactcctgaactttctcactctgatttcctctacttcccccactgtattcttcagcgttctctagagggacagaactaataggagacatatatatatatatgagtttatatgagtttattaaggagtattaactcacacaatcgccaggtcccacaataggccatctgcaagctgaggagcaaggaagtcagtccgagtctcaaagctgaagaatttggagtctgatgtttgagggcaggaagcatccagcatggaagaaaggtgtaggcttggaggctaagccagtctagtgtttctaggttcttctgcctgctttttattctggccatgctggcagctgtttaaatggtgcccatccagattgagcatgggtctgcctctcccagtccactgactcaaatgttaatctctagcaacaccctcacagacacacccagcaacaatactttgcatccttcaatccagtcaagttgacactattaaccatcacatccaccatactgacctttatggtactcctttatccaagcctgggttcctcaagcatatctgagactgaattgtcttttcactgagaacacttcaaacaaaggaatatctataaagcaaccaggagttggttaaccagaagatagccctgctaactcatgccaagcattttggtcaaggtccttccccaccctatgtatctccaggccattccttttagggcctttcttgtctcccagtgtctaaatactgattcacttgaacagttttctttctttaacagcaattctaaagtcttcaaagaaattcatttagtttctgtctttctttctttttttttttttttttccctgagatggagtttcactctcatcgtgcaggctggagtgcaatggtgtgatcttagctcactgcaacctctgcctcctggtttcaagcgattctcctgcctcaccctcccgagtagctgggattacaggcacctgccaccacacccgactaatgtttgtatttttagtagagacggggtttcaccatgttggccaggctgatcttgaactcctgacctcaggtgatcccctcgcctcgtcctcccaaagttctgggattacagatgtgagccactgcgcccagcttcatttagtttcaaacctcccaggattactacaaatctcctcccttatttctatttttggtcttcaagactcctagtccagggctgtagtaactgatatgttttgagactcaagagtgccatacatgtggaagtggttctcaaatgtaggaattcagtagttacaatatgtacatgggaagagcaagaagggattatttaagataaccatgaaagctggcttccttgagcttttcaatgacccatcacaggaagtgaggggcattgttaagaggtctccaatgcggatgtcattagataggtaactactctaatgtccctttccaacaccatctgtaacactgggacattatcaactcagtctactgctctgggagagggggaacctggctgaaataacagtagagaataccagatctagctccaagaaaggccttttcacttgacctttgtctttcacgctgctttcattttaagtattgatatataacttcttgaaagttttatgctaattcctggtacataaacctaattaactagatcagtatagagctccccatggctatgagcacagactccatctccagaggccttggggccagcacaaaatcaaatgagtgccctagaatagcaaaaatgatctcgaaaaagaataaaatgtgagtaatcaatctacccagtttcaacactcattatatagttacagtaaccaagacagcgtaattttggcagaagggtggacatatcagatcaatgccacagaacccagaaataaatgtacacaaatatgcccaattgatttttaaatttattttgtattgatatgtaataattgtaaatctttactgagtacatgtgatattttgatatgcatacaatgtgtaatgatcaaattagggtaattaggatatctatcaccttaaacgtgtatcatttttttgtgttgggaacatttcaagtcttctgttttatgtattttgaaatatgcaataaattattgttaactactgttaccctgctgtgctactgaacactagaacttattccatctatcaaactgtatttttgaatccattaaccaacctctcttcatttccctaacaccatccttccaagcctctagtaaccatcattgtactctctacctccatggaatccacttttttagctcctacatttgagtgagatcatttgatatttgtctttctgtgcctggcttatttcacttaacattatgagctccagttccatccatgttgctgaaaatgataggatttcattctttttgtggctgaataatattccactgtgtatgtatactacattctcttcatccattcatctattgacagatactttggttgattccatatcttggttattgtgaatagtgctgtgataaacataggagtgcaaatatctcttcaacgtactgatttcctttattttagatatatacccagaagagattgtgattataaaagtgtaacaacagggatccttgtgatgatggaaatgttctatatcttgactgtatcctgttataatgtcaatatcctggctgtgatattgtactattgtactattgttttgcaaaatgttaccattgggaaaactgggtaaagagtacacaggatctctattatttcttaaaactgcatgtgaatctgtaatgatttcaaataaatgcttttaaaaaaaatcaaattagtaacaaaattccctctctaatatctgcgtattgtctgttggcattcagtaccctcatacttctgacacttaccaccttgcaaaactagctcttagaaaagattctgatctttctcactgaagtgccagtggctgatgatggcttaaatgatactacttccaggcaaagggacttagtcatcaagcaaaggcaaaaaaagtaactgtaatgttggaatttcagaccctgagtagcagatgaggaaggtatttgggagcagcagagaagccttcctgacatgtctgaattatatgctgtatgtcttgtcctattctgctctgaatgtagatcaggattaaactttcactttaggcctccaggttcctggaatcctccattaatgtggattttgctttgatggttgcaaacctacctacaaatgttgagaaggtttttaatattagtatcatttaagctattccgtttgaaaagacacacacatattccgtcttccttgctccccatgaattataccttctggtagtaagtttactttctccttcacctactaatgtcaattctctattaagtgcaggttcatcactctcaacccaggacagaacactaaatcacttgcaccttatgcttttagaaaatttctcctagaaacctgtcctgaagtcaatagttcttaaccaggctcttttaaaacttccaggggggactggagaaggcgaaatagagtttgttgggttctttgcaggaccaacccctgcataagggattctggtgtcttggaaagagctctgaactgagtagtcaaagaatgtaggttctaacccttgctttgtcgctaacttaccatgtgaccttgggtataacatttcttttcagatatcagtgttctcacctgtaaaacagattatagcaataccccaaatttctttgatacctgactagatgtggaagtgtgtagggttgcaatagtagccatggtattccaaaatctgtttgaaagaggaattctccccttggatgatttgtaaaaccagttcacactctctaaaccagtctgccttgagttgtctgcccagagtggtcactgggtaatttgagaagccctttgttacataacttataccctttccctttgatctctcatctactctaggtgtcaactctgcccgctcagttcctccttcctacccaccaccgcaggacccgttaaaccacggccagtacctggtccccgacggcatcgctcagtcgcaggtctttgagttcaccgaacccaagcgcagccagtcaccattctggcaaaacttcagcaggttaacccccttcaaaaaatgatacctacagggaggcagataattttaaaataaagtaaataaaatt

SEQ ID NO: 4644 - DNA, 20627 bp, human
atgggggagctacccaaagcctggggaaggggagtcagtgctggaggtgactggagccgcggcgacggcggcagcagctgcggtggcggcgctctcagccgtggcagccgaggctgcagcccggcccagggcggctcagcggacaataaccgggctaggaacctgaccgggctgggtaagcgttgcgtacagccaggagcctccgcctgcccgcggtcgggtgcattcccgcgtgctctgctcctacggactggaggagggcactaaggactaggcgggtcggagtcccggtcgctcgcccctctcctttggaacccgctttgcggactgtcgggtggagaggcagagcggccttgagtcccctgggcacaagcgaccacggctggggggaggggggttggggagggcgggtaggaaggcaggctagcctgggccaagcctcccggctttcgggggggcggggatgggcccgcacgtgctgccgcacagtcccgggaagggcgccgccagccagcaccccaagccatgcatttgtaggccaggagctctgcagctttgttgtagcacatttgctggaacagctgtgtaacgcgggtaccgctcacccctctctccggctgcctggctgccgcccctcccctcccctgtgcatctccagcctctccctcctttctgcggactcaagctggcgtgctggcttgggcccgacggagaccggctttggcgtggattgggacatccacagactgccccctccccagaggagctcagttgggcctgtgggctgagctcagtcgcacacttcccttcagaaccttggccttgtggccccaactagccgcgcccctcctcctgggcctccgggcgcatctggcgcccgcccccgcggtcgggcaggctggctggcagccgggctcttgctggtccttgggttagagcagcggcgcaagctagtccttgagttagagctgcaaggccgctttgtctcccgcctcgcctcgcctcacctccttttcccttggaggatactggccgcgttttcctctccagcctcccgtttaaaaatagcaataggcacggtgtttggggggcatttccttgccagaggccgaaggagccctcattgtagtacggaacgtatcataccatctctgtgtacaggagagctagcgaggtggccaaaccctccaacttcgcagttacttaacatacccagcccgccaggcccctgtcattgtctgctggagacacttctgacactggtgaccgcccgaacgctggactttgcttggctcccccggtggtgaggggctgtgcccgctacatgcgtcacagcccaagcgcctaggcggcagctggactggccccgcagagctggtctccgtttggccaggctgctttcggcaagggccgcggggtcaaggcgagccttgttccacacacaaacatcttcctctgcggctctgcctgcctgctgcagcggcgtgggcatgggcaaggcagagggcactgcactgttggactgcctgccccaccgggattccagcagagccccctcccccagtgtggctcccctcattcggcaccacccactgcacagtcactgcaccatggtgcacctctggcagtgggctctctaggcctttttgaggaataggacagaggaagccactgggggcttggtaagctcttggacctttgattaacctctggtgtggagagccctgtgggctgcagggcccaggcaaagcttgggcactttgaggaggggcaacgagacccagtaaattcctcacttgggggaaggctagctctggacctttatgacaggagccaggaccacagatatcacactacagtcacctcctcccaccttgattaggccccaacacaaacctctacttgcagctgggcatctctagcccagggctggacctgccctctgccttgtctcaggccagcaggcacctaatgtatctgctctatgtaactcccttccccacacccaaacccactcagcctacacctgtccaaatcttcttccttctcaaacctcagttctgggccttccttttccttggtgcctttctgcctggctcttgcccacccatggtgacttctttcttctcagaactcctccagggctgcctacttctcctgggcatattcaggcttaaattataataggatgcagactataattaagttggcctgcctctgttttgtctgatatcatggatgtctgggttctctcagaaccctttggaggagtaaataaaacctggacctcagccacaaccctctcaaagccaagcagtgcagagcagttaatgattgttccggaaggacttgctttctttgtagagttttccagaagacctttacctttccaacttgcgcttgtcctgattcatatgaaagtggctagagaaatgatactcaaggctcagatatgtattgagtgtgcctaatgaggatggattagaagggggatgattgcaactacaagaaaaaaatcatgatatatcttcccccaacaacaggcccaggatttggaatgctcagatcccagaccatgcatatctttggttgctgattcatgagccaagagacaaactacttggagagagatgaaagatctgtataagcagggggatcatccatggaagctgccagaaagtagaggggtttagtaggcaaagcataagcagacccaggaatgggaggggagaaagtgattgacaggcagggtgaagggagtgaatgagtctattctggttgagatggtgtggctcagaggtagagaagagattgaggctcagtgatggggtttcccggatgccaggctgtggaatggaaatctgatccttttaggggaaggcggcatcaaagagtagggaattgacagggagttgctatttttgtatgtaactaagcagtaataaaaacaaggtttttgaatgagttttagaatggggtcttagaaagggatcagaagcatgctgcaaagtcagccagttaagaggtcacctttggatctggaagtagagctgcgggcaggctacctccaaaggaaagttttactatgtcagcctccctttggcattgcaggggaaagggcaggaagaggtgggaagtggggctgagaagtgttccccaggcctctgctgaacaccttcctctcagatgggcagtccttggggagcaccagtttgaactgctatgcttacagatgagaatccttagccttggaaagcaacaggggctcgcttaaggtcacacagctatttaaggataggctcctgcttcccgtgcagtggctctttccactatgttccatggaaccagcagcctccaatcaatgtagatttcattaaccatccccctcatcttacctccctcattccctaagaggaaaggggggctgagttaacttgggaacttcataaggggagcctctcactcgtttaatgtctcttttgcctcttggtcttggcctatagctttgctgggactgaaaatttcaaaaggagaggaggtagttggaagaatttggcagtctaatgatcccctcctagcatagtggaggtattaaaaattccttaagggctgggcctggtggctcacacctgcaattccagcactttgggaggcctagccgggtggatcacttgaccccaggagttcgagaccagctcgggcaacatggcaaaacctcatctctacaaaaaatacaaaaatttagccaggtgtggtggtttgcacctgtagtcccagctacttggaaggctgaggcaggagcctctcttgggcctgagacatcaaggctgcagtgagccatgatcatgccactgcactccaggctgggcagcagagcaagaccctgtctcaaagaaacacgaaatttcctgaagaactgttacatctccactcgtagatagtgtgtatggaagaaacaactctgctccactaggaaacagtagcaagcctggcaggtagaaccaagagggagaaggggtttccagcccccttgcttaacagataggctatctgaggctagaagagagaatgtccaatgttatttcaatttccctacctgaatcctgtctgggcagatacagtgggtgataaagggttaagcccctgaggcaatatttcatagcctttctgtgtcactcattcctgggtcacctgcctcattgcccagttctttctcagggataatctgagcctgtcatgctatagttaaaccttgtgtgtgtgtgtgtgtgtgtgtgtgtgtgtgtgtgtgtgtgttgggggaaggagttgcgagcagctggccaccattgctcttctgcttaacgatctattggagatttcataggcattaaactctctctgcacccccaacttctgttctctgaattaaataatctcagagtcttccatctcctctgcttcgtcttatttttcaaacctgtgcgtgtgtaagtgtatttctagcaaaggcaggcaggggaaccagaaccactacagaggtacaggtgctagcccagtaagagtatgttgctccctccacctccccttttggaattaggggaaaatatgaacaatggagaaaatgacctgaggggcttggtgtggtcataggcaggcatactggtgctgcagtggcctttgtgaccctttgatgtgcattttttttcagcatagaggtttcattgctttcatctcctacagtttttacccccgctgggcttccaagtggatactaaccctccatccctagtgagtatgcctcaaccctccctctccatctgctcagcccttcttgctgggggctgtggctcttttcaggggaatgaggaatggcatgaccagttctggcccccctcctttctggatatgttggaaatattcacaggccagactcagtgcattttgaaagagcaaaatgttgaggggtggtgtaaggagtgaggctgggccacagtgcacctttgtcctgaagtggtgaactaggtcgaaccagctaggtaaccaggcctaacagtaagacctaggaccctcaaagccaatccagtgccccctgctatgccttctgactcagcagccattagaaaactgggcacaagaccactcctcccccagcctctcagggcaacttggagcaagcagactccctggtccaatctcccatttctatatgaagaaactgaggtccagaacagggaaaggatttgctcaagttaactcagaagtccaaagctcctggtccgcaattcaattccagagttcttcctcgaatcacactctccttgtcccctcccaagcttcagtttcctcacttggtttctcacacagggcatggttagtagaggggagtggacacataggaaagtcagaggtatccattgttcacttgacccagctgctcctctgtagggtttccttggctgctctgtcacatctgtttctctggagttagctcctctcctattcttcatttgaacggggggtggggaagggttggcacctgtctgatctcgctctagctgggctagtactgacttagtggaagcctatgcaggcgggcatggtacccacttcagatacacttctctctaagaaagtttgggagcctaagatgggagtggcaagtaagtggctcccaaagtccctgtcattcaaggcaagctgggcagggaggggacctcaagagcctgaggaggaacctggggcactaagaagactcaccaggaaagcccatttctagggagaggtggtatctgggtgaccacatctcccagactgggcaaacccctgtgtatttggggctggggccaagaggcagagaaacaaggctgagaaacttgtaaggagcattcagggagagcaagcctttaacatcagacatagggttttggcccttatcctgtaggcaatgcagaataatttggtaagtggaggagtgaagtgctgaaacaggagttgtaagaaaatgaatctggcaacaacgtacaggatgaatgagatgggagaggggagccagggggtgctgcggtagggagggactagagggagctcagctaagaggcttgtgtcatcttcggagaatgtggggtggcaattggggagctggagaggaaaaggtgcctacaagtggcctcatcacaagagccctttattgaatatctgcttagtatgtagttaccagtttgcttttacattgatcatctctaatccttaccacaatcctgcatggtagatagcattttcttcattttacagataaggcatttgagtgtcagagaggttaggccactttctcaaaccacacagcctatagaaggtgaggctggcattccagttccgcaccaagaaacttcaggtgaattagaattcagttgaatcagcattgtttgagctcctgctgtgtgctagttgtagtgactgtaagatgaaggagggtcaatttgagagagatgaatgaacagaccaaagcccgtcaggatgaattatacaaagctcagtatgtaaacaaatcagttgagaggggctggtgggggaattgggacaggagagagaagtcccaatttggggtcttgctgcatctggagttggtgagatgccctctgggcaggaggtgcccctcagcaggaaggctgcaaattaggggaggagctgaaggggctctgccagctgcatctacaactccatcagccaaccaagccaagcagcccttcctttaggctctgaccaaatagttttgagggcagtacttggctatgggtgttaaaaatggatcattcaagttccagatcatctgataagtcattttcttcaaatagctcaaattctgcatctttgtccacgttggcaggtttctcgtttttgggccactcaaacctatctcttaaggaaaaggggagtagagtgacatgtcctgtagtttgagaggagtggtggtagggttgctgatgaggagagcagccacaggctgggttgttggcccctagattctgatgtcagcaggcttcctggaatgtgtttggtaggacccaaacagtggcaaccagtgaggactggaaatgtggcaaagaaggcttagcagggctgggacagaggtgggatgggattgggagattatagttcttgctggtgtgagggtaaactttgcagttctcttgctcagtcttcctcctttgattggtggcctgcacagtgcagcagaatggcatgaaattgagactcaacagttctgggagctagtgtggctctgtcaccatttcactatgtgaccttggacaagtcttttcccaagtctaggcacagtttccttctctgtgacaaggagttgccatcccccaccaggcctgagtaatgggtggctgaggagggcaaatgggggggtatgggagtagggagtgctttataaagtggtaaataccctgagggtgaaggatatctgttgatttgcatttcctttgatgttggtacttttagctgagtttgacctgggctagagaacctggctagttgaaagtcccagataatccttggctgctagccagtagctgactcttttaggtccctgaatatcaaaagttggctaaatgagcaagtaaagcctcctatgacatgaccacacagttatcttcatttaccatttgccatttgggaaaactgagccccaaggaggtttggtgacttacccacagagccctagggagcaccctactcaacctgactgagatgattttacttctagaaattgttctaccacagtttgaataaaatatgaataaaagttggttactataatgtttttagcttctgctatgtaatgcacttgatttggtacattatgtgcattggttttacttcttacaatagccttaagaggtaggcactctcaatgacctcattttacagttaaggaaattgaggcataaacatgggaaaaaacttgctggatttcccctagctgggcagagttgattccagcgctgaaatggccagctctctggagggccatcctcaccattttttctttaaccaaccctccccaacatacagaagggcaggtgggcctgaagtgggcttgctttcaggaagactgtttggaacaggcctgaggaactatggctggtcaaggccatgtctctggagctactgcataaatccacttgcttctttttcttcccccaattcagccctcttcaagttggccatgctggccccgggaagctgatttggagcagaatgtgcaaggctcatattgcagctgtcccttctccttgagaagggtctctagggcaggtatgtggctggcctcctgcctatgttttaagtggagaggagaaggaagaagctcttcctttgtagccagccttccactggccccagaatggcttgaatctggctcagggagctggaatggccccagcgctttctaccacagcctgctttctgccatgatagcagctgctgcagcaggcagtccctgcaagggaccacagagtggcttgggagggttctcttaacccccagcccacctgaaactcagccacactggttaaggaacatgagggttgtggggccctgcatttggcagtgccactttcttgacaggacccccagggaaagccagtcccagcctaggggatctgcagagtctgtcctttgctgtctcctttgctttctgccccacctcactctcttggtgaactcttgtggtcctaagtaaaggcagcataacccattgaggaaggatagctttggcacctggttggatagcaaagagtatggagaagaggcctaaggcagaggtagctaggtggggctacgctagggagctaccagctatgggtgaccctgccaccttccttcccagtgttctgggtgacataggcagagatactgtgaatgactgtggggggacatggctctgggagagagaacacagagtaccagtttaaggctggtatctgccagcaaagatgactctggacttggttaggagaagggcctgaactggacggagagaaactccatcccagggacaccctgcgtaattcatctgtctcccacaacacacagagagggcttttcaaacctcttagcagaggagtttgtatagatatacacacctttttaaaatcccctcatatctgtctccctctcagcatgggccaaggcagcaagtccctgagcttcccacagtgaatggctttcccaaatgaacagcctttaacacatggtcagttgcttcctaagaaactgggatctgacctggaaggagtaataataactgtaatgacagtctttctcatttgcactgtactatacagtttataaagtgctttttttgtgcctattatcacatcaactcatcacaccactgtagttggagtgggcaggtagaaggataggtagaggagctgttttgatctcaaaatagctcacaagtacctgcgtctcagcaggctacactggcccattcagggtcccttggcagatgggaggctgacatggcctggaccccagccctgtggtccatggctccttccacaacacactgcagctccctgtgacaggaaaggggacaatacagagagaggtgagtgggctggcctctaccctcacagagcataggagcaagggcaagggaaagcccaaagagactgtcttctaactggggcgtcaaggctctggaaagcagccttctttgtgattcaatttgccaaatcactctgttcccaggaactccagccccaaacccagcaggacaagtcagcctttgattcacaaggatgtgtaggtcctagagtttttcacttggctgtgaggttttccttgaggcccagccttactgcccaagaagtgtctttctccctttcacatttatcttggaatatgtttacaaggtataaagaatgatactccaccaaccagctttagaaataacaggggctattctttaaggcagcggttcccaacctttttggaaccagggacctgtttcatggaagacaatttttccatggatggagaggaggaaggttttgggataaaagtgttccatctcagatcatcaggcatttgttagattctcataaggagagtgcaccctagatccttcgcatgcgcagtttgcaatagggttcacgctcctatgagaatctaatgcctctgctgatctgacagaaggcagagctcaggtaatgttcaccttgccctcctgcctgccggtcacttcctgttgtttggtccagtttctaacagactgttacatataggactctccctgttagcctaggagctccttagaagcaaaggctgggagttctcccttcttgtcctgccctgaagcactgaattccagaggggaatagaatttcacaaacaactccagtactgcctccccaactcccctatccccaacaccgtgacgataaccttagcagtaattttaaggctgaggtaaaaatgtgctgtggaaagtggggcattcagacatgatagggcccctattcccaccagacccaggggcagaaaactgggtgattgtgtgtttaggtgtgattgtgtgtgtatttggaggtgggagggggcactgtctattgtgggactatcagttgcagggctgagttggaacagtgtgatgtcaaaatatgttacagaaaaatctctaacctgagcaaatggcaattcagatctctgcagagagaggttcagatgaactttccttttcacctgctcttttcttttctggataaccagctgttatcttgctccaattttaatattcagttatgcagagtgttctttatggaagcttggatcatcacactgatgattcaagtgtcaagccaagcaaggcagcaggcacaaaattaatgtttgcaagacagaaccaggggctccaaggctagagtgtagctgccagcctctttccatgctcagtgctggtccacagtcttccactttaggtgaatgtgtgagtcttattattatggcaagcaatcacaggcctggtgtactgtccagctgttcttggaccaagggtgcttgcttctctctccctctcttactcttccttccctccccttccccttcccctctcccctctcctcccagattcccccatctgctggtgccactctacagagaggggacaaattggtgagggacttcccagggaggggtcattgggttttagcaggctggtcactgagctagcggatgaccagaggtgcagaggtatattgtggtgggtagtggctaggtcttgtttttattccatctctgttggtatttgggcatttggaggattgagagccttgaccagaagggtgtggcttgcaccaggtttatttatttaaaaagccattgggaacctatctcacacaccaggaatatgaatcatgtagggccttcaaggagttcccttcctagatagggagctagatggggacaaaaataataagaggaggagagtagaggagaaacagtccacctcatggttctcaagtggaatttggggttccattgatgaccgcattaaagtatcttcccagcaggacagccaatagagggtctggcttagacccaccctcatatcacctctctgagggagagatattgataggcctcttgaatggcgaatattgaagcccagagagtacctttcttgaggctcccatttcattgtcttagcaggttctagattgcagacctactttgtggatgtgtgaggctcctattctgagattctgaagcctgagcatggttctgcaggcaatttaggaagctttggatgggaggtgaaacttcaggtccacttttcagtctcagacaaaatgtcagtgagagcccagactaatatgaaactgaagcttgaatccaacagagccctgtgaggactcaatggactgttttgccagatggttttcaaaaattctgtgatgttggagccaacatcccttttgcctttcttgtctctccctatcctcatcccctttgataattgataatacctcccacagccaatagcaccactaggcctttcacacaactgcaggtccccctgcccagtggtcccctgagcttaggatggtctgaagggagtggacccagcaagaaggtaggggatgaaggcttcttgttgctcagtgtagagttttgcttccttggggcccagagagagctggcccagcaagccaagcatatcgagtggattaagatttgccccacattttccatcattttctttcttgttccactcaagcctgacgtccggtgaaagcaaacccagcctggatgcttgctcactagtatctgtctctctgtctttgtctctcctatctcctccagaccccactgtgatgcttcctgactgataatgttataacagtgcctggaagcctgaggctgcatttccagctggacgtacctcagttgtccccatcatcatggagacccaaaaggatgaagctgctcaggccaagggagctgcagcctctgggagtacccgtgaacaaacagcagaaaaaggagccaagaacaaggcagctgaggcgacagaaggaccaacctcagagccatcctcatccggcccaggtaggctgaagaaaactgccatgaaactctttggtggcaagaagggtatctgtactctgcctagtttctttggagggggacggagcaaaggttctgggaaaggcagctccaagaaaggtctcagcaagagcaagacccacgatggcctgagtgaagcagcccatggccctgaagatgttgtcagtgaaggaactggcttctccctgcctttgcctgagttaccctgccaatttcccagctctcagagtgcccatggggctttggagacaggctccagatgtaagacatctgtggctggagccacagagaaagctgtggctgagaagtttccctctatgcccaagccaaagaaaggcctaaaaggcttttttagcagtatccgccgtcaccggaagagcaaggtcactggggctgagcaaagtgagccaggggccaaggggcctgagagggtcagagccaggcctcatgagcacgtgagctcagcccctcaggtgccctgctttgaggagaccttccaagcccctagaaaggaaaatgctaacccccaagatgcccctgggccaaaagtttctccaacaccagaaccttctccaccagctactgagaaaatggcctgtaaagatccagaaaaacccatggaggcctgtgcctcagcacatgtgcaacccaagcctgcccctgaagccagtagcctagaggagccccatagcccagaaacaggggagaaggtagtagcaggagaggtaaacccacccaatggccctgtgggggacccactgagcctcttgtttggggatgtgacatccctgaaaagctttgattcattgacaggttgtggtgacataatagcagaacaggacatggacagtatgacagacagcatggcctctgggggccagagagcaaaccgagatgggaccaagcgaagttcctgcctggtgacctaccaaggaggtggggaggagatggccttgccagatgatgatgacgaggaggaagaagaggaagaagaggtggaattagaggaggaagaagaggaggttaaggaggaggaagaagatgatgacttagaatatctgtgggaaactgcccaaatgtatccacggcccaatatgaacctgggctaccatcccaccacatccccaggccaccacggctacatgctccttgacccagttaggtcttatcctggcctagcccctggggaacttttgactcctcagagtgaccagcaagaatccgcccccaatagtgatgaaggttattatgactccaccacacctggatttgaggatgattcaggtgaggccctggggcttgtccgcagggattgtctaccccgagacagctacagtggagatgccctatatgagttctatgagccagatgacagccttgagaactctccacctggagatgactgcctttatgacctccatggtcgaagctctgagatgtttgaccccttcttaaactttgagccctttttgtcctcccggccacctggggcaatggagacagaggaagaacggctagtgaccatccagaaacagttgttgtattgggagcttcggcgggagcagcttgaggcccaggaggcacgtgcccgagaagctcatgccagggaggcccacgccagggaggcctatactcgagaggcttatggcagggaagcctatgccagggaggcccacacttgggaagctcatggcagggaggccagaacccgagaagcccaggcccgagaggttcgttgtagagagactcaagtccgagagacccaggcccggcaggagaagcccgtcttagagtatcagatgaggcccttaggcccatcagtgatgggcctggcagcaggggtatcagggacctctcagatttcccaccggggaattacctcagctttccccaccactgcaagcagcgagccagactggagggacttccgtcctctggagaagcgttatgaaggaacctgctccaagaaagatcaaagtacctgcctgatgcagctcttccagagtgatgccatgtttgagccagacatgcaagaagcaaattttggaggatctcccaggagggcctaccctacttattcaccccctgaagatccagaggaagaggaggttgagaaggaagggaatgccactgtgagtttctcacaggccctggtagagttcaccagcaatgggaacctcttttccagcatgtcctgcagctctgactctgactcatctttcactcaaaacctccctgagctgcctcccatggtgacctttgacatcgctgatgtggaacgggatggggaaggcaagtgtgaagagaatcctgagttccacaatgatgaagatcttgcagcctccttggaagcctttgagctgggctactatcacaaacatgccttcaacaactaccatagtcgattctaccaaggcctgccctggggtgtgagcagcctccctcgatacttgggactgcctggcctgcaccctcgacctccacctgctgctatggccctcaacaggagaagccgctctctcgacactgcagagaccctggagatggagctctccaattcccacttggtccagggctacctcgagtctgatgagctgcaggcccagcaggaagattcagatgaggaggacgaagaggaggaagaaggagaatggagccgagacagtcccctttccctctatactgaacccccaggggcctatgattggcctgcttgggctccctgtcctcttccagtggggccaggtcctgcctggataagccccaaccagttggacaggccttccagccagtctccatataggcaggcaacctgttgcatacctcctatgaccatgtcaatatcactatcagtgccagagtcaagggcacctggggaatctgggcctcaactagctcgtccctcacacctacacctgcccatgggcccttgctataacctccagccacaggcctcccagagcatgagggccaggcctcgagatgtgctgctgcctgttgatgagcccagttgctcttccagttctggaggcttcagccccagccctctaccacaggccaagcctgtgggcatcacccatggcattcctcagctgcccagggtccggcctgagcacccccagcctcagcccactcactatgggccttccagccttgacctgtcaaaggagagggctgagcaaggtgcctctcttgccaccagctactcctccactgccatgaatggaaacctagccaagtagttattatcaattctggagtagggacacggggcctgagcatgtgaatggggatcaggggttgggcagaagggtgggggggtgggggttgttgtttaacttgaaaaccctttgggccaaggaaaactcctgtgagttttcaccttggttttcccacttgcctcttctgccatctatggccacgttcaactcaagtgcatctgcccagggaggctgctgctgctactgcactccagtttttgctttcgaggtttcttcttgtgacccacgctgggtttgggatgctgtaattttgtgcctattccagttgccaagttagtgattatatatatatatatatatatatatatatatatatatatatatacacacacacacacacacacacacacacacatacatacacacacacacacaaacacacatgcacacacatatatagcatgcatccttgacacaggctaaacctttagtgccccctgcccctttcccccaatgaatgatgaaccactgattagcagccaagtctgcattgcctcccgcttggggaagtggggcttatttgctattagcaatgtgaaattatggtacagatcctccccacccctattccttttggcctggcatagctgccatcattatatcagatgactataagctattcatcccagctagctgtccttagagaggatcaagtagcgtgtgtctcacagcctatcgctgtggactttggcatcatgaccagatgggggccttttaactgtcctgccatagcttgggttaaagacaaaaatgctaatccccttgatggagtgataaaattcatccatttgcaaacagaagacaaaacaaggttctgttgtggacactgccatagagtgttgagctccggaatgataggattttttttccttcttttaagcttgtgactacctgagttgcagatgcttttgaatttttgttcttttttcctctaaaggaaattttcataatctcatcacaaggaacacggtcttttaattgagataagggaagagaagcaacctaaattaggcttgactataggggctggggtttttgtggagtgtaggggaaagatagaaaatgagggtccatttatcacagccagcaagaaaggggatttcagaccatgcagagcttaaggtatctcagtttcttaaaagggaaaactcccttctcaagcctcccaacacaaaatgttccttaagccttgcccatcccatcatttggactctgtaataaggccccaggtttgcactcccaagacaggataccaaaggcatctcagctgctgttctgggccctttaaagagcttttatcttccaattagccgagtccttagcatcatcaaatgacagggcttcttggcagttgcagccctttatggaatgaatggcaccctcccttctcctgcatccatgcagttttcatgttaaactaggttggaaatactggtggggaagagcttgctgtcaggaagacattggaacaggctaatcttgccaagctcaacctctcattaatcacctgtaggagagggttccttttacatgtctttattggaaatggcatatggaacattttttgcttggctgtgttcactcaaattatgattattgcaccctcgccctcacatcccaccatctccatgcctgttgagagaagaagtcaacagggttcttgccattcctgagatatggcaatttagcttgggaacagatgctgtttgccccctaagtcaaggtgactttgtgggcaaactgtttcttggccaggggatgtgtccatgctggtctttgtcaccatttctcagattggggttggcccagtgcccttactcacaaatagcagacctggctggtagaagctgcacccctggaagcaccacatgaatttgcatggcactaacaccaccactcaagggacccagaccagctcttcaggctgactttggctacagatacattgtgaagaaatgtatctgttgtggagctggagaatgaaagagggtgaggaaggccctccttaccccaagcacagcattccaagagagaagtgcccaaattccaactttctggcctcttaccaaagctgctctgggatggtggggctgaaattggcctggctatttggcaggaagtaaacactcaccaaatgcctttacaacagggaagaacccacctcttgcctcttctttcagggcagcttgagctcctgtctacatgtggactgtgccagccacagcaggcggtagagccatcaccagcctccagaccctgctggagaagggccaccagcctatctgggaagagaaaaaggaggtggccaacctttggctaagggctgagagctgccctcaggatcaggaaggcagcatgaggcattgtctctgaggggcactggcatagccctgacacactttgttgggctttggaaggtcacacaccacagagtagggcctggggctgagtgagagttcatggtttggacagccttgctgcctgcaagtcccttcactgccctagccagcccaggaataggatccttaccacctgaagtggggcagccaggatatgtggctgcagaagcaggttcctttgaatttctagagctaagcagtttgtggctgaaacccaatggcagcctaggggaggaaggaagacctgtctggggacccatggtgttgacagcacagggtgacattgggagagccagccaagcttcaggcctgtttccaaacacagactagtgctggcttgggtggcagcaaatacaccccagaccactaaaactgttgatatcatgtccacacctccaagagtactactagatgaacaacatgtctccattgcaaggtcctggaataatgcttttggatgtgattttaagggaaaatgggacttagtggaagtagctgccttcatcttattacccaataggcctagtgccagacagctgtgatcctgagaattcccagatgagactggtccttggaggaccagtgaatgtggatagagaaggccacctagtaggcctctcccagggccaggatgccagtttcttggtgctttagagtctccaaggaagcactgccttggggcccagttcaagccagccctacctatctggcctcagcttgggtaccaggccacaagactgcccggataatgggttcagtaaacaccagtctctctccctccttagtcctatgccaagaagggaagtagcttcacacactcaggaggctgggtgtgtacccttcatcctgctgccagcagctttccttacctgtgccagtgccaccaccccacctgccctcagcccccaggcccagttgctagagggaggcatggggtttagcagggagacttcaagtttacccatgtgtatgttgcattcaagttgtttttaatatatatatatatatatatcaaaagtcaattatctatttttatattgtttgcattttatattcatggaaaacaatgtttatcaattgttcttttctgatttatttttaagcggtgctgtttacagttttaaacaaaacaaagatgacacaaaaattgctgctgcttgtgcagagggctggcatctcaactgcctagggccctccctctttcccctctccctaccttagctgtaccacactgtccgttccctccccccatgatagggacagcagaagatgcccaggtactgaagacaaacgccaagtgactcaggcgtgtgggacctggtagacagcttgtcattttctggctttattttatgtttttctttcttttgaacccttcttccccatgtctagaccctctgagagtactcatgtgtcttattttttttcctcgttatgttttgtgctttagttttgaaatcagagtgcccatgttgtgctatttgtcttgttgagtttctccaaaggagcattttgggaacattctccacccaatggggaaggaagggggtttcaaccatgtcccctttccccaagaagctgtgggagacagatgacaatgatgcttgcactatcaggaatttaccatctcgttgaggaaacccttgcataggacttcctaggagctcagttgattgtgacattttcccagaagagaggctttggggaactccttcacccctcttgctgctttgggggaatctcctcccctaccaccattccccctcccctgccctgctccagctcacacgtggatggtactttggggaacagtgactttcagggtgatggcttgctggcctgatccctgactttccaatcctatagtcactccaaagaagaaaatccacatggtatgtatatgtgtgagggttgggtctattgagaggtgggactttaattattgttattattattggtgcttatttttcctgctgtatatgggggtgggggtgggggggaataaaacaggaatgtatatttaggtcatgttaaataaaatggctggaggaaggagggaagaaattaggaactgcagtacatcatcaccccaggtgtaagagttatttctctcccagtgcagaaaggggagtgtggcccctggctgtacctgagcttcctcttctccatccctgagacatcacagaatcacccgggttctgacctctccacttctagctctcactgacatctggatatcttgatgcactgcctgtttgtaacaacatatacttctttgctgaatgctaataaacttctgggttcaagagggaacccctcagtc

SEQ ID NO: 4645 - DNA, 7169 bp, human
atggagacccaaaaggatgaagctgctcaggccaagggagctgcagcctctgggagtacccgtgaacaaacagcagaaaaaggagccaagaacaaggcagctgaggcgacagaaggaccaacctcagagccatcctcatccggcccaggtaggctgaagaaaactgccatgaaactctttggtggcaagaagggtatctgtactctgcctagtttctttggagggggacggagcaaaggttctgggaaaggcagctccaagaaaggtctcagcaagagcaagacccacgatggcctgagtgaagcagcccatggccctgaagatgttgtcagtgaaggaactggcttctccctgcctttgcctgagttaccctgccaatttcccagctctcagagtgcccatggggctttggagacaggctccagatgtaagacatctgtggctggagccacagagaaagctgtggctgagaagtttccctctatgcccaagccaaagaaaggcctaaaaggcttttttagcagtatccgccgtcaccggaagagcaaggtcactggggctgagcaaagtgagccaggggccaaggggcctgagagggtcagagccaggcctcatgagcacgtgagctcagcccctcaggtgccctgctttgaggagaccttccaagcccctagaaaggaaaatgctaacccccaagatgcccctgggccaaaagtttctccaacaccagaaccttctccaccagctactgagaaaatggcctgtaaagatccagaaaaacccatggaggcctgtgcctcagcacatgtgcaacccaagcctgcccctgaagccagtagcctagaggagccccatagcccagaaacaggggagaaggtagtagcaggagaggtaaacccacccaatggccctgtgggggacccactgagcctcttgtttggggatgtgacatccctgaaaagctttgattcattgacaggttgtggtgacataatagcagaacaggacatggacagtatgacagacagcatggcctctgggggccagagagcaaaccgagatgggaccaagcgaagttcctgcctggtgacctaccaaggaggtggggaggagatggccttgccagatgatgatgacgaggaggaagaagaggaagaagaggtggaattagaggaggaagaagaggaggttaaggaggaggaagaagatgatgacttagaatatctgtgggaaactgcccaaatgtatccacggcccaatatgaacctgggctaccatcccaccacatccccaggccaccacggctacatgctccttgacccagttaggtcttatcctggcctagcccctggggaacttttgactcctcagagtgaccagcaagaatccgcccccaatagtgatgaaggttattatgactccaccacacctggatttgaggatgattcaggtgaggccctggggcttgtccgcagggattgtctaccccgagacagctacagtggagatgccctatatgagttctatgagccagatgacagccttgagaactctccacctggagatgactgcctttatgacctccatggtcgaagctctgagatgtttgaccccttcttaaactttgagccctttttgtcctcccggccacctggggcaatggagacagaggaagaacggctagtgaccatccagaaacagttgttgtattgggagcttcggcgggagcagcttgaggcccaggaggcacgtgcccgagaagctcatgccagggaggcccacgccagggaggcctatactcgagaggcttatggcagggaagcctatgccagggaggcccacacttgggaagctcatggcagggaggccagaacccgagaagcccaggcccgagaggttcgttgtagagagactcaagtccgagagacccaggcccggcaggagaagcccgtcttagagtatcagatgaggcccttaggcccatcagtgatgggcctggcagcaggggtatcagggacctctcagatttcccaccggggaattacctcagctttccccaccactgcaagcagcgagccagactggagggacttccgtcctctggagaagcgttatgaaggaacctgctccaagaaagatcaaagtacctgcctgatgcagctcttccagagtgatgccatgtttgagccagacatgcaagaagcaaattttggaggatctcccaggagggcctaccctacttattcaccccctgaagatccagaggaagaggaggttgagaaggaagggaatgccactgtgagtttctcacaggccctggtagagttcaccagcaatgggaacctcttttccagcatgtcctgcagctctgactctgactcatctttcactcaaaacctccctgagctgcctcccatggtgacctttgacatcgctgatgtggaacgggatggggaaggcaagtgtgaagagaatcctgagttccacaatgatgaagatcttgcagcctccttggaagcctttgagctgggctactatcacaaacatgccttcaacaactaccatagtcgattctaccaaggcctgccctggggtgtgagcagcctccctcgatacttgggactgcctggcctgcaccctcgacctccacctgctgctatggccctcaacaggagaagccgctctctcgacactgcagagaccctggagatggagctctccaattcccacttggtccagggctacctcgagtctgatgagctgcaggcccagcaggaagattcagatgaggaggacgaagaggaggaagaaggagaatggagccgagacagtcccctttccctctatactgaacccccaggggcctatgattggcctgcttgggctccctgtcctcttccagtggggccaggtcctgcctggataagccccaaccagttggacaggccttccagccagtctccatataggcaggcaacctgttgcatacctcctatgaccatgtcaatatcactatcagtgccagagtcaagggcacctggggaatctgggcctcaactagctcgtccctcacacctacacctgcccatgggcccttgctataacctccagccacaggcctcccagagcatgagggccaggcctcgagatgtgctgctgcctgttgatgagcccagttgctcttccagttctggaggcttcagccccagccctctaccacaggccaagcctgtgggcatcacccatggcattcctcagctgcccagggtccggcctgagcacccccagcctcagcccactcactatgggccttccagccttgacctgtcaaaggagagggctgagcaaggtgcctctcttgccaccagctactcctccactgccatgaatggaaacctagccaagtagttattatcaattctggagtagggacacggggcctgagcatgtgaatggggatcaggggttgggcagaagggtgggggggtgggggttgttgtttaacttgaaaaccctttgggccaaggaaaactcctgtgagttttcaccttggttttcccacttgcctcttctgccatctatggccacgttcaactcaagtgcatctgcccagggaggctgctgctgctactgcactccagtttttgctttcgaggtttcttcttgtgacccacgctgggtttgggatgctgtaattttgtgcctattccagttgccaagttagtgattatatatatatatatatatatatatatatatatatatatatatacacacacacacacacacacacacacacacatacatacacacacacacacaaacacacatgcacacacatatatagcatgcatccttgacacaggctaaacctttagtgccccctgcccctttcccccaatgaatgatgaaccactgattagcagccaagtctgcattgcctcccgcttggggaagtggggcttatttgctattagcaatgtgaaattatggtacagatcctccccacccctattccttttggcctggcatagctgccatcattatatcagatgactataagctattcatcccagctagctgtccttagagaggatcaagtagcgtgtgtctcacagcctatcgctgtggactttggcatcatgaccagatgggggccttttaactgtcctgccatagcttgggttaaagacaaaaatgctaatccccttgatggagtgataaaattcatccatttgcaaacagaagacaaaacaaggttctgttgtggacactgccatagagtgttgagctccggaatgataggattttttttccttcttttaagcttgtgactacctgagttgcagatgcttttgaatttttgttcttttttcctctaaaggaaattttcataatctcatcacaaggaacacggtcttttaattgagataagggaagagaagcaacctaaattaggcttgactataggggctggggtttttgtggagtgtaggggaaagatagaaaatgagggtccatttatcacagccagcaagaaaggggatttcagaccatgcagagcttaaggtatctcagtttcttaaaagggaaaactcccttctcaagcctcccaacacaaaatgttccttaagccttgcccatcccatcatttggactctgtaataaggccccaggtttgcactcccaagacaggataccaaaggcatctcagctgctgttctgggccctttaaagagcttttatcttccaattagccgagtccttagcatcatcaaatgacagggcttcttggcagttgcagccctttatggaatgaatggcaccctcccttctcctgcatccatgcagttttcatgttaaactaggttggaaatactggtggggaagagcttgctgtcaggaagacattggaacaggctaatcttgccaagctcaacctctcattaatcacctgtaggagagggttccttttacatgtctttattggaaatggcatatggaacattttttgcttggctgtgttcactcaaattatgattattgcaccctcgccctcacatcccaccatctccatgcctgttgagagaagaagtcaacagggttcttgccattcctgagatatggcaatttagcttgggaacagatgctgtttgccccctaagtcaaggtgactttgtgggcaaactgtttcttggccaggggatgtgtccatgctggtctttgtcaccatttctcagattggggttggcccagtgcccttactcacaaatagcagacctggctggtagaagctgcacccctggaagcaccacatgaatttgcatggcactaacaccaccactcaagggacccagaccagctcttcaggctgactttggctacagatacattgtgaagaaatgtatctgttgtggagctggagaatgaaagagggtgaggaaggccctccttaccccaagcacagcattccaagagagaagtgcccaaattccaactttctggcctcttaccaaagctgctctgggatggtggggctgaaattggcctggctatttggcaggaagtaaacactcaccaaatgcctttacaacagggaagaacccacctcttgcctcttctttcagggcagcttgagctcctgtctacatgtggactgtgccagccacagcaggcggtagagccatcaccagcctccagaccctgctggagaagggccaccagcctatctgggaagagaaaaaggaggtggccaacctttggctaagggctgagagctgccctcaggatcaggaaggcagcatgaggcattgtctctgaggggcactggcatagccctgacacactttgttgggctttggaaggtcacacaccacagagtagggcctggggctgagtgagagttcatggtttggacagccttgctgcctgcaagtcccttcactgccctagccagcccaggaataggatccttaccacctgaagtggggcagccaggatatgtggctgcagaagcaggttcctttgaatttctagagctaagcagtttgtggctgaaacccaatggcagcctaggggaggaaggaagacctgtctggggacccatggtgttgacagcacagggtgacattgggagagccagccaagcttcaggcctgtttccaaacacagactagtgctggcttgggtggcagcaaatacaccccagaccactaaaactgttgatatcatgtccacacctccaagagtactactagatgaacaacatgtctccattgcaaggtcctggaataatgcttttggatgtgattttaagggaaaatgggacttagtggaagtagctgccttcatcttattacccaataggcctagtgccagacagctgtgatcctgagaattcccagatgagactggtccttggaggaccagtgaatgtggatagagaaggccacctagtaggcctctcccagggccaggatgccagtttcttggtgctttagagtctccaaggaagcactgccttggggcccagttcaagccagccctacctatctggcctcagcttgggtaccaggccacaagactgcccggataatgggttcagtaaacaccagtctctctccctccttagtcctatgccaagaagggaagtagcttcacacactcaggaggctgggtgtgtacccttcatcctgctgccagcagctttccttacctgtgccagtgccaccaccccacctgccctcagcccccaggcccagttgctagagggaggcatggggtttagcagggagacttcaagtttacccatgtgtatgttgcattcaagttgtttttaatatatatatatatatatatcaaaagtcaattatctatttttatattgtttgcattttatattcatggaaaacaatgtttatcaattgttcttttctgatttatttttaagcggtgctgtttacagttttaaacaaaacaaagatgacacaaaaattgctgctgcttgtgcagagggctggcatctcaactgcctagggccctccctctttcccctctccctaccttagctgtaccacactgtccgttccctccccccatgatagggacagcagaagatgcccaggtactgaagacaaacgccaagtgactcaggcgtgtgggacctggta

SEQ ID NO: 4646 - DNA, 20627 bp, human; identical to SEQ ID NO: 4644

SEQ ID NO: 4647 - DNA, 2727 bp, human
cagaggctccctgacttgtgtgaagaagaggagaagctttccttggagtaagctacctgcccccagtccctacaacataccctccctccgacccacatacatacttacatacctacacacacacgggcaggtatacatacacaaagcctagcctgaaagtcagagtgcctagttttagtcccaggcctttcagtggcttactcactgtgtgatcttgggcaagtctctgtgccagcttgttaaaacagaaggaggattattaaactggatgaattactagatgaattagaacaactactaggtggctttttaaattctttgtgtgatattgacaatacaagactatgtctataactcttaagagatcatttcccaagtcagggtctagaaggcgatatctagaaacctctaaaaacaaaaaagactgagctttcctggtcttcaggaagtggcctgggacttacttcatctcctggctcagagttaagaactaggcttgccttgcagagagacagaatttgacctggtagaggaaatcatttcctaaaggtagagcaaggtgtctgtggagtttgtgagcttcctactcttagagatatgtcaccagaggccttaggacacttaataggaatactcaaaagagcatgagatagcagataggactgaataccctttaaggatcttgctagccctaagatttcttggtcttcttggcctatcagagctaaggacaaagaggattacccttctcatcagacattgggcctagtacccagggacaatagccttgtgcttgggaaggtgtggggaccttctagaatgagccacagctcaacccttggttgtatggcatggagtctttaagaggagcaaggttctcattgctttcagaatgatctagccagtgtctctcatctccaaagttactttgagaagcagaaagcagaatggcagacagaacctcaggagccccccatccctgagtccctggccgctgcagccgctgccgcccaacagctccaagtggctaggaagcaggatactcggcagacggccaccttcaggcagcagcccccacctatgaaggtaagtgagctgggtaatggttgtggaggaagcaaagtatcctcccatggaagggccgtggaaggctagttctgggtctttggctttatttatgctgggccttcttttaatggcctttgcttgtgacacagtggaaggggtgacatgggtgtgctgtgttggacacacacagcacaggttttgttgccccatgttcccagaggtgttagaatgcagggagattttcaggccctgctagagtgcaattctaaaagttagaaatgactcttacacaaagatgtaatgagcatgtatcataaatgagggaaccagcaggattataaagctggttccaggagcatttggaacaaatatctatatagtcaagaaaggagaggaaggctgaaacaaatttgcaaagttagatgcaaaactggtttacatcccacaggacaataaaactgtaactttatagttactttttcttccaaacagaagtaatttgcatctctactgggcaaaagccatttgcagcttatcagtgtaacatcacagagcctgggtcctaatcaattggtaaatagtcaaacaaagagacattcttctagagcaggggtcatcaaattacagcctacaggtcaaatctaatctgttccctgttttcgttaaagttttattggcccacatgcatgtctgtgtttgcaagctattgcaaacaacatgcatgcaagctattgtctatcacttctttcatgcaaaacagaattgagtagttgcagcaagtttatatgatgtaaaaagtctaaagtatttgctgtcctggcctttacagaaaatgtttgttgacccctgttctagaaaattaaatagtccttaagtgggcctgttagacaatgcttcattataatgacgaaaagatgtgtagttctcattttgccttactttctagttttgtatactttttctcaacaccattctctgaactgggttatgtccttccttcccatcttccatggcatccaagaatacttgagtctactcactgattattgctctcttctgatgggaaatcactttgctttctgggcccctggggaatcagaagtctaagttgttgcctggaagaatctgactactaactttctttttcctgtgtccctcaccaggcctgcttgtcatgtcaccagcaaattcaccggaatgcacctatatgccctctttgcaaggccaagagtcggtcccggaaccccaaaaagccgaaacggaagcaggatgaataaagaaagggagagcacatgaagctttgctaattataacccctcaccttgaccagagtcattgatgtcctgatgtgaaacaacccttgcccaaccccacgaagtctcctatttaatgtgatggaagcacaacccctctctcactttgctcctatttctttctgctcttgggatttctggtttaggaagagatgtggttcaggtgctaaacagtgtgtctgatgatcccttctctcccactcacatttcaacccctgcccttgtttggagctaagggaagggcaaaaggctcagatatgattctctatctcttgtgcctgaggcctggagcctaaggagctgtagggtctgaggggcaggggaggcccatatcttgtttcaggta

SEQ ID NO: 4648 - DNA, 60163 bp, human
cctgaagctccggactacagctcccaggcctctccaagcccctaccgcacaggctcatagccccaagcccggaggaggtggctacattgtgtctattgtatcccttggctggtgtatttgtacatctctcgggacgtgaaattgacagtgaaaagtatggcagatgagcaagaaatcatgtgcaaattggaaagcattaaagagatcaggtaagtggcacgttgtccccctccccgcccctctccaacccttcgttgcgggagagggctaattatctattgttgggctgtttgtctagaggagctggaaaggggcccattcaccacagacttgccggagaggtgaggatgggaggggcgctgaggagagttgagagagagagagacctcttgccagatgtggctgagaaagcaaagatgaagaaacacgggtttggtaccaagacagttttattcttctcgaggtggaggtcagggctctgcattcatggacacgttttttaaaagtacttgtgtgccccaaggtgtctttggctccttgctctttaggagtcgggatttttttccagtctcttgttcaacttcagaacctggagttcgggaaaggcttttgagagccaagtctagcgcatcggggctggtggctgctgccaggggctgccaactgggggttgcagaggaatctcagcgggcggagctgggagaatggcgcgcgctcgttttcctttcactcactcgccactttcttccttcctatcccgcgcttgggagggggatgggagcaatggggactggggacgcggtcgctgcgctgatggtgggatcgcgacagctgctctgaggagctggaggtgacaggcgggctggcaaagtgggagttgccgaagtggagtccgctacacggttgctcctggagcagcttttggcaaagcgatgatattgtccttgctcagaacacaatagcgccaggcgggctgtgtgggctggcacaaggtctttcttcacctcgccttctcagcgtgagcccctgctttggcttttgctctcactctgagagtggcctgggtcaagctctctccctggagtgttttctgagaacccaaggtggaagatgtcaagtgtgtttctttaagaaataagactttgatcatgagatttaacccttagagtgctggatgagacctacacatggtgattagtggtggtaggtaaagcaccttggtttcttcttcttcttgaggggttgcatctctctttctacaggagaggtaaaggaagggaactatcatttattgagtcccttcccgcccctgtgtgccaggccctttgacctacttttgctcattcagcaagagtcctgtgagcttcctactcctcctttacagctggggaaatagaggcccagagaatttgagtgattttcccacagccacgcagcttgaaattgccacattttgttggtctgcctgcaaaggtattccttttcccactatgtcccaggtaaagtctggaaaggagaagggaatatgttgcaattttttttttttttttttttttttttggcaaaagcatcagaagctagctagaaagtgagacaccttagtacagtagaatgccagctgtcataacgatgcagctagtcagaagcttaggcttgcaaatggagagcctagacttccactctcaccaagcttcaaaggaaccaccaccccatgcccagagaaggaccagttgtgagcaaggactttaatccccagtgaaaatagacctctcccagtgaagaccatatggagaaccatgacttctacccttaccagtggtaactaggagtttctacctcaaccagctaggatggaatcagcataggcccagagagaaggccaaactttcacctctaaacagcagtaacaaacagcccttctccaaactggatgtcaagagacagtggagaaactggacttctactgtccctcttccatccaagagagtggtagaggactgctaaaacaaaagatttaaataagatccagagtatccaacttttaatcaaaaatcactttccatactaagatatccacttgaatgagaagagaaaataaacagatgccaatactgagataacacccatgttagaattatctgataaggatcttaaagcacctgtcctaaaaacatttcagtgagcagttacaatacacttgaaacaaatgataatgtagaaaatctcagaaaatgaatagaaagtctcaacaaagaaatataaaacataaagaagaacaaagtgacatttttagaactgaaaaatacagtaacataaaaaccccaaaaaactcaatggataggttcaacagtaaggtggagaagagagagggaaaaaatagcttacaaatataaaacaatagaaatcactgtggcactataacaaaagctttaacatttatgccaacaaattcccaggagaaagagggcaggattggaaaagtattgggaaaaataatgactaaaatcttcccaaattgtgcaaaagacataaacatttagattcaagaagaggagcaaacaccaacataattgacacaaagaaacacactccaaaacacattgtaatcaaccttctgaaaatgaaagaaaaaggaaacttcttcaaaacagctgaagagaaacaaaagctacaaaggaaaaaaaaaattagaatgacagatttatcatcagaaactgacgatgccctagcattttgtaagtgctgaaggaaaagaagtgacaacccataaatctatgtccaataataatatccttcagtattgaatgggtaatcaagacattctccaatgaagaaatactaaggaatttagatataccctaaaaaaagatgatagtaagctctgaaaacagaaaagaaacaataaacagtaagcaaaagcatggttaatgcagtagactttctctttcctcttgaaatttcttgtattttgataattgaagctaaatttatactgttatctagtgtggtctcagcatatgtagaggaaatatttaacacatttatattgtaaactggggaatgtaaaggggattgtaaatgtaaagagatgtaaaggggaggacatgcttctacacttcattcaagcatgtaaagtggtaatgtcagaagactattaaataaattatgtatacataatatattactgagagaaaacactgaaaatgctatacaaagaaatgtactcaaaacattataaataaatcaatatgaatttttaaaaaatgctccagtcacccacaggcaggcagggcaaagaaaatggagaaactaaaattacggagaatgaacagaaaaaaaaataaaaaggcagacttagccttcatgtatcaataattatgttcacaacaaatagtctaaataccttgcaaacattaatcaaaataaagcaggaatggccatcttaatatcaaataaaacagacttcagagcaaagaaaattcctagagatggatattacataatgaaaaatagtcaatctaccaagaagacataacaattccaaatgtgtgtgttccaaaagtgacttaaattaaactgcttttgacaattttacagtaatatacaaaggttaagccacttggtttaagaatttaaaatggagaaagtactataaatatatacttgatgttcacatatggacagataaacatgtatgagagatagaaataaggaaggagcaaagggtcaaagaaactgaagaaaggaactaacatttgtcaagcaccttttaatttaaaagctcctggctcatttactctttagtcttcccaaaggaaatctgggataggaattattacccccactttacggataaggacattgaggatcagacagattaggcaactttcccatggttacacagctaggaaagaaaaaataatatatcctcctattcacatggcatgcacatttcaatgttattaactgcccttacaaatgctgattatctgattaaccattattcacagttcttcaactgctataatcctaaatctcctgaagtataagcatagcagcatatttctgttaaagaaataatgtttgctggacagaagcaggaatgatgacagcagcatcatctaatgacctattgaagtcaagctaagagccttacacacatcaagacacgagcccagaaatatatgcattcatactcagcactcacaccaatggcagaatttgcagtgggaaaaacatcagaagcagattctcccaccacagaccattttctgcttctaactctgaacacacgcctacccctgtctttcctcccaatcccaatcacactcccacattatgttcccaacctcagcctccaaatcctacactaatctattttgcccatgttttccttggacttttaaatggtgatgaaggagcatgtagataagtggaagaagagagacaagaatggaacaaaagaagggagatagaaaagagggaaagggaggatagcagtaataaaacagagacagtgagtacaggcaccattaaatggaccagagccctacaccagctccccaagtacaaaacaatatttccttaaaatgcacatgccatccattcatgtgtattgcgtacactcacaccccgatgtacacatatccatacacaaagagctttcctcacttgaaaaaaagaaaaaccattttggaaggagatgttgagttaagtaggtactcttaaatgaatgtttctcgactgggtccttcttttctttttttctttctacacactcttttgagtaaattcctgtacttccatggcttcaaatattatcctccaaatctccaacctctataccccacccacattcatgctttagcccatacatatgacagcctactgggcttgtccgcctggaagtttcacagataaatctcagctttatatctacgtctcttcctacagcaatcaagctcctccccttaaacctttggtttaataccaccattctctgcacagttacctcagatggcaatctgaaagtcaatgttgactcccctttctctttaatgactcacctgcaatcacttagttaattctatttctatcctgaatatcttacccaatacctgccccactctccacctcccagttcactgctccatttcaggccttcattatgaattggcatggatatttgtaatgcagtatccatttccatctgaagaattacttccctgtctacagtctctcctctgtctgcaatggcatccacattgccttgagaactaccttcctaaagcatggttgttattttatttctcaaacatcttcactaacttttcattgtgtatgacaatctttttgaaaaatacaggctgcgtcccattattagctcataaaaagaatttagttggtcactagtagcatttttaaaaaaccttttttaaaataaaaaggaaattatcaacatacattgcatatgaagtagtaggtatactttggagaaggttttgtttagttttaaatatgtgtatgtgtgtattgtgtcatgaggtgaaattcatttctcacttacgtcatttcttactgtgtctctgttgaacacacatttacctatcggtgtttccatggcattcatgctgcctccccggaaatctgtcccatacccactattctgaccttatctgctactgctttttattaatcctatcctttagccatatagaagttcttactgttttatatatttccgttccaccagacctttgcctctgcagattcctcgttctagaatgccactctcccattccaagcatctaaatcctactcatttttcaaggaagacccatatgaaatgcctcgtcttctccaaaaccttctcgagttccccagtcaaaatgaattacaataccccaaccacagactccacagggagatttattatagcactcaagttatcccatctaatgatggaattttgaattgatatcctcccttccttcctcccttccttccttccttcccccctccctccctccctcccttcctctcttcctctcttcctcccttcttcctttccttccgccattggtgtggcagtcttggtaagctcctctgttacctggcttggggattgactcagaaccagtgcttactcaagaccaaggcacaggacaactggaacctctgggacttgtggatgggcaaattaagccaaacaatgctggccacaggagagactgaaaaggtgttggcatttggtattgagatgtaagaaagttatcagaatgaactgttataagaaatctactttgctgacagtagctttgtttccagttgagcaaataaatattacatggaagaatgcttagtacttaggcaatattctcaccagactggagtaagcaggaaaaactagctcctttgtgttcattcagtgacatttactgagcataaatctgggccataatcagggctgggctatcctttggtggcccatcacttaggataaataagacccatcagaaggatcttctaatcaaagtcaatagctctgatctctcccttgagttccagactcacatatctaactgcccatttaacttacacccttgcatgtatcactggcatctcaaacaggccctcaactccagccccacccctaaacatttttatttcccagtcttccccatctcagtaaatgcctcactatgctgaaatctggaagccattctttattcctctttttatgtgaccctctccatccacaccattagcatagtggttattatacttgaccatgcaggaggttacacctaaagggcttttaaatcattgattgctgagccccatttccagggtctctgattcagtagatatggagtggggcctgagaatttacatttctaacaagttcccaggcaatgctgctgctggtggtgcagggactacatgtggagaacaactgcattagtaagacctggccagttatacctatacaatataatctggaattgtccacttctcatcatcccctcaacttattaacaaataccagcacttttccatcaatctccagtaaacagtatcttttcacctaattttcccatcttcaaggcctacaggtcccagctgtcctaccctgctttttgagtgtgcattggggctgagtcacctctgaaactgggtgacagatgagcctgccaagtttgtcccagcaatggatgatccatggccctagaacttctccttctttgcacctgtcctcttccatatttgccagaaagaaatcattgaaaagaaggtatccagctgaatgttttatagtcttggctcaggagactgtctggagaacctgtggcctagcagtctgctatgatttgaatgtaccccaaatttcatgtgttgaaacataatcctaccattttgatggtattaagaggagagacctttcgggaagtaattaagtcatgaagcctctgccattatgaatggattagtgccttagaaaatgacttggaatgagtttagacccttttttgtacttctgtgattccaccatatgaagacacaacattcactccctcttgaaaatgcagcaacaaggtgccatcttggaaggagagaccaagcccctcaccagacaccaaatctgttggcacattgatcttaaacttcctagccttcggacctgggagaaataaatttttgttctttacaaattacccagtctgtggtattgtgttatagaagcacaaacagactaggacaggagctcaggaatactggtccaaaagttacctaagactgtcatcctggtgactgtagaaaccctaaagtaccctgaaaaccctgtggtttccctgtggttcacgagtcatactagctgtgctttagcctcttggaaaaatctcattaggaaattttatatataaaattgcatctttaatgatctggatggcttcctcacttgtagggccaaacattccacagatttcatctcattgaagcatccaacaattccatgcaaggctacactgagtcctactttccaggtagaatttccaaggtgccaagagattccatgaagtgcactatttcaccctgaaaattgatgactgagccaggacaagaattcaccctactggcctggtttttatggctttaaatccatcatatgatgaaagttccttgttgtgatggaaaggtgatcagatttacaacgctggattttccacttcctgaatttgtcttcttgggcaagtcactttacttctctcagcctcaaattcttcatgtgtgaaaataaagtgaaacatacctgccgatatggttcttatgaagattaaattttgatagcataaaaagtgcctaatacagttgctggaacatagtaggcaccacaaatataatagctattgttattaaataaagcctttcttaacagacggttgctttcagttcctgtcacttagatagattcttaataaatatgaaccaaatgaatgaaatccttgccacccatggtaatgtcttttcttctctgaggctactgatgctataatcactcccctggatttactacctaccattcagtagtttctcattccaaatgtaatgattgagccccgcttatggccaaagcagaatgataggtgttgtggaggttaaagagagaaatatggcatagtgccactgtctagaaagccctcgtgtatataattactctgatttcaagttgcttcatgcataaatctgtactttttagaggacccagaggaccatgactatgtgccttgtgctagtccctttcccatcctggacctttatttattcacctctgaaataaagaggatagatttcatgggtgactttgaaataatgttctgacgagcccagggaattctaaggagggttttaaagggccactgtgatagagtcaggtggtggttgaatttgaggacagattaatgactctgggggtcccacttccactttaaccataacagttatgatttgttccattttctatattggatctcaatcagttattttatttgaaggaagggatcttatcattcatccacaagaaccagcgcacttctggataaatggtgcttgcttaatacaatttttaagtctgcttgattgatggaagtttgtaaagagggaatttggtattgtgagtacatctaagcagtgactggcatgacactctttgtagattagagagaggaagggccttttatttagatttaatcttagctcaaacttctcaattgctggacagagaatggaaggctgggaattagatgcaaatcctgaagaccatagtaaaggcaatctacctcaaatgcaacaaattatttatttatttatttattattaagccattaagctccttctcatttctcctggctgccttaatcagcaaactttaaaaaaatccattccctctacgtaagccttttgacaagtcatttatttttctgggaaaacatgagcatgcttagaagttatgtttagtgggagttgtaggtttagatttaattctgggtgcagtaagaggtcattacaggataatttgagttatattttatataccataggaaacatccatttcaagtgtacaattcagcatgttttaataaatttaaagagttgtacaatcatcaccataatattttagaaaatttccatcattccaaaattagctctttgttcagtttcagttgatctttgttcttatccacagccccaggaaacctgtaatatattttctgtctaaatagagtggctttttcttgatgctgcatataaatagttatacaaatgtggccttttgggtctgccttcagtcacttagcttattgtttttgagattcattcacattgtaacatgtaacagtatttcattcctttttgttgacaaataatatcccattgcatggatatcgcacattttgggtgttcactcacaagttgaggagcatttcagttatttccactgttttggctcttatgaataatgctgctctgcacatttgtgtacaagtctttttgtggaaaaatgtttccatttctactgcttagattctcaggagtgagatttctgtttcatattgtaagtatatgtataactttttaagatacaagtgtttttgaaagtggatgtcctagtttccatcccaagagggagtgtatgagggtcccagtttctctacatcctcaacaatacttgttagtgtctgcctcaaaaaggcattatagccatcctagtggtgtgatgtgatagctcacagtagttttaacttgcatattcctaatgaccaatcttgttgagtatctcttcatgagtttatttgccacccatatatcctcttctgtgaagtgtttattcaaaccttttgttcattttttaactgggctgtttgtttactgattgtgagttttgagtgttatttacattttctggaaacacatttttaccagacacttgatttgcaaacatgttctcccagtctgggacttatcttttcattgtcttaacagtgtcttttgaattacaatgtctttttttttttttttttttttgcttctttgtttgaaacaggatatcactccgccacccaagctggagttcagcagtgccatcgtggctcactgaagccttgaattcctgggctccagaagttatcccacttcagcttccccaataactggactacaggcttgtgccaccatgcctggctaatttttcttaaatattttgtagagacagggtctcactatgttacccagggtggtcttgaactcctgggctcaagcgatcctcccgccatggcttcccaaagtgttctgattataggtgtgagacaccgcactgagccagaaacttttaatgttgatgaagaaatccaatttatcagtattttttatggattgtgaattcttgtgccatttaggagaaatgtttgcctaagtcgtattcacaaagattttctcctatattttcttccagaaattttatttttaggtttcacgtttaggtctatgatccattttcacttaatttttttgtatgttgcaaggtacgggttaaggattttcttttgcatttggatgttcagctgtttcactatcatttgtttgaaagacttgtccttacatctgtgggtttatttctgacctatctgcttcattgctttatttgtgtatctttatgccaatagtttgctgatttgattactatatctttttaataattacggaaaccaggtcatgtaggttctccaacttcattattcttcctcagaaataattttgactattctaggcgctttgaatttctatgagttttagattccccttgtcagtttctaccaaaaaccatactgggattttaataggattttgttggatctgtagattagtttgttagatttcaccagtgtgtaatgaaataatgtcctatttctgttctaggatctaacccaagataccacattgcatttttatgattccatttaacttattttatgacttattagctataatgctgttttattatttcagtggctgctttagagtttataatatacatccttaacttatcacaacctaccttcaattgagcgcataatactgcacatataatgtaagaaacatacaacactatatttctccctttctggcctctgtgctattgcattttggtactttttggtttaaactgttgattatatttttaagtaacttaattaaggaagaaaataatcatgatatttttctatgtagttaccattttcagtgctctgtattcctttgttttgatacatttccctctgctatcattttccttttgcttgaaggactccctttaacatttgtggtagtgcaagtttgctgatgatatagcattttacctttccttgtgtgaaaagttctcattttacctttgttttcaaagttgttttccctgggtaaataattctatattggcatggatttcgtccgtactttaaaagtgatacaccactgtcatcttgcttccaacattctttgatactctttgtgtaacatatcctttgtttctgactcctttactggttttgagcaatttgattatgatatagcttggtgtgatgttctttatggattttatgcttggagcttgatgaatctattggatcagtgggcgtgtagctttaatcaaatttgaaagatttttggccatttattcttcaaatatttttatcttcctctttcttcttggtcttcagttacctgtatttttaattcaatttaatttaatttgatttaatttaatttaatttaattttactgtggtaaggtcacagaacttgagatctaccctcaacaaattttatatttataatacagtattgttaactagaagcataatgttgtactgcaaatctcttgcagttatcatcctgcacaactgaaactttatacatattgaatagcagctctacgtttccccctccttcagttcctagcaactgccattctactctctgcttctaagaatttgactattttaaatacctcatatgagtggaatcatgcagtatttctccttctgtgattagcttatttcacttaggattatgtccatgttatctcatattgtaggacttccttcttttttaatgcttaataatattccattgcataaatatactacattgttaattcattcatttaggttgttttcatatcttggctattgtaattaatgccatgataaacacgggagtgcagatatctctttgagatcccgatttcaattcttttggacaaatacctagaagtaggagtgctggatttatatatttttatatatttattatacctgttggccatgtttatgttctttggaataatgtttatggaactcctttgcccagtgttcaatcgggttaatagcttttgtactattggtttgtaggatttcttatattttatacaaattaatccattatcagatatatgatttgcaaatatttcatcctttatgcagtttgccattttactctgtttattgtttcctttgctgtgcagaaacattttaatttgatgtgatcctacttggtcatttttgcttttgttgcctgtgcttttggtgtcatatccattaaatcattgccacaagcaaagtcttgaagtttttctcttatggcttcttgtaggagttttgtagtttcagaagttatgttcagtgtttaatacatttgtagttaatttctgtgtatggtataagataagggtccaatgttatacgtttgcatgtggacatagtttttcccatagcatttattgaaaggactatcatttcttgcattgtgtattcttgtaaactttgtcaaagatcaagtgactgtatgtgggtggattcatttctgggctctctgttttttcccatggcctctatgtctgtttttatggcagtaccatactgttttaattactgcagctttgtaatatattataaaatcaggggataagattgttctggctacttggagtttacatgaatgtaaaaaaaaatgccattgggatttttataaggattatattgaatctgtagattgccttgagtagtatggttaagtcttccaatccatgaacatgtatgtcttcccatatgtttgtgtctaccttaatttctttcatcaatacgttatagtttcatttattgctaagtattttgttctttttggtgctatcataagtgggattgtgtctgaatttccttttcagatagtttgttgatagtgtacagaaacacaactgactttgtatgttgattttgcatcttgtaactttactgaattcatttattaattctaacaatctttttggaattttttgggttttgtacaaataagattttgtcaactgaaaacagcaataatcttaccatttccttctcaattttggtgacttttatttcattttcttgtctaattgctctggttaggtctctaggatctatgttgaatagaaatgtcaagagtggacatccttgtctttttgctgatctttcagtgttttaccattaagtatgacttagctgtgggcttttcatatatggcttttattgtgttgaggtaatttccttctatttttagttgttgagagtttctatcaggaaagggtgttgaattttgtcaaaggctttttctgcatttattgagatgatcatgtgactgttatctttcattctgttgatgtgatatagcacattaattgacttttgcatgctgatctctcctcacatcacagggataaattccactggccgtgttgtatgatacttttaatgtgctgttaaatcagtttgctagtcttttgttgaggatttttacctgtatattcatcagagatagtgtcctctagttttcttttcttgtggaatcttcatctagctttattattagggtagtgctaggctcataaaatgagtttggaagtgtcgcctcttcacttttttggaaaagcttgaaaaggattggcattaactcttctttaagtgtctgtcagaagccaccagtgaagccagctggtcctggccttttctttgttgggaagtttttaattactgtttcaatctccttactaactacaggtctattcagattttctatttatacaggactcagtcttgccagattgtatgcttataggaatttatccattttttatgttatccaatttgttgatatgtgattcttcatagtagtcttatgatcctttctacttctttggcatcagttgtagtgtgtcatctttcatctctgatttcaattagttgattcttttctattttctcttagtctagctaaagatttgtcaattttgtttattttttcaaaaaaaaccctcttagttgcattaaaaaaatttgattctttatttggcttatttctgctctctcttcattatttccttcaaaactgaccaataaatcacatggttaatagaattattagctgatgacattaaaagttattataaatccatttcatatgttcaaaaagcttgaggaaaaactgaccaagtagaggcatggcagaaataaaaaagattcaaataaaaagtctatagatgaaaactattatgtctaagatcaaaaaatttcttagtttagaaaaagagggagaaaagattagtgaacttccagaaatagtaatagaaatcatcccaaacaaaatacatagggttaaagatttttaaaaataaacagtatcagcaaattgtgggacaacttcatttggttaaaaatacagataaccgtcatttaaaaacaaagaagaacattatgtaatgataaaacagtcaattcaccagaaatatgcaacaattataaatatatatacacccaatatcagaacactgaactatataaggaaacattgacaaactgatggtagaaatagacagaaagacaataatagtaagagacttcaataccccacttttaataatggatggaacagtcggacagaaaatcaataaaaaacagcaggcttaagaaacactacagaccaaatggaccttacagacatataaaacattaaacccaagagcaacagaatagatactcttcctaactgtacacagaacattctccaggatagaacacattaagacaattagcacatcttaacaaatgtaagaagatcaaaatcctaccaagtatcttttctgaccacagtgaaattcaacagtagaaggaaaactggaaaattcacaaatacccatcttaagggttatatttttcctgcttatttgtacatctggtaatagtaaagtgtgaatggatgccagaaatagtgaatttcatcttgttggttgctgcatgtatttgtattcctatacttagtatcagttttatccctataagtcttgctgttaagcatagttaagtggaaccaaagtagtgctttgtctagaagtcatttccccagtactaatgcaaaaccttctttgtattttaatgctttatgaattgtgaagttcttctaccttggctattggaaataggtccatgtgggctctgatcactgtcccctttgggtggttattttcctggccttatgtagttttcttatacacgtgtgctaatcaatatttaactgaataattggtggagttggatcctctgaaaattgagagagtcccctttttttcattaaaaaaaaattaaaacggtgctattgcaatagagttctctttctacataggtctacactctccaaaactcttttctgaaaaattttgataccttggcttccccagagtcatggctccatttttttcaattgaaggagactagcaggctctgactgagtttcccttccctgcagcctagaatatttatctaggcatgaagatatagccatcttagggctcatctaagcctttccatcttttggagatcactgaccttacttgcctgaagtccagtgacttaagtgctattttttcatataattttgtcagtttttttctgtttttagttatgcctgggagggtaaatcaggtccctgttactctatcttgactagaagtgaaagtcaaggttatttctcaaatatggtttcaaaagatcagattttgtcatttaagacacatattttacattcaaaaatgtaaagtcagggtgtgtcttaaaatccattggtgttttaatcatgcttaaacatgtgactgctgttggccaggatacagttgtggtggtgtcgtcagtatctgagcacatgtgaactttgccatgactattcatattgtcttctcttaaactgaattatgtccatggttgccaacatgtactgtccatagttgccaccatgtatttaggttgtcatttaaaatgtcctcaaaaagatttcaccatgattctccatcaaaatagaaagctattttgtatgaagaagaactcagaccagaaaagtctgataaaaataatctcttaaataagtctacattaggtctttcaatttgtataaaatgtaaattttgaattataagaaaacaatttgttatactgtaattggtagcattttttcttagtagtgtacaaaataatgtgtaccttacattcaaaggcatcctagattcaattaaataaaataactgattagccaggatattaataatgctaatctaagaaagtcctaaaataacagtgtttaaaacaagacagttttaattctccctcacattattgatctgggaacaaggtatttgtggtttgtggtggtgtttgatattggggacctaggctatttttatattgttgcttcactgtatacagggtttcgccctcatctatatgattcaagcccactgttgtgtacacattttatccaataggaaaatagcaatgggaatggttcttccatttatagtcacaatccagaagttgtagacatcatttctgcttccataaaattggccagaaagttgtcatatggtcacaaatagctgcaaaagggatggggtaatatagtccttatttcagacaacttcatgcccagctgaaaatcagagggtctattgctatagaaagaggggagaatgaatttggggagacaggaagtattgtgttgtttaagagagaaatgagatcagctcagggtatattctgctacaggtctccaattgggtgccacccccagtaccttcttaattctccatctttctgaatgcaaacacagatacaagagcccttatgcactgctggtaagagtatgaactgttatagccatcctgctgagcaaattggcactgcttaatcaaagtaagaatgcacattacctgggcccctgaaatccaactcctgggataaatcaccccccaccaccaccaaaaaaaaattactgagacaggtacaaggctattcacttaaatgttattttggaggtggggagattgaggcaaagtgggagtctgtccctggaagagtcaacagataaaatgtggttgatagccatatatagaagcaaggaattctggatattaacttgagattgctgtgtgaaaaccatattttggaaattggccaatataacaatttttatatacacatatatgtacatatatacacacacacaaatacacacacacacacatatacaggcatgtgccatataatgatgtttcagtgaacaatacaccacatataccatagtgtggtccctgaagattacaatggagctgaaaaactcctatcacctagtgacgtacccactgtaacatcatagtgcaatgtattactcacgtttgtgatgatactgcactgccagtcatataaaagtctagcatataaaattatctacagtacatgatacttgaaaatgataacaaatgactatgttactggtgtatgcatttactatactatactttttatcattattttagagtgtactcctcttacttattaaaaaaaaataactgtaaaacaggttcaggctggacttccaggaggtattccagaagaaggcattgttttcatattccttgaagactttccagtgggacaagatgtagagttgggagacagtgatattgacaatcctaaccctgtgtaggcctaggctaatatgtgtgtttctgtctttatttttatttttatttttttttatttttgaaacctggtctcactctctcacccgggctggagtgcaggggcatgatcatggctcattgaagccttgacatcccaggctcaaacaacccttccacctcagcctcccaagtagctaggaccacaggcatgcaccaccacacctggctaatttatatatttttttaatagagatagggtcttcctatgttgcctaggctggtctcaaactcctggcctcaagcgatcctcctgccttggcctcccaaaatgctggggttacagacttgagccactgtgcccagcctgtatctttatgtttaaccaaaaagtccaaaaagtaaaaataaataaataaatacaaacatagaaaaaacgcttatgaaataaggatataaagaaataaaatatttttgtacagctgtacagtatgtttttgtgtcaagctaagtattattgcaaaagagttgttaaaagaaaagcttcagccaaattaaatttaaaggaggttaattgagcaatgaatgattcatgaattgggcagcccttagaattacagcagatgcagagagactccagcacagccatgtagtggaagaagatttatagacaaaagggaagtgacatacagaaatcggaagtgaggtacagaaacaactggattggttacagctcagtgtttgcactatttgaacacagtttgaaccctcagcagtgtatgagtggttgaactatggctgctaggactggccaagactcagctattgttacaggcacatactcctaagttacgttttcaatcttgtctacctaataagttaggttatgctttgtcctcatggactcaaatgtagaagtacagtccttctcaggctatatttagttggctttaacaattcctcccttttggttactttctcaattttgagatgttgaccaaaactttagtcattgatgtcactatcaccattgtaaatgtacttatttggtcttgaaacccactggaaaacagtagaacagtgggttttacaaggtgggaacaaggacagagtagagggtacctccttatgctgtaacatcctgtttgcaggagaaaaacaaaatctggtctgttctaggatctatgtgtttccttaaagtcttagtttgattatgtcatatttagtatgagtgactccatgtttgtttggtttggtctgttagggcctaatgcaagagctcagtccaaaacaatggcctcccataattttgttttaaaactctacttttcgggtcaggttcttacttaggtgagggtgtgaccaaaacttagggccttagtgccactctgttaccatcattttgggtttctggtctcagcgtgtaattcataagttaccatgtgttcatggttgcatatttttttcagctcttgtcatcccagttgaagagagaccatttgatattctatagatggctgcatgcaaacatttaaaacttttgagagaatgcagcgcacaagggagactactattatgactattgggaggataacaccaacagtttgtagtatgctccttacccagggttcccataaatcaaaccacttaaaattaaatagattaaagaatgggctaaagagtctactcacttaactaagcagtctttccattaatcccctacaactgaatttttatattctacattttatgtatttctccataggcgacaagtgccagcagctgcacagatatttttccattgagccaatgctattatttagtataactttcacaagagaatttaaagtctgttgtgtagccatagcctttacagtaaaatctgctatagagcctatcatgagggatacatttttaatcattgcttcttttactccaaaccaaggaagaaagatctaacaaatgatgtcctctagaagagtaaaggcctcctcataatgttcactttaacccatgatgtgggttaagaggagtgaaccaatgttccctttctgactgattatgaggcaacgtgtgtaccgttaaagcttcttgtctacattgagccttcgtcttttatctgtcaaagtataaggttatccatgtataaggctggctgcaaaatccttcacaaataaaagtataccccataagtacacacaacagaccctcttttcacttctattcttcagaggcataagcaaggaaaaaaatagttagacaagaatctcatgatgctagagaagtcttgatctttgatcttgggaaaagctattcacatcagagatgccatcttcttctggggagaaacttcccaggttagctttactttaagggcttcactgggtgtacagttccaagagtgtggagggacccttctcagttgtgagattatgaacttaaaattcaaggtcctgaagttttgctgtagtgtggatggcaaatacagcctttctctgatgttctcagaagatccaatttttgggttctagattgtgaaggggttgattgtcctcagtcagtgatccataaaaactttctttacctggtgaaaataccctgtagcataataatctactgttataacagcaaccctcatacatgggaaaacttttatacaaccagaaaacatgcattgaaaatgacaactgaatgaaattcttatacaaaatgtttaaatggcccatcagctaaccaaatgcacctgaaggtttgattgttttcccaggaatatgggtgtgacaaaccaaatattgttcataaactattttaggaatttagaagacaccacattaatatataattaatttggatcattttgtcttttccatgatgagtcacagaatacagaacctttaataacaaaagctttaacgactcaggaaggacaaagtggctgtcctgcttctccatgagtccatgcttaattaacattagacttatgtcctcttgaataccagttatttctccaaattaggtacatagcactgataactggtgggttatcataggtaatttgacttagaccgtggagtttattcaaactgtatacctaaacaatttcagtattggctgattcagcattcaaatctggcagagtattttcttgttattccataactttctgttctacttgggttagtagttttataaaccagtccaccttttcattaaaatttcaggaattcttatccggtccaaatgatatgattttatagaaacctgtattgaagagtgattttcagggacctttcaatcctttcatgaacctcctaaaagacaccatattctaggattttgcatgcttgtgaaatttttcagaaacagcatcagcattaagcaactaactgtggaaatgacttcaaaggattatagttaaaaacacaattaaaaagaaaacttcattctttctgttgtctacaataacataataaccataataatgattaatagcaagcactcaaacatattagaaattttgaaatccaatacaatttttgagcatatatatatataattataaatatatataattatatatatatatataattatatatatatataattatatatatatatatatataattatactttaagttttagggtacatgtgtacaatgtgcaggtttgctacatatgtatacacgtgccacgtaggtgtgctgcacccattaactcgtcatttacattaggtatatctcctaatgctatatctccccaattcccccaaccccacaacaggccccggtgtatgatgttccccttcctgcgtccatgtgatctcattgttcaattcccacctatgagtgagaacatgcagtgtttggtttttcgtccttgcgatagtttgctgagaatgatggtttccagcttcatccatgtccctacaaaggacatgaactcatcattttttatggctgcatagtattccacggtgtatatatgccacattttcttaatccagtctatcattgttggacatttggcttggttccaagtctttgctattctgaacagtgccacaataaacatacgtgtgcatgtgtctttatagcagcgtgatttatagtcctttgggtatatacccagtaaggggatggctgggtcaagtggtatttctagttctagatccctgaggaatcgccacactgacttctgcaatggttgaactagtttacagtcccaccaacagtgtgaaagtgttcctatttctccacattctctccagcaccctttgttccctgactttttaatgatcgccattctggtgtgagatgctatctcattgtggttttgatttgcatttctctgatggccagtgatgatgagcactttttcatgtgacttatggctgcataaatgtcttcttttgagaagtgtctgttcatatccttcacccacttgttgaaggggttctttgttttttccttgtaaatttgtttcagttctttgcagattctggatattagccctttgtcagatgagtacattgcaaaaattttctcccattctgtaggttgcctgttcaatctgatggtagtttcctttgccgcccagaagctctttagtttacttagatcccatttgtcaatttcggcttttgttgccattgcttttggtgttttagacatgaagtccttgcccatgcctgtgtcctgaatggtattgcctaggttttcttctaaggtttttatggttttaggtctaacatttaggtctttaatccatcttgaattaatttttgtataaggtgtaaggaagggatccagtttcagctttctaatatggctagccagttttcccagcaccatttattaaatagggaatcctttccccattgcttgtttttgtcaggtttctcaaagatcagatagttgtagatatgtggcattatttctgagggttctgttctgttccattggtctatatctctgttttggtaccagtaccatgctgttttggttactgtagccttgtagtatagtttgaagtcaggtagcgtgatgcctccagctttgttcttttggcttagggttgacttggcaatgagggctcttttttggttccatatgaactttacagtagtttttttttccaattctgtgaagaaagtcattggtaacttgatggggatgacattgaatctataaattaccttgggcagtatggccattttcacgatattgattcttgctatccatgtgcatggaatgttcttccatttgtttgtatcctcctttatttcgttgagcagtggtttgtagttctccttgaagaggtccttcacatctcttgtaagttggattcctaggtattttattctctttgaagcaactgtgaaagggagttcactcatgatttggctctctgtttgtctgttattggtgtataagaatgcttgtgatttttgcacattggttttgtatcctaagactttgctgaagttgcttatcagcttgaggagattttgggctgacatgatggggtcaatattgtgaaaatggccatactgcccaaggtaatttatagattcaatgccatccccatcaagctaccaatgactttcttcacagaattggaagaaactacttgaaagttcatatggaaccaaaaaagagcctgcattgccaagtcaatcctaagccaaaagaacaaagctggaggcatcacactacctgacttcaaactatacttcaaggctacagtaaccaaaacagcatggtactggtaccaaaacagagatatagatcaatggaacagaacagagccctcagaaataacgccacatgtctacaactatctgatctttgacaaacctgagaaaaacaagcaatggggaaaggattccctatttaataaatggtgctgggaaaactggctagccatatgtagaaagctgaaactggatcccttccttataccttatacgaaaatcaattcaagatggattaaagacttaaacgttagacctaaaaccataaaaaccctagaagaaaacctaggcattaccattcaggacatacgaattggcaaggacttcatgtctaaaacaccaagagcaatggcaacaaaagccaaaattgacaaatgggatctaattaaactaaagagcttctgcacagcaaaagaaactaccatcagagtgagcaggcaacctacaaaatgggagaaaatttttgcaacctactcatctgacaaagggctaatatccagaatctacaatgaactcaaacaaatttacaagaaaaaacaaacaaccccatcaaaaaatgggcgaaggacatgaacagacacttctcaaaagaagacatttatgcagccaaaaaacgcatgaaaaaatgctcaccatcactggccatgagagaaatgcaaatcaaaaccaaattgagataccatctcacaccagttagaatggcaatcattaaaaagtcaggaaacaacaggtgctggagaggatgtggagaaataggaacacttttacactgttggtgggactgtaaactagttcaaccgttgtggaagtcagtgtggcgattcctcagggatctagaactagaaataccatttgacccagccatcccattactgggtatatacccaaaggagtataagtcatgctgctatacacatgcacacgtatgtttgttgtggcactattcacaatagcagacttggaaccaagccaaatgtccaacaatgacagactggattaagaaaatgtggcacatatataccgtggaatactatgcagccataaaaaatgatgagttcatttcctttgtagggacatggatgaaattggaaatcatcattctcagtaaactatcgcaaggacaaaaaaccaaacaccgcatgttctcactcataggtgggaattgaacaatgagaacacatggacacaggaaggggaacatcacactctggggactgttgtggggtggggagagtggggagctatggcattaggagatatacctaatgctaaatgacgagttaatgggtgcagcacaccagcatggcaaatgtatacatatgtaactaacctgcacattgtggacatgtactctaaaccttaaagtataataataataataatcaaaaataaaaaagaatccagagccatcagtgtgctgtattcaggaaacccatctcacatgtggagacacacataggcttaaaataaagggatggaggaagatctaccaagcaaatggaaaacaaaaaaggtggggattgcaatcctagtctctgataaaacagactttaaaccaaccaagatcaaaagagacaaagaaggtcatttcataatggtaaagggatcaattcaacaagaagagctaactatcctaaatatatatgcacccaatacaggagcacccagattcataaagcaagtccttagagacctagaaagagacttagactcccacacaataataatgggagactttaacatcccactgtcaacatgagacagatcaacgagacagaaagttaaaaaggatatccaggaattgaactcatctctgcaccgagcagacctaatagacatctacagaattctccaccccaagtcaacagaatatacattcttctcagcaccacaccgcacttattccaaaattgaccacatagttggaagtaaagcagtcctacacaaatgtaaaagaacagaaattataacaaactgtctctcagaccacggtgcaatcaaactagaactcaggattaagaaactcactcaaaaccgctcaactacatggaaactgaacaacctgctcctgaatgactgctaagtacataacgaaatgaaggcagaaataaagatgttctttgaaaccaacgtgaacaaagatacaacataccagaacctctgggacacatttaaagcagtgtgtagagggaaatttatatcactaaatgcccacaagagaaagtaggaaagatctaaaattgacaccctaacatcacaattaaaagaactagagaagcaaaagcaaacacattcaaaagctagcagaaggcaagaaataactaagatcagagcagaactgaaggagatagagacacaaaaaacccttcaaaaaatcagtgaatccaggagctggttttttgaaaagtacaacaaaattgatggaccgatagcaagactaataaagaagaaaagagagtagaatcaaatggatgccataaaaaatgataaaggggatatcaccaccaatcccacagaaatacaaactaccatcagagaatactaggaacatatattaatatcattcactaaaatataacctgaggaaagttaatttttttgacagtgcttcccgtgtaacttgctatgtcaaataattctgtttacctttcctctgggtgcttaagggtccctctggagcattccaagttagaggtcgcataatataattttgaagctgcaatttgattttgggaaggccatcaaatatggtaaagttttaaaacagtttgatatgatgaaatggaattctaggtactgtaagtcattcatttagccaaaatgatgactcaaaaaatttaagaaggcaaaaactgttagtcattgataggcagaaaccttagctttccaaacagtctgtctcttgtctttcccttcttttttggtagtttattcaaaaggcaaagaaaaatcttttattgtcctttactattgcatgaaaatcttgttcaagagagaaagcaaaatttcaccctggcattagtgtaccatgaatgttaaccctaattcttaagaaatcttatagacaaattgattcaatcttaatcatttggaccataaggtgagattcccataaaccttttattaccctttacaaatttttgttgaagagcagattagtgctctaagaaaaccctgttgtgcttttatttcaatgttcaagttatggaaaaaataataatacctctttaaatttagtcaatatgtttacagacaaaatttgttttacaatattaatttttacgaaccttttacaacttggtgaaacgtttacctttatcttatgtaatttaaaacaatcatttagccctttaatctaggcaaacatttacattcccatgccttcttataatattttaccaaaaatactttttattgtcttcacacaccttgcatataaaacttttttcagtagtctcaaatacatgttataatggtaactctccagaattttaatttttggtagaaaacctggcaagtaagtaattttaattatgtagtaggtttgtatccaaggaaatcagacagaagtacagataaggtgtgactctttcatcatttctgttagacttcactgcttcccaggttaacatttatgcatgtgttagccagaggaactcagttcttcagaaattaaaaattaaatttgtacctaaaatattggctttgctctcagattcccctgatgaacttagccaatgatttttcctacctaagtgtgcacaaaaaaaaatgtgaaacaaaggggtagaacgtaaaaatcctcatgaatatccagaagccaattttttttcaatttctacaatattgccatttactgccagtttttttctgacccagtcaggtgtaagagccctctaactggatccaagccagttaatcactggaacgaatccaatcctggaccaagtccggtttctatagtgacttataaaccaagtttggatgagaaattcgcccaaagaaactcaaagagctcaaaacacaaatccatgaagctccaaaacccaaaagagaacttaaccaagatctctagctcctctgatagatcaaacgacacaattgggtccttgcagttaccttgcttgttcactcagtgctcctgggggtcgttaaaagttctacttcagatgccacttctgacatcatctgttaaaagaaaaaaatcagccaaattaaatgtaaaggagtttaactgagcaatgaacaattcatgaatcagacagccatcagaatcacagcagattcagggaggccagcacagccacttcatggaagaagatttataaacaaaaaaaaaaaaaagagaagtgacatacacaaattggaagtgaggtacagaaacaactggattggtcacagctcagtgtttgcattattcacagtttgaacactcagcagcgtatcagtggttgaagtatggtttctgggattagccaaggctcagctattgttacagacacatactcctaaattaggttttcagtcttgtctacgtattaaattaggttgtggttcatccacaaggactcaaatatagaagtgcagagtctttctcagccatatttagtttgcttaacagagtaaaaatgtttttaaaaagtttaaagtttataaagtaaaagcattacaataacctaattttaatttattatggaagaaagacatttttaaagataaatttagtttagcctaggtatacagtctaactatagctggagtcttcaacatacctctatcaacatttgataaaacaagccagaaatcatcaaggatatagaaccatcaccatcaaccagcagaatctcattgacatttatagaacacttcacccagcagcaggatacacattctttgcaagtgctcatggaacatataccaaaatagatagaccatttcctgggatataaaataatccccaacaaatttaaaagaacagaaatacagaaatgtgttgtgtgacattaataaaatcaaactaaaaaccagtaaaccagaaaaaattaccagaaaaatctacacacgcttggacactaaacaacatatatctgaatgatgtgtatttcatagagagtctcaagaaaaataaaaatacactaaactgagtgagctgaaaaatatcaaaaattgtgagatgcagtaaaagcagtaatgaaaaaaattaacagcactaaatgcttacattataacagaagagatgccttaaaacaataatctaagctcccacttcaagaaactcgaggaagaagagaaaaataagatgaaggcaagcaaaaaacagaaactaataaaggtaagaacagaaatcaatgaaattgagactagaaaacaacaaagaaatgaatgaaacatttatatatttaaaacaacatatacacatttcatgcacattacctgtgctgtgaaatcccactcctgagatgaatccctggttgttttaagaatctatctatctatttatctatccaaacatatatatttcatatatataaaacaaccagggtttatccccagtgaaatttatatttaaatagacgtgtgtgtgtgtgtgtgtgtgtgtgtgtgtgtgcacgcatttaaaacaaccaaggggtttttccaagatggctgaataggaacagctctgatctgcagttcccagcaagaccaaagcaggaggtgggtgactgctgcatttccaactgaggtacccggttcctctcgttgggactggttagacagcgggtgcagcccacagagggcgagcagaatcagggtggggtgtcaccttacccaggaagtgcaaaggaccagggacctccctgttctagccaagggaagctgtgaggctgtgctatctgccccagatactacgcttttcttatggtttttgcaacctgcagactaggagattccctcatggacctgtaccaccagggccctgggattcaagcacaaaactgggtggctgtttgggtagacactgagctagctggaggaggttttttttgttttgttttgttttggttttggttttttttcccacacgccaggggcacctggaacccaagcgagagagaactgttcactcctctggaaaggcggtggaagccagaaagccaagtgatctcgcttagcaggtcccacccccacagagcccagcaagctaagatccaccagcttgaaattctcactcccagcacagcagtctgaagttgacctgggatgctcgagcttggtggggggaggggcttccaccattactgagacttgagtaggtggttttccccacacagtgtaaacaaagccaccaggaagttctgacttagcggaaaccatcatagcacagcaaagcagctgtggccagactgcctctctagattcctcctccctgggcagggcgtctcgggaaaaaaggcagcagtcccagttaggggctcatagatggaactcccatccctgggacagaacacctgggagaaggggtggctgtgggggcagcttcagcagacttaaatgttcctgcctgccagctctgaagagagcagaggatctcccatcagagtgctagagctatgctaagggatggactgccttgtcaagtgggtccctgacgcctatgcctcctgactgggagacacctcccagcaggagtcaacagacaccgcatacaggagaggtcagggtggcatctggcaggtgcccctctgggatgaagtttccagaggaaggagtaggtggcaatctttgctcttctgcagcctccactggtgatacccaggctaataggatctggagtggaccaccagcaaactccagcagactgcagaagaggggactcactgttagaaggaaaactaacaaacacaaagcaataacatcaacatcgacataaaggatgcccacacaaaaaccccatttaaaggtcattaaagtcaaagatcaaagttaaataaatacacgaagatgaggaaaaaccagtgcaaaaaagatgaaaattccaaaagctacaatgccacctctcctacaaaggatcacaactcctcgccagcaagggcacgaaactggatggagcaagagtttgacgaaatgacagaagtaggcttcagaaggtgggtaataacaaacttctctgagctaaaggagcatgttctaacccaatgcaaggaagctaagaaattttataaaagttgacaagaactgctaactagaataaccagtttagaggaaaacataaattacctgatggagctgaaaacacagcacgagaacttcatgaagcatgcgcaagaatcaatagccaaatcaatgaagcagaagaaaagatattagagattgaagaccaactttaagaaataaagcatgaagacaagattagagaaaaaaaatgaaaaggagcgaacaaagcctccaagaaatatgggactatgtgaaaagactaaatctatgattgactggtgtacctaaaagtgatggggagaatggaaccaagttggaaaacactcttcaggatattatccagaagaacttccccaacttagcaagacaggccaacattcaaattcagaaagtgcagagagcaccactaagatactcctcaagaagagcaaccctaagacacataagcgtcagattcaccaaggttgaaacaaaggaaaaaatgttaaaggcagacagagaaaaaggtcaggttaccaacaaaagaagcccatcagactaacagtggatctctctgcagaaaccctagaagcaagaagagagtgggggtcaatattcaacattcttaaagaaaaaaaattttgagattgagaccatcctggctaacatggtgaaaccccgtctctactaaaaaaatacaaaacaattagccaggcatggtggcaggcacctgtagtcccagctactcgggaggctgaggcaggagaatggcatgaacctgagaggcagcgcttgcagtgagctgagatcacgccactgcactccagcctgggcaacagagcgagactccatctcaaaaaaaaaaaaaaaaagaaaaaagaaaaaaattttaacccagaatttcatatccagctaaaataagcttcacaagcaaaggagaaagaaaatcctttacagacaagcaaatgctgagggattttgtcaccaccaggcctaccattcaagagctcctgaaggaagcaataaatatggaagggaaaaactggtaccagccactgcaaaaacgtaccaaaatacaaaaaccaatgacactaggaagaaactgcatcaactattgtgcaacaaaccagctagcatcatgattacaggatcagattcactcataacaatattaaccttaaatgtaaacaggctaaattccccaattaaaagacagagactggcaaattggataaaaaagactcaagacccatcactgttctgtattaaggagacccatctcatgtgcaaagatacacatgcgctcaaaataaagggatggatgaatatttaccaagcaaatggaaagcaaaaaaaaagcaggggctgcaatcctagtttctgataaaacagaccttaaacaacaaagatcaagaaagacgaaggatattacatgatggaaaagggatcaatgcaacaagaagagctacctatcctaaatatatatgcacccaatacaggagcaccaagattcataaagcaagttcttagagagctacaaagagactaagacttccacacaataatcatgggaaattttaacaccccactctcaatgttagacatatcaatgagatggaaaaaaatacaaggatattcaggacttgaactcagctctagcccaagcggacctaatagacatctacagaactcttcactccagatcaacagaatatacattcttctcagcaccacatagcactttttctaaaatcaaccacataaaggaagtaaaacactcagcaaatacaacagaacagacataataacaaacagtctgtctgaccacagtgtgatcaaattagaactcaggattaagaaactcattcaaaaccatacaacttcaaaagaagacatttatgcagccaacaaacatgaaaaaaagctcatcatcactggtcattagagaaatgcatatcaaaaccacaatgagataccatctcacaccacttagaatggtgatcattaaaaagtcaggaaacaaaagacgcagtagaggatgtggagaaataggaacacttttacactgttggtgggagtgtaaattagttcaacccttgtgaaagacagtgtggtgattattcaaggatctaattagaaataccatctgacccagcaatcccattactgggtatatacccaaaggattctaaatcattgtactataaagacacatgcacatgtttgcttattgcagcagtattcacaagagcaaaaacttggaaccaatgcaaatgcccatcaatgatagactggataatgaaaatgtggcattatacaccatggaatactatgcaaccagaaaaaagaaggagttcatgtcccttgcatagacattgatgaagctgaaaaccatcattctcagcaaactaacacaggaacagaaaaccaaacaccacatattctcactcataagtgggagttgaacaatgagaacatacaggcacaaggagggaaacatcacacaccaggacctgttggggggtgggggggcaaggggagagatagcatttggagaaatatgtaatgtagatgacaggttgatgggtgcagcaaaccaccttggcacaaacctgcacattctgcacatgtatcccagaaattaaagtataataaaaaaatcaatgaatctaggagctggttttgggaaagattaacaaaatagacggctagccagactaataaaaaagaaaagagaagaatcaaatagacacaataagtagtgataaaggggatatcaacactgaccccatggaaataaaaactaccatcagagaatactaaaaacacctttatgcaaataaactagaaaaatctagaagaaatggataaatttctggacacaaacacactcccaagactaaactagagggaagttgaatccctaattacaccaataacaacttctgaaaatgaggcaataattaatagcctaccaaccaaaaaaaagtccagggccaggcggattcacagccaaattctatcaaaggtaaaaagaggagatggtacaatttcttctgaaactattccaaacagtagaaaaagagggactcctccctaactcattttatgaggccagcattattctgataccaaatcctggcagagacacaacagcaacaacaataacaaagaaaatttcaggccaatattgctgattaacatcaatgagaaatactggcaaaccgaatccagcagcacatcaaaaagctcattcaccatgatcaggttggtttcatccctgggatgcaaggctagttcaacatatgcaaatcaataaacgtaatccatcacataaacagaaacaatgacaaaaacctcatgattatttcaatagatgcagaaaagacattcgataaaattcaacacctcttcatgctaaaaacattccataaactaggtattgatggaacatatctcaaaataataagagctatttatgacaaacccatagccaatatcatactgaatgggcaaaagctggaagcattccctttgaaattcagcaaaagacaagaatgacctctctcaccactcctagtcaacatagtattggaagttctggccagggcaatcaggcaagagaaggaaataatggtattcaaataggaagagaggaagtcaaattgtctctgtttgcaaatgacatgatggtatattcagaaaaccccattgtctcagcccaaagctccttaagctcataagcaactttagcaaagtctcaggatagaaaatcaatgtgcaaaaatcacaagcattcctatacaccaataatagacacacagagagccaaatcatgagtgaactcccattcacaattgctattaagagaataaaatacctaggaatacaacttacaaaggatgtgaaggactgcttcaaggagaactacaaaccactgctcaaggaaataaggacacaaacaaatggaaaaacattccatgctcatggataggaagaatcaatatcgtgaaaatgaccatactgcccaaagtaattcatagattcaatgctattcccatcaagctaccattgaatttattcacagaattaggaaaaagtactttaaatttcatgtggaaccaaaaaagagcccgtatagcaaagacagtcctaagcaaaaagaacaaagctggggatatcacgctacctgacttcaaattatactacaaggctatggtaaccaaaacaccatggtactggtaccaaaacagatatatagaccaacggaacagaacagaggcctcagaaataacaccacacatctacaaccatctgatctttcaccagtctgacaaaaacaagcaatggggaaaggattccccatttaatatgtagtgttgggaaaacaggctagccatatgcagaaaactgaaactggaccccttccttacaccttatacaaaaattaactcaggatgaattaaagacttaaatgtaagacctaaaatcataaaaaagaaaacccaggcagtaccattcaggacataggcatgggcaaagacttcatgactggaacaccaaaagcaattgcaatgaaagcaaaattgacaaatgggatctcattaaactaaagagcttctgcacagcaaaagaaactatcatcagagtgaacaggcaacctacagaatgggagaaaatttttacaatctatccatctgacaaaggtctaatatccagatcctacaaggatcttaaacaagtttactagaaaaaaccaaccccattaaaaagtgggtgaaggttatgaacagacaattctcagaagaagacatttatgtggccaacaaacatatgaagaaaagctcgtcatcactggtcattagagaaatgcaaatcaaaaccaaaatgtgatagtatctcatggcagttagaatggtgatcattaaaacgtcaggaaacaacagaagctggagaggatgtggagaaataaggaagcttttataataattgcaaaaattttctcccattctttaggttgcctgttcccactgataatagtttcttttgctgtgcagaagctctttagtttagttagatcccttttgtcaatttttgcttttggtgccattatttttggtgttttggacatgaagtctgtgcccattactatgtcctgaatggtattgcctaggttttcttctaggatttttatgattttaggtgttatgtttaagtctttcatccatcttgagtaaatctttgtataaggtgtaagtaaggggtcgagtttcagttttctgcatctggctagccagttttgccaacaccatttattaaatagggaatcctttccccattgcttgtttgtgtcaggttggtcaaagatcagatggttgtagatgtgtggtgttatttccgaggcctctgttctgttctatgtatctgttttggtaccagtagcatgcagtttcggtttctgtaaccttgtagtatagtttgaagtcaggtatcgtaacacctccagctttgttctttttgcttaggagtgtcttggctatgtgggctcttttttggttccatatgaagttaaaagtagtttttttccaattctgtgaataaagtcaatggtatcttgatggggatagcattgaatctataaattactttgggcagtatggcaatttttacgatactgattcttcctatccataagcatggaatgtttttccatttgtttgtgtcctctcttatttccttgagcagtggtttgaagttctccttgaagataaccttcacatcccttgaaagttgtattcctaggtattttattctcttagtagcaatggtgaatgggagttcactcatgatttggctctctatgtgtctattattggtgtataggaatgcttgtgatttttgcacattgattttgtatcctgagactttgctgaaattgcttatcagcttaaggagattttgagatgagacaatgaggttttctaaatatatgatcatgtcatctgcaaatagagacaatttgacttcctctctttctatttgaataccctttatttctttcatttgcctgattgtcgtggccagaaattccaatactatgtggaatagaagtggtgagagagggcatccatgtcttgtgccagttttcaaagcaaatgcttccagctgttgcccattaagtatgatattcgctgtaggtttgtcataaataggtcttattattttgagatacatttcattgatacctggtttattgagagtttttagcataaaggggtgttgaattatgtcacaggccttttctgcatctagtgagataatcatgtgacttttttgtcattggttatgtttatgtgatggattgcatttattgatttgcatatgttgaactaactttgcatcccaggtatggagccaacttgatcgtagtggataagctttttaatgtgctgctggattcagtttgccagtattttattgaggattttcacatcgatgttcatcagggatattggcctgaaatttcccttttttgttgtgtctctgccaggttttggtacccggatgatggtggcctcataaaacaagttagagagtattccctctttttctgttgtttggaatagtttcagaaggaatggtataagctgctctttgtacctctggtagaattcggctgtgaatccgtctggtcctggactttttttggttggtagtctgttaattactgcctcaatttcagaacttgttattagtctattcagagattcgacttcttcctggtttagacttgagggggtgtatttgtccaggaatttctccatttcttctagattttctagtttatttgcatagaggtgttcatagtattctctgatgatagtttgtatttctgtgggatcagtagtgatatgccctatgtcgttttttactgtgtctatttgattcttctgtcttttcttctttattagtctggctagcagactatctattttgatgacttttttcaaaaaccagctcttgaattcattgatttttttgaaggttttttcatgtctctagctccttcagttctgttctgatcttagttaattcttgtcttctgcgagcttttgaatttgtttgctcttgcttctctagttcttttcattgtgatgttagggtgtcaattttagatcttttctgctttctcttgtggggatttagtggtataaatgcccctctacacactgctttaattgtgtcccagagatcctggtacgttgtatctctgttctcattggtttcgaagaacatctttatttctgccttcatttcattaattacctagttgtcattcaggagcagattgttcagtttgcatgtagttgtgtggttttgagtgaatttcttaattctgagttctaatttaattgcactgtggtctgagagactgttatgattttcattgttttgcatttgctgaggagtgttttacttctaattatgtggtaaattttagaataagtgcaatgagttgctgagaagaatatatattcttttggtttggagtggagagttctgtagatatctattaggtcagcttggtctagagctgagttcaagtcctgaatattcttgttaattctctttttcgttgatctgtctaatattgacagtggggtgttaaagtctcccactattattgtgtgggagtctgtgtttctttgcaggtctctaagaacttgctttatgaatctgggtgttcctgtattgggtgcatatatatttagaatagttagctcctcttgttgcattgatccctctaacattatgtaatgcccttctttgtctcttttgaccaacaaacacaaccaacaggttagtttcaagtctgctttaccagagattaggattgcaaccccagcttttttttttttctttccatttgcttggtaaatattactctgtctctttattttgagcctatgtgtgtctttgcatgtgagatgggtcccctgaatacagcacactgatggatcttgactctttatccattttgccagtctgtgtcttttaactggggcatttagctcgtttacatttaaggttaatattgttatgtgtgaatatgattctgtcaatttgatgctagctggttattttgcccatttgttgcagtttcttcatagtgtcaatggtctttacaatttgttgtttttgcagtgactggtacctgttgtttctttctatgtttagtgcttccttcaggaggtcttgtaaggcaggcctggtggtgacagaatctctcagcatttgcttgtctgtaaaggattttttttctccttcacttatgaagcttagtttgggtggatatgaaattctgggtttaaaattcttttctttaaaaatgttgaatactggcccccactctcttctggcttctagggtttctgcagagagatctgctgttagtctgatgggcttccctttgtgggtaacccgacctttctctctggcttcccttaacattttttcctttgtttcaaccttggtgaatctgatgattatatgtcttggggttgctcttctcaaggagtatctttgaggtgttctctgtatttcccgaatttgaatgttggtctgtgttgctaggctagtgaagttctcctggataatatcctgaagagtgttttccctgttggttccattctacccatcactttcaggtacaccaatgaaacgtaggtttggtcttttcacatagtcccatatttcttggaggctttgtttgttcctctttattcttttttctctaatcttgtcttcacgctttatttcattaatttgatcttcaatctctgatatactttcttctgcttggtcgattccactattgattcttgtgtatgcttcacgaagttcttgtgccatggtttttatccccatcaggtcatttatgttcttctctaaactggttattctagttagcaattcctctaacctttttcaatgttcttagcttccttgcattgtgttagaacatgctcctttagctcagaggagtttgttattacccaccttccgaagcctaattctgtctgttcatcaaactcattctccatctggttttgttcccttgctgatgaggagttgtgatcctttagaggagaagaggcattctggttttcatctttgtagatttatttacctttggtttttatgttagtgaccttagaatggggtctctgagtggatgtgttattcctttatgtttgttagttttccttctaacagtcgggcccctctgctgcaggtctgctggaatttgctggaggtccactccagaccctgtttgcctgggtatcaccagcggaggctgaagaacggcaacgattgctgcctgttctttcctctggaagttttctcccagaggggcacctgccagatgccagccagagctctcctgtatgaggagtctgttggcccctactgagaggtatctcccactcaggaaacatgggggtcagggactcacttgaggaggcaatctgtcccttagcagagcttgaatgctgtgctgggaggtccactgctctcttcagagctgtcacacagtgacctttaagtctgccgaagctgtgtccaccactgccccttcccactggtgctctgtcccagggagataggggttttatctataagtccctgactggggctcctgcctttttttcagagatgccctgcccagagaggagaaatctggcagtctggccacagcaaacttgctgagctgccatgggctctacccattttgaacttccctgaggcttctttacactgtgaggggaaaactgcctactcaagcctcagaaatggcggacgcccctcctcccaccaaactcgagtgtcccagtcggtatcagactgctgctgtgctggcagagagaatttcaagccagtggatcttagtttgctgggatccatggggttggaacccactgagcaagactacttggctccctggcttcagccgctttccaggggagtgaacatttttttctcgctggcccttaaggtatgggggaaaaaaaaaaaaccctgcagctagttcagcgtctgcccaaagggccgcccagttttgtgctggaaacccagggtcctggtggtgtaggcaccgaaggggatctcctggtctgcgggttgtgaagactgtgggaaaagcacagtatttgagttatagtgcacaatgcagtccctaatggcttcccttggctgggagatggagttccccgaccccttgcacttcccagttgaggcgatgccccaccttgctttggctcgtccttcttggtctgcacccactgtccaaccagtcccaatgagatgaactgtgtacctcagttggaaatgcagaaatcacccaccttctgttttgatctcactgtgagctgcagacagagctgttcctatttggccatcttgccagcaatcaagacacaaattttctgatatcaggaatgaaatagaggatattgctgcagaccccacaggcatcaaaagaataataactatgaacaactgtgtacgtgtaaattggacaaattgcatgaaatggaccagtttatccaaacactaccacagttcacccacaatatattagagaatttgaataaccctatgtcactatttaggaaattgaatttgtaatttaacagtttccaaaaattgaatcttcaggcccagatgttacaatggagtaaaaatgttaaaaattttggagaatattccacatgtttaaggagaatcttccagtcactgcaatctgtttctcaggaagccacagtcctagcagaagggaccacaacaaggtaacaccctgtgggacaaaagaatctgaatagcaggtcttctctcccaggtctctctgctgataggatcagaggtgtccatctgacctgaatagccagaacactgggacaaggttgaggctgtgagttggatagctttcctgcttgcctggcaggggaattgaggtagcttccactcttcacccttataaaacctcagcacatctcattgagagctcctccaacacccttatcaagtctggggtcttagcctaccattatgtatgacatctcacctgccttagctacaactggtgcctatacaggaatatgtttcctcttgacctgaagcctgaatcatcaactcagcaagtataaaaatgggggaaaattaaataaacaaataaagtgtacaccatgagagaaggaaataagctttaagagatccctgccattctgaccccataagaaacagtgaacttgcccacacaccaagaacttaactactaaaaccatcatctgggaaagccagttggaaaagattctctataaataaggaactcatacagagttttcatcctaaaatcaccaagaatcaaactaggctaaaataaacattggcgtatgatccttaagaaagaaaaaaagaagttaaaaaaaaccacagtccaataaaaaataaattcaagaacaatttgattagtctacccaaatgagaaggaagcaggaaagtaattctggtaatatgacaagacagggttctaaatcatcctgaaaagatcctactagctccccagcattggatccaaaccaagaagaaatctctgaagtgccagataaagaattcataaggttgattagtaagctactcaagaagacaacagagaaaggtgaaaaccaacttaaattttaaaaaatcaggatataattaaaattttttcagaggaatagatatcataaaggaaaaaacaatgagagctactggaaatgaaagacacacttagggaaatacaaaatacagtggaaaattttaacaataagctagaacaagtagaagaaagaatttcagagcttgaagacaagactttcgaaataacccaaacagacaaatacaaataaaaaagaatgaaataaatgaacaaagtctccaaggaatatgggattatgtaaaatgaccaaacctaagaataagtggtgattctaagaaagaacagaaatctaaaagtttggaaaacttatttgagggaataattgaggaaaacttccctggccttgctagaggtctagacatccaaactgaagaagtcaaaagaactcctgggaaattcattccaaaacaatcatcattaaggcacagggtcaccaggttatctaaagtcaagattaaaaaaaacataattttaagagctgtgagataaaagataacctataaagcaaaacctatcagattaacagcagatttctcagcagaagctttacaagtcagaagggattggagtcttacctttcacctcctgaaacaaaataatgtcaccctaaaattttctatctagcaaaactaagcttcataaatgaaaggaagataaagtcttcttcaaaaacaaatcctgacagaatttgccacccccaaacaagcactacaataaatgctaaaaggagttctaaatgttgaaagaaaaccttgatatacaccaaaatataaccttcttaaagcataaatctcacagggcctataaaacagtaacacaatgaaaaaaatccaaaacatataggcaacaactacatgataagtacaacagtacctcacatttcaatactaacatcgaatgtaaatgggcctcaacgctacacttaaaagatacataatagcagaatgaattaaataaaccaccaaccaagtatgtgttgttttcaagagactcacctaatgcataaggactcatgtaagcttaaggtaaaggggtggtaaaaaatattccacacaaatggaaaccaaaagcaagcaggagtagctattcttatatcagacaaaacagactttaaagcaacaacagtttaaaaaaaaaagacaagcaaggacattgtataatgataaaaggattagtccaacaggaaaatatcaccatcctaaattatatgcacctaacactggagcacctaaatttataaaacaattggtactagacataagaaatgagataaacaacaacacaataatattggaggacttcaatactatacttacagcactagacagatcatcaagacagaaagtcaacaaagaaacagtggacttaaactataccctagaacaaacagaattaacatatatttacaaaacattatttccaacaactacagaatatgcattctttttttcagtgtatggaacattctccaagatagaccatatcataggtcacacaacaagtttctataaatttaagaaaatcaaaattatatcaagcattttctcagaccacaggggaataaaattggaaatcaacttcaaaaagaaccctcaaaactatagaaatacatggaaagtaagtaatctgctcttgaatgagctttgggtcaacaatgaaatcaagatagaaatttaaaaattatttgaaatgaatgataatagttacacagcttacaaaaacctgtgggatacagcaaaagtggtgctaagacaaaagttcatggtgttaaatgcatcaatcaaaaagtctgaaagagcacaaatggacaacccaatgtcacacctcaaggaacaagggaaacaagaacaaactaaactcaaacccagcagaagaaaagaaataacaagatcagagcaaaactcaatgaaactggaacaaacaaaaacaatgcaaaagataaatgaaacaaaaagctgattctctgaaaagataagcaaaattgatagactgttagtgagattaaccaagaaaagatccaaatgaactcaatcagaaatgagactggagatattacaactgataccatggaaatacaaaagataattgaagtgtactatgaacaccttttcacacacaaactagaatgtgtagaggatgtggacaagttcctggaaatatacaagcctcctagattaaatcaggaagaaacagaaaccctgaacagaccaataacaaaaagcaagattgaaactgtaattttaaaattgccaacaaaataagttcagaaccaggtggattcacagctgaattctatcagacattcaaataagaattggtaccaatcctactgaaaccattccaaaagacagtaaaagaagaaatcctcattaaatcattctatgaagccagtgtcaccccaatacccaaaccaagaaagaacacaaccaaaaacgctacagaccaataccctgatgaacatagattcaaaaatcctcagcaaaatactagctacccaaatccaacagcatattaaaaagataatacaccatgatcaagtcagttttatcatagggatgcaggtatagtttaacatacacaagtcaataaatgtgatacatcacataaacagaatcaaaataaaaaatcatatgattagctcaatagatgcagaaaaagcatctgataaaattatcccttttttataaaaacactcacaaaaactggcatagaagagacatacctcaagataataaaagccatctatgacatacccacaggcaacattatactgaatggggaaaaattgaaaacattccccgtgagaactggaacaagacaaggatgcctattgtcaccacttctattgaacatagtactggaagtcatagccagtgtaatcagacaagagaaagaagtaaagagcatccaaattggaaaagtggaagtcaaaatgtcactgtttgccaatgatatgatcatatgcctagaataccctaaagaataatccaaaagctccttggcctgataaacgaattcagtaaagtctcaggatacaacatcaatgtacacaaatcagtagcactgctatataccaacaatgactaagctgagaattaaatcaagaagtcaacccattttacaacagccgcaaaaataataataataagatatttagaaataaccaaggaggtgaaagatatctgcaaggaaaactacaaaacactcctaaaaaagatcatagatgacacaaacaaatggcaacatattccatgctcatggaggggtagaatcaatagtatgaaaatgaccatactgcccaaagtaatccacagattcaatgcaattctaatcaaaataccatcatcattctttacagaacaagaaaaaagcaatctaaaattcatatggaaccaaaagagagcccacatggctaaagcaagactaagaaaaaggaacaaatctggaagcatcacatttcccgacatcaaattatactacaaagctataagctaccaaaacagcatggtaatggtataaaaataggcatgaagaccaatgaaagacaatagaaaacccagaaataaggccaaatacttacggccttctgtaagtattgacaaagcatacaaaaacataaagtggggaaaggacaccctattcaataaatggtgctgggaaaactggcaagccacatgtagaagaatgaaactagatcctcacctctcaccttatacaaaaattaactcaaaatggatcaaatacttaaatctaagaactgaaactataaaaatactagaaggtagcattgggaaacttttctggacattggcttaggcaaagaattcatgactaagactccaaaatcaaacgcaactaaaacaaaaataaataaatgggacctaattaaactaaaaatcttctgtacagtgaaattatcagcagagtaaacagacagcctatagagtgggggaaaatatttgcaaactatgcatctgacaaaggactaatacccagaatctacaaggaactcaaacaaataagcaaaaacaacaaaaaaaatcccatcaaaaagtgggcaaaggggcaggtgcagtgactcacgcctgtagtcccacaactttgggagtccaaggaaggcagatcactggaggccaggagtttgagactagcctggccagtatggcgaaatcctgcctctactaaaaagaaaacacaaaaattagctggcacggtggcttatgcttgtggtcccaggtatttgggaggctgaggcatgagaattgcttgagcctgagaggtggaggttgcagtgagccgagatcatgtcactgtacctcagcctgggtgacagagtgagactgtgcttcaaaaaaaaaaaaaagaaggagaaagagaagaaaagaaggagaagaaggagaaggaggaggaggagaaggaggaggaggaagagaagaagaagaaggagaagaagaaggagaagaaaaagaagaagaagagaagaagaaaagaagaagaaaagaagaagaaggagaaggagaagaagaagaggaggaggagggggaggaggaggagaagaagaagaggaggaggaagaagaagaagaagaagaagaagaagaagaagaagaagaagaagaagaaggagaaagcaggcaaaggacatgaataggaaattctcaaaagaagatatagaaatggctaataatcatatgaaaaacccgcttaacatcactatactatactacaagtctgcagtaaccaaaacagcatggtactagtaccaaaacagatatatagaccaatggaacagaacagagtccttggatttaatgccacaaatctacaaccatctgatctttgacaaacctgacaaaaacaagtgatgtggaaaggattccctatttaataaatggtgttgggaaaactggctagccataagcagaaaaattaaacaggacaccttctttacaccttatacaaaaattaactcaagattgattacagacttaaatgtaagacctaaaaccataaaattcctagaagaaaacctaggcaataccattcaggacataggcatgggcaaagacttcatgactaaaacaccaaaagaaatggcaacaaaagccaaaattgacaaatgggatgtaattaaactaaagagcttctgcatagcgaaaaaaactatcatcagagtgaacaggcaaactacagaaaaaatttttgcaatctatccatctgacaaaagtctaatatccagaatctacaaggaacttaaacaaatttacaagaataaaagaaagaaccccatcaaaaagtgggtgaaggatatgaacagacacttctcaaaagaagacacttaagtggccgtcaaacatatgaaaaaagctcatcatcactggtcattagagaaatccaaatcgaaaccaaaatgagatactatctcacaccagttagaatggtgatcattaaaaagtctgtaaacaacagatgctgattatgtggagaaataggaatgtgtttacactgttggtggaagtgtaaattagttcaaccattgtggaagacagtgtggtgattcctcaaggatctagaaccagaaataccatttgacccagcaattccattactggatatatacccaaaggattataaatcattgtactataaagacacatgcacacatatgtttattgcaacacagttcacaatagcaaagacttggaaccaacccaaatgcccatcagtaatagactggataaagaaaacgtggcacttatacaccttggaatactatgcagccataaaaatggatgagtttatgtcctttgcagggacatggatgaagctggaaaccaccattgtcagcaaactaacacaggaacagaaaactaaacactacatgttctcactcataagtggtagttgaacaaaaagaacacatggacacagggaggggaacatcacacactggggcctgtcggggtggggggctagggtagggatagcattaggagaaatacctaatgtagataacgggttgatcggtgcagcaaaccaccatggcatatgtatacctatgtaacaaacctgcatgttctgcacatgtgtcccagaacttaaagtataataataaaaaaaagaaagaaaaatttgataaattggacttttaaaaaaaatttaaatactcttccaaagaccctttcaaggtgacaaaaaggcaagctactgcgtgggagaaaatattttcagccacatgtctgcggaaatactcaaatctagaatatataaagaaatattaaaactcaacagtgagaaaacaaatatggttgtccctcagtgtatataggggattggtcctaggcctctacctgtaccaaaatttgcacatatccatactcaatcttacagtcagccctgggcatacaaaaagtcagccctccatatatgcaggtattacatcctgtgaatactgtatttttgatccatattttgttgaaaaaaatccatgtacaagtgaatctatgcagttcaaacccatgttcttcaagggtcaatggtaatccagttagaaaatgaaccaaagacatgagcagacatttcatagaaaaggatatatggatggcaaataagtatgtggaaaggtgttcaacatcaatgggcattagggaaatgcaaattaagatcactttgaagtatcactacatatttattatgatagttaaaataaaatagttggccaggtggagggactggatcactcatattttgctggtgggcatgtgaaatgatacactctggaacagttgggcagtttattgaaaagctaaatgtgcaattatcatataacccagcaattgtactcttggatgaaaacttatggttaccataaaacttgtacatggatattcatagtggctttattcataattaccaaaaattagagtgagtctagatgtcctttaatagacattgtttgagattgccattgcatggtggtaataaagagtagaccaactttagttggttttatttttatattttaattttctacacacagcatacccccttattgtcttcaccccagggtagactgttgttactgccctgcacttgatgcaccactattgaaagatattaatggcaccatcaaagcctgcagtgacattgttgtccctccactaaagcaaggaccaggcttccctcagagaaactgactttacaaatagtaaatagaggctctttctgaaacctatcttcgtaaacatatttccctctcctaacaaggagttttggcccttctgccctttagtcagggtcttggtccttggtatttcttgccacagcaggcaatagacaaaggctcccaaagaccttggatggaggcagacattgtggctatgtaccttgtacccaaaggattaagctgccatcttgctggtggcagcccttcaccccagagagaggaaatgccactggtgctttgaggaaggctttgtgcctttgattttccatgtcaagtcagcacttaactgtgaccctggacacatgaggtgaaaaatctttggtttattttggcattaatgtctcttgcccaataacatgggtttctgtaaacagaagtaggcatggagggaggagggaggattacataaaagggactcatccaagcagggctagctgcactatgctgatttctattaaatggcaatgggagataccctcttacccctgatttcagttagtggtagttactttcatcttaatcgaattaattacaaattgggaaggcttgggtcagcttcataaaatgctgttatttatgttgacatttttatgtggctttagctaatatatgttttaattttagattcagggactacatgtgtacatttgttatatgaatatgttgcataatattgaggtttgggcttctagtgtacccatcacccaaatagtgaacattgtacccaataggtaatttttcaacctttattcccttcccattctcccactaatgattattattttaatctcagtaaccagcaatatacctggccactcatgcatgtgcacacacacaaaccctatttgctgtagtggaaaccactctggtgaaggagatatccatggtggaagagttgggcagagtggagaaagaaggaccctatcatttgttgactgcccaccatgtgccacatactctgcttggtgactttacatgtcttagctcatttaatcctcaccacataatgtgtaaagtagatgctattattattcctgtgttactgatgaggaagccaaggctgagggaagtgaagtgagatgatcagataacgtcactcttccggtgcttaaaattataaaattccccttccactgaggataaaagtcccaactcgtcccattctccaagctatgttttagggcctgtcaacctccctagttttatctaggcccctctccctcttgcagtaggtgctccagccacactgctcttcactcagttcctttaatgtgccatattcttcttctgtggggccattactcatgctattctttttgtctggactgttctcctgtgtgcccacctgcactcaccagcgaactcctattgattcttcaggtctcagcttagatttcacatcctcagttctcagggaagcctcctctgactgtcccctttaccctatagtgtccctcagactatgttaggtccctttgttgtatccttctatcacattctgcatctcctccctaccactaatatgattttacatacaaccttgtgttcaggatcgattttcttcattagatgaaacttgctgtctatatactgtcttgttctctgctctatccctagtacctagtacaatgaatgcctggcacatgataagtattcaataaataattattgactgaatatatattgaaaccctctataattaatacatagtaagtgctcaataaatatagttaaaatacagttgttattattgtccaaaagcaaatagttaatcagaggcagaaccaggatttataattgaagtctgagtctaaagcgcatgcttcttttatgatatgactttgtctgcagaaataggttcttggcccagcactgccctaactggttgtatgacacttagggtgagacactatactactctgaatcttagttttcccatcggtaaaatggttacaggagcaggcaaagttcaggtttatcttcacgtaacctagaaaaggaggagaatagaagtctagatagatggggatataagcaaataagtaattaaccaatacaaatcagtatcttccctctgcaagacagttgatgagctataacaagaacccttgatgtttttatgcccttcagcctggtaaccctgttcaaaggcaatatagagtagtggatggtatggatggtatgtaggctttggtgttagagagccctggttcaaatcccaacatccaatttactagctctgtggtactgggcaagttaccaccctgaacctcactcaattcccttctctacaaatgggataacacccaccttttaacccatttctaaggttacaaaaaaaaaaaaaatacaataacatgaaaagatgttttcttagtatagaaagagaaacttctcccaccatcctacccacctaacagttctttctgtagttctgtgccattgaaggctacctcttgaggcaagaggcacaggcaatgtcaagaaaagagagactgaagacaagcaggctgatggcagaagccagagtccagtgtgtggagttggatcacccataggatagactggggcagaggggaagatcagctactgagggagaagaaaggagactacaaatctgagtaaggggataatggctaggcagatcctgagaagcatggtagggagccagtgggaagacaacaacatgccttagagggtacccctttcaaaactttgtagccctttcccagaggcaggcttcaaattatgttattaaaggcccttgaaactgtgtttcttccaaatctttttcttatttagtcacatccatgtatgttttgaaattgtaatcttagtgtgtacactttttcagcgagtatcttatcttcaacattttctatgtcacaagtcttcagtggctgtcaaatatcctaattttgctgaaagcccagaaagtacacctctgtgtattaactttttgcttccttgaattacctccttaaaatatattcccaagtataggattcctgagccacacggtatacaattgggatttaatgaccaaaaccaggtttttctttttctaagaaagaaattacccataatatcctttccccttccttttctggaactgataaacacaccctctagagttgtgctgtctaatatgacagccagtagccacacgtggctgtttaaattttaagtttgattaaataaaattcaaaactcagttcctcagtagcactggccacatcacaagtgctcagtagccatatgtgcatagtggctattatactggacagcacagatacaaaacatttccatcactgtagtaagtttattggacagtgcttacttagagtttctcaagagatcatttttggtttcttgggtgggagttctttgtgttcaggactttcctgggcattgagaggctatttagcatctctggcccatgtccactaaatgccagtaacacatttccttgagtcaatctaacagccaaaacactccatatttgcaaatgccccataagggaacaaaattaaccccattcgagacccactgagcttttagagggaaacatctcctaactttttcttgagacaaggtcttgctctgtcacctaggttggagtgcagtagtgcaatcatagcttaagcaatcctcctgccttatcctcctgagtagttgagactactggcatgtaccaccatgtgtggctaattctttctttctttctttctttttctttttctttttcttttttttttcttttttctttttcttttttttttttgtagatataaggtctcactatgttgcccatgctggtttcaaactcctgggctcaagtgatcctcctgcctctgtcttccaaattgctgagattactggcatgagccattgcacctggccttcttttttgagatggcctcaggttggctctgcctggagagggggaagcttgtaaagatggcttagaaaaaaagtcctggctccatttctattttctcccttcttttgctggcctgtttcctgctttttgcaaattgcaggaacaagaccctgcagatggagaagatcaaggctcgtttgaaggctgagtttgaggcacttgagtcagaggaaaggcacctgaaggaatacaagcaggagatggaccttctgctacaggagaagatggcccatgtggaggaactccgactgatccacgctgacatcaatgtggtacgtggctgcctggagcctatctctaaagcctttgagaaagaggtagtggtgaatgatagggcctttccttgagatgtggcttaggcctagctcggggagcaggcatcagtgcaggctgtggtagagcagaagaattcaggagttctgagatccagccctggctctgtcactaactgactatatatcactggacaagtcccttctctctgggcctcattttccctctctgcactataagggggactcagtaccctctaaatgtactgatttgatgtgctctcattctgggattctgggagttgagagctagccttggggaaaagcagagcaggcagctgcctctggaatgtagtttaaagcactccaagctttcagtcagaccaaacaaatcatttctgcctgctaccaaagtggagcttcctcattgatatatcctttggaaactcttggaacacagaatatgaactgtctgctaaggtggtaagctcccctctttggaattattcaagcagcatcttaatggacacttgtatgagctactgtactgatgattccttcacaaggaaggaggttggcagtgctgaccagtaaggtcttttcaaacccttatcacccataaccatgaagaatatatttttaaaatttactttcaaaggaactaagtttatatttctggaaaactcatttctgtggcaatactcattttctgatgttgtcagacctaggatcataaaggaaatatgaatgaggtttggacagtaagcaattgggattttctgtgttagagatcgcagaattctagatctcataaagtgttgacagtttggctgccagctaaccaatgatacagggccagttaaatgaggaagatatttgccagaagggctaagaatataagccagtggatctcaaacttgagcatgcatcaaagccactttgagagcctaagacacatattgctagactccacccctgattttctgattttgtatgtctgaggtgaacctaagaatatgcatttctgagttcccaggtgatgctgatgctgctgatcccttggccacattttgagaatcactgatctaggagaaaagactgctggcctgggaggcggaagccctaagtctttatgcaggatttgatactaagaagtatttccccaggaaagtccctttttctctttgagcctcagttttctataaaatgggagtaaggtggactaaatgagctctgaaggacattccagctctaagatactatatttgaacaataccatttatttagcagtaaatattaatttagcccatttactgagtgctttatatgaatcctatcattacatcttcaccaagattgcatgagttaagcactagaatatcaccattataccgatgaagaaactgagacttgaccagagttacatggagagggcatgggagatcaaggacttgaatatagactgaacaagttctggagcttgtgctattattcactcagctatagatcctctctgagaaccttaggatcttttctctgtgcctatcccactctatgttccagatggaaaacactatcaaacaatctgagaatgacctaaacaagctgctagagtctacaaggaggctgcatgatgagtataagccactgaaagaacatgtggatgccctgcgcatgactctgggcctgcagaggctccctgacttgtgtgaagaagaggagaagctttccttggagtaagctacctgcccccagtccctacaacataccctccctccgacccacatacatacttacatacctacacacacacgggcaggtatacatacacaaagcctagcctgaaagtcagagtgcctagttttagtcccaggcctttcagtggcttactcactgtgtgatcttgggcaagtctctgtgccagcttgttaaaacagaaggaggattattaaactggatgaattactagatgaattagaacaactactaggtggctttttaaattctttgtgtgatattgacaatacaagactatgtctataactcttaagagatcatttcccaagtcagggtctagaaggcgatatctagaaacctctaaaaacaaaaaagactgagctttcctggtcttcaggaagtggcctgggacttacttcatctcctggctcagagttaagaactaggcttgccttgcagagagacagaatttgacctggtagaggaaatcatttcctaaaggtagagcaaggtgtctgtggagtttgtgagcttcctactcttagagatatgtcaccagaggccttaggacacttaataggaatactcaaaagagcatgagatagcagataggactgaataccctttaaggatcttgctagccctaagatttcttggtcttcttggcctatcagagctaaggacaaagaggattacccttctcatcagacattgggcctagtacccagggacaatagccttgtgcttgggaaggtgtggggaccttctagaatgagccacagctcaacccttggttgtatggcatggagtctttaagaggagcaaggttctcattgctttcagaatgatctagccagtgtctctcatctccaaagttactttgagaagcagaaagcagaatggcagacagaacctcaggagccccccatccctgagtccctggccgctgcagccgctgccgcccaacagctccaagtggctaggaagcaggatactcggcagacggccaccttcaggcagcagcccccacctatgaaggtaagtgagctgggtaatggttgtggaggaagcaaagtatcctcccatggaagggccgtggaaggctagttctgggtctttggctttatttatgctgggccttcttttaatggcctttgcttgtgacacagtggaaggggtgacatgggtgtgctgtgttggacacacacagcacaggttttgttgccccatgttcccagaggtgttagaatgcagggagattttcaggccctgctagagtgcaattctaaaagttagaaatgactcttacacaaagatgtaatgagcatgtatcataaatgagggaaccagcaggattataaagctggttccaggagcatttggaacaaatatctatatagtcaagaaaggagaggaaggctgaaacaaatttgcaaagttagatgcaaaactggtttacatcccacaggacaataaaactgtaactttatagttactttttcttccaaacagaagtaatttgcatctctactgggcaaaagccatttgcagcttatcagtgtaacatcacagagcctgggtcctaatcaattggtaaatagtcaaacaaagagacattcttctagagcaggggtcatcaaattacagcctacaggtcaaatctaatctgttccctgttttcgttaaagttttattggcccacatgcatgtctgtgtttgcaagctattgcaaacaacatgcatgcaagctattgtctatcacttctttcatgcaaaacagaattgagtagttgcagcaagtttatatgatgtaaaaagtctaaagtatttgctgtcctggcctttacagaaaatgtttgttgacccctgttctagaaaattaaatagtccttaagtgggcctgttagacaatgcttcattataatgacgaaaagatgtgtagttctcattttgccttactttctagttttgtatactttttctcaacaccattctctgaactgggttatgtccttccttcccatcttccatggcatccaagaatacttgagtctactcactgattattgctctcttctgatgggaaatcactttgctttctgggcccctggggaatcagaagtctaagttgttgcctggaagaatctgactactaactttctttttcctgtgtccctcaccaggcctgcttgtcatgtcaccagcaaattcaccggaatgcacctatatgccctctttgcaaggccaagagtcggtcccggaaccccaaaaagccgaaacggaagcaggatgaataaagaaagggagagcacatgaagctttgctaattataacccctcaccttgaccagagtcattgatgtcctgatgtgaaacaacccttgcccaaccccacgaagtctcctatttaatgtgatggaagcacaacccctctctcactttgctcctatttctttctgctcttgggatttctggtttaggaagagatgtggttcaggtgctaaacagtgtgtctgatgatcccttctctcccactcacatttcaacccctgcccttgtttggagctaagggaagggcaaaaggctcagatatgattctctatctcttgtgcctgaggcctggagcctaaggagctgtagggtctgaggggcaggggaggcccatatcttgtttcaggtaaaggacccagtatttcccctccttgtacttttgccttaggttctcaagggacaatagtcttcatgttggattctccaacaggctgggtgcatgtatccccctactcctaccctcatctcatccttaaggcccagaggtagcttggacaagccctccttttcataatcatttgggaggcatggctgtaattctttagctttctccacttctgtctcccacatatactaaaattcttaggtactaggctgtgtgtcttgggatcttaagatcaatgaacctttccccaatatctagtctttgcaaattctagtagaagatttccacagtgaaatcagtgagccagaccaactctacatctcctgcctaacctactgcctaagtcattagggctgagggctcggctgtaggggcttccttaggctgagagtgcccccaggctgacatctgtgttggcttttgttcagaaccattactctggcacatgctcaatggtatattgcagggaggagaggagtagatttagatttgagtaaatgccaatcactttacacatgaaggtgggtgggactttccttccattcatcccttgctctcttggatctgaactcttctggagcctcagctcaggatagctgctggccactcctgtcctgtggattgtgcaggtggcctttcctcccaaaagaaaaggcatcaggctccccaagccccacagctctcctttccaccaaagccaggtttcctggtaaggtcactcgaagataagggatggggatgggggctgactgacaaaaaattttagccccaggtctcagtacctggctggggagggggatatttttccttccttaagtagttttacattgccacagtgtgtatgtgttcactatataaaatgttcctctgctctttgaaagtaagagtgttgtgtctgtacaaatccttttaacatgcattcattggagtaaattctgagtatctactgtgtattggataatacaaaagatgtaatgtcatttacctttctggg

SEQ ID NO: 4649 - DNA, 60103 bp, human
caggctcatagccccaagcccggaggaggtggctacattgtgtctattgtatcccttggctggtgtatttgtacatctctcgggacgtgaaattgacagtgaaaagtatggcagatgagcaagaaatcatgtgcaaattggaaagcattaaagagatcaggtaagtggcacgttgtccccctccccgcccctctccaacccttcgttgcgggagagggctaattatctattgttgggctgtttgtctagaggagctggaaaggggcccattcaccacagacttgccggagaggtgaggatgggaggggcgctgaggagagttgagagagagagagacctcttgccagatgtggctgagaaagcaaagatgaagaaacacgggtttggtaccaagacagttttattcttctcgaggtggaggtcagggctctgcattcatggacacgttttttaaaagtacttgtgtgccccaaggtgtctttggctccttgctctttaggagtcgggatttttttccagtctcttgttcaacttcagaacctggagttcgggaaaggcttttgagagccaagtctagcgcatcggggctggtggctgctgccaggggctgccaactgggggttgcagaggaatctcagcgggcggagctgggagaatggcgcgcgctcgttttcctttcactcactcgccactttcttccttcctatcccgcgcttgggagggggatgggagcaatggggactggggacgcggtcgctgcgctgatggtgggatcgcgacagctgctctgaggagctggaggtgacaggcgggctggcaaagtgggagttgccgaagtggagtccgctacacggttgctcctggagcagcttttggcaaagcgatgatattgtccttgctcagaacacaatagcgccaggcgggctgtgtgggctggcacaaggtctttcttcacctcgccttctcagcgtgagcccctgctttggcttttgctctcactctgagagtggcctgggtcaagctctctccctggagtgttttctgagaacccaaggtggaagatgtcaagtgtgtttctttaagaaataagactttgatcatgagatttaacccttagagtgctggatgagacctacacatggtgattagtggtggtaggtaaagcaccttggtttcttcttcttcttgaggggttgcatctctctttctacaggagaggtaaaggaagggaactatcatttattgagtcccttcccgcccctgtgtgccaggccctttgacctacttttgctcattcagcaagagtcctgtgagcttcctactcctcctttacagctggggaaatagaggcccagagaatttgagtgattttcccacagccacgcagcttgaaattgccacattttgttggtctgcctgcaaaggtattccttttcccactatgtcccaggtaaagtctggaaaggagaagggaatatgttgcaattttttttttttttttttttttttttggcaaaagcatcagaagctagctagaaagtgagacaccttagtacagtagaatgccagctgtcataacgatgcagctagtcagaagcttaggcttgcaaatggagagcctagacttccactctcaccaagcttcaaaggaaccaccaccccatgcccagagaaggaccagttgtgagcaaggactttaatccccagtgaaaatagacctctcccagtgaagaccatatggagaaccatgacttctacccttaccagtggtaactaggagtttctacctcaaccagctaggatggaatcagcataggcccagagagaaggccaaactttcacctctaaacagcagtaacaaacagcccttctccaaactggatgtcaagagacagtggagaaactggacttctactgtccctcttccatccaagagagtggtagaggactgctaaaacaaaagatttaaataagatccagagtatccaacttttaatcaaaaatcactttccatactaagatatccacttgaatgagaagagaaaataaacagatgccaatactgagataacacccatgttagaattatctgataaggatcttaaagcacctgtcctaaaaacatttcagtgagcagttacaatacacttgaaacaaatgataatgtagaaaatctcagaaaatgaatagaaagtctcaacaaagaaatataaaacataaagaagaacaaagtgacatttttagaactgaaaaatacagtaacataaaaaccccaaaaaactcaatggataggttcaacagtaaggtggagaagagagagggaaaaaatagcttacaaatataaaacaatagaaatcactgtggcactataacaaaagctttaacatttatgccaacaaattcccaggagaaagagggcaggattggaaaagtattgggaaaaataatgactaaaatcttcccaaattgtgcaaaagacataaacatttagattcaagaagaggagcaaacaccaacataattgacacaaagaaacacactccaaaacacattgtaatcaaccttctgaaaatgaaagaaaaaggaaacttcttcaaaacagctgaagagaaacaaaagctacaaaggaaaaaaaaaattagaatgacagatttatcatcagaaactgacgatgccctagcattttgtaagtgctgaaggaaaagaagtgacaacccataaatctatgtccaataataatatccttcagtattgaatgggtaatcaagacattctccaatgaagaaatactaaggaatttagatataccctaaaaaaagatgatagtaagctctgaaaacagaaaagaaacaataaacagtaagcaaaagcatggttaatgcagtagactttctctttcctcttgaaatttcttgtattttgataattgaagctaaatttatactgttatctagtgtggtctcagcatatgtagaggaaatatttaacacatttatattgtaaactggggaatgtaaaggggattgtaaatgtaaagagatgtaaaggggaggacatgcttctacacttcattcaagcatgtaaagtggtaatgtcagaagactattaaataaattatgtatacataatatattactgagagaaaacactgaaaatgctatacaaagaaatgtactcaaaacattataaataaatcaatatgaatttttaaaaaatgctccagtcacccacaggcaggcagggcaaagaaaatggagaaactaaaattacggagaatgaacagaaaaaaaaataaaaaggcagacttagccttcatgtatcaataattatgttcacaacaaatagtctaaataccttgcaaacattaatcaaaataaagcaggaatggccatcttaatatcaaataaaacagacttcagagcaaagaaaattcctagagatggatattacataatgaaaaatagtcaatctaccaagaagacataacaattccaaatgtgtgtgttccaaaagtgacttaaattaaactgcttttgacaattttacagtaatatacaaaggttaagccacttggtttaagaatttaaaatggagaaagtactataaatatatacttgatgttcacatatggacagataaacatgtatgagagatagaaataaggaaggagcaaagggtcaaagaaactgaagaaaggaactaacatttgtcaagcaccttttaatttaaaagctcctggctcatttactctttagtcttcccaaaggaaatctgggataggaattattacccccactttacggataaggacattgaggatcagacagattaggcaactttcccatggttacacagctaggaaagaaaaaataatatatcctcctattcacatggcatgcacatttcaatgttattaactgcccttacaaatgctgattatctgattaaccattattcacagttcttcaactgctataatcctaaatctcctgaagtataagcatagcagcatatttctgttaaagaaataatgtttgctggacagaagcaggaatgatgacagcagcatcatctaatgacctattgaagtcaagctaagagccttacacacatcaagacacgagcccagaaatatatgcattcatactcagcactcacaccaatggcagaatttgcagtgggaaaaacatcagaagcagattctcccaccacagaccattttctgcttctaactctgaacacacgcctacccctgtctttcctcccaatcccaatcacactcccacattatgttcccaacctcagcctccaaatcctacactaatctattttgcccatgttttccttggacttttaaatggtgatgaaggagcatgtagataagtggaagaagagagacaagaatggaacaaaagaagggagatagaaaagagggaaagggaggatagcagtaataaaacagagacagtgagtacaggcaccattaaatggaccagagccctacaccagctccccaagtacaaaacaatatttccttaaaatgcacatgccatccattcatgtgtattgcgtacactcacaccccgatgtacacatatccatacacaaagagctttcctcacttgaaaaaaagaaaaaccattttggaaggagatgttgagttaagtaggtactcttaaatgaatgtttctcgactgggtccttcttttctttttttctttctacacactcttttgagtaaattcctgtacttccatggcttcaaatattatcctccaaatctccaacctctataccccacccacattcatgctttagcccatacatatgacagcctactgggcttgtccgcctggaagtttcacagataaatctcagctttatatctacgtctcttcctacagcaatcaagctcctccccttaaacctttggtttaataccaccattctctgcacagttacctcagatggcaatctgaaagtcaatgttgactcccctttctctttaatgactcacctgcaatcacttagttaattctatttctatcctgaatatcttacccaatacctgccccactctccacctcccagttcactgctccatttcaggccttcattatgaattggcatggatatttgtaatgcagtatccatttccatctgaagaattacttccctgtctacagtctctcctctgtctgcaatggcatccacattgccttgagaactaccttcctaaagcatggttgttattttatttctcaaacatcttcactaacttttcattgtgtatgacaatctttttgaaaaatacaggctgcgtcccattattagctcataaaaagaatttagttggtcactagtagcatttttaaaaaaccttttttaaaataaaaaggaaattatcaacatacattgcatatgaagtagtaggtatactttggagaaggttttgtttagttttaaatatgtgtatgtgtgtattgtgtcatgaggtgaaattcatttctcacttacgtcatttcttactgtgtctctgttgaacacacatttacctatcggtgtttccatggcattcatgctgcctccccggaaatctgtcccatacccactattctgaccttatctgctactgctttttattaatcctatcctttagccatatagaagttcttactgttttatatatttccgttccaccagacctttgcctctgcagattcctcgttctagaatgccactctcccattccaagcatctaaatcctactcatttttcaaggaagacccatatgaaatgcctcgtcttctccaaaaccttctcgagttccccagtcaaaatgaattacaataccccaaccacagactccacagggagatttattatagcactcaagttatcccatctaatgatggaattttgaattgatatcctcccttccttcctcccttccttccttccttcccccctccctccctccctcccttcctctcttcctctcttcctcccttcttcctttccttccgccattggtgtggcagtcttggtaagctcctctgttacctggcttggggattgactcagaaccagtgcttactcaagaccaaggcacaggacaactggaacctctgggacttgtggatgggcaaattaagccaaacaatgctggccacaggagagactgaaaaggtgttggcatttggtattgagatgtaagaaagttatcagaatgaactgttataagaaatctactttgctgacagtagctttgtttccagttgagcaaataaatattacatggaagaatgcttagtacttaggcaatattctcaccagactggagtaagcaggaaaaactagctcctttgtgttcattcagtgacatttactgagcataaatctgggccataatcagggctgggctatcctttggtggcccatcacttaggataaataagacccatcagaaggatcttctaatcaaagtcaatagctctgatctctcccttgagttccagactcacatatctaactgcccatttaacttacacccttgcatgtatcactggcatctcaaacaggccctcaactccagccccacccctaaacatttttatttcccagtcttccccatctcagtaaatgcctcactatgctgaaatctggaagccattctttattcctctttttatgtgaccctctccatccacaccattagcatagtggttattatacttgaccatgcaggaggttacacctaaagggcttttaaatcattgattgctgagccccatttccagggtctctgattcagtagatatggagtggggcctgagaatttacatttctaacaagttcccaggcaatgctgctgctggtggtgcagggactacatgtggagaacaactgcattagtaagacctggccagttatacctatacaatataatctggaattgtccacttctcatcatcccctcaacttattaacaaataccagcacttttccatcaatctccagtaaacagtatcttttcacctaattttcccatcttcaaggcctacaggtcccagctgtcctaccctgctttttgagtgtgcattggggctgagtcacctctgaaactgggtgacagatgagcctgccaagtttgtcccagcaatggatgatccatggccctagaacttctccttctttgcacctgtcctcttccatatttgccagaaagaaatcattgaaaagaaggtatccagctgaatgttttatagtcttggctcaggagactgtctggagaacctgtggcctagcagtctgctatgatttgaatgtaccccaaatttcatgtgttgaaacataatcctaccattttgatggtattaagaggagagacctttcgggaagtaattaagtcatgaagcctctgccattatgaatggattagtgccttagaaaatgacttggaatgagtttagacccttttttgtacttctgtgattccaccatatgaagacacaacattcactccctcttgaaaatgcagcaacaaggtgccatcttggaaggagagaccaagcccctcaccagacaccaaatctgttggcacattgatcttaaacttcctagccttcggacctgggagaaataaatttttgttctttacaaattacccagtctgtggtattgtgttatagaagcacaaacagactaggacaggagctcaggaatactggtccaaaagttacctaagactgtcatcctggtgactgtagaaaccctaaagtaccctgaaaaccctgtggtttccctgtggttcacgagtcatactagctgtgctttagcctcttggaaaaatctcattaggaaattttatatataaaattgcatctttaatgatctggatggcttcctcacttgtagggccaaacattccacagatttcatctcattgaagcatccaacaattccatgcaaggctacactgagtcctactttccaggtagaatttccaaggtgccaagagattccatgaagtgcactatttcaccctgaaaattgatgactgagccaggacaagaattcaccctactggcctggtttttatggctttaaatccatcatatgatgaaagttccttgttgtgatggaaaggtgatcagatttacaacgctggattttccacttcctgaatttgtcttcttgggcaagtcactttacttctctcagcctcaaattcttcatgtgtgaaaataaagtgaaacatacctgccgatatggttcttatgaagattaaattttgatagcataaaaagtgcctaatacagttgctggaacatagtaggcaccacaaatataatagctattgttattaaataaagcctttcttaacagacggttgctttcagttcctgtcacttagatagattcttaataaatatgaaccaaatgaatgaaatccttgccacccatggtaatgtcttttcttctctgaggctactgatgctataatcactcccctggatttactacctaccattcagtagtttctcattccaaatgtaatgattgagccccgcttatggccaaagcagaatgataggtgttgtggaggttaaagagagaaatatggcatagtgccactgtctagaaagccctcgtgtatataattactctgatttcaagttgcttcatgcataaatctgtactttttagaggacccagaggaccatgactatgtgccttgtgctagtccctttcccatcctggacctttatttattcacctctgaaataaagaggatagatttcatgggtgactttgaaataatgttctgacgagcccagggaattctaaggagggttttaaagggccactgtgatagagtcaggtggtggttgaatttgaggacagattaatgactctgggggtcccacttccactttaaccataacagttatgatttgttccattttctatattggatctcaatcagttattttatttgaaggaagggatcttatcattcatccacaagaaccagcgcacttctggataaatggtgcttgcttaatacaatttttaagtctgcttgattgatggaagtttgtaaagagggaatttggtattgtgagtacatctaagcagtgactggcatgacactctttgtagattagagagaggaagggccttttatttagatttaatcttagctcaaacttctcaattgctggacagagaatggaaggctgggaattagatgcaaatcctgaagaccatagtaaaggcaatctacctcaaatgcaacaaattatttatttatttatttattattaagccattaagctccttctcatttctcctggctgccttaatcagcaaactttaaaaaaatccattccctctacgtaagccttttgacaagtcatttatttttctgggaaaacatgagcatgcttagaagttatgtttagtgggagttgtaggtttagatttaattctgggtgcagtaagaggtcattacaggataatttgagttatattttatataccataggaaacatccatttcaagtgtacaattcagcatgttttaataaatttaaagagttgtacaatcatcaccataatattttagaaaatttccatcattccaaaattagctctttgttcagtttcagttgatctttgttcttatccacagccccaggaaacctgtaatatattttctgtctaaatagagtggctttttcttgatgctgcatataaatagttatacaaatgtggccttttgggtctgccttcagtcacttagcttattgtttttgagattcattcacattgtaacatgtaacagtatttcattcctttttgttgacaaataatatcccattgcatggatatcgcacattttgggtgttcactcacaagttgaggagcatttcagttatttccactgttttggctcttatgaataatgctgctctgcacatttgtgtacaagtctttttgtggaaaaatgtttccatttctactgcttagattctcaggagtgagatttctgtttcatattgtaagtatatgtataactttttaagatacaagtgtttttgaaagtggatgtcctagtttccatcccaagagggagtgtatgagggtcccagtttctctacatcctcaacaatacttgttagtgtctgcctcaaaaaggcattatagccatcctagtggtgtgatgtgatagctcacagtagttttaacttgcatattcctaatgaccaatcttgttgagtatctcttcatgagtttatttgccacccatatatcctcttctgtgaagtgtttattcaaaccttttgttcattttttaactgggctgtttgtttactgattgtgagttttgagtgttatttacattttctggaaacacatttttaccagacacttgatttgcaaacatgttctcccagtctgggacttatcttttcattgtcttaacagtgtcttttgaattacaatgtctttttttttttttttttttttgcttctttgtttgaaacaggatatcactccgccacccaagctggagttcagcagtgccatcgtggctcactgaagccttgaattcctgggctccagaagttatcccacttcagcttccccaataactggactacaggcttgtgccaccatgcctggctaatttttcttaaatattttgtagagacagggtctcactatgttacccagggtggtcttgaactcctgggctcaagcgatcctcccgccatggcttcccaaagtgttctgattataggtgtgagacaccgcactgagccagaaacttttaatgttgatgaagaaatccaatttatcagtattttttatggattgtgaattcttgtgccatttaggagaaatgtttgcctaagtcgtattcacaaagattttctcctatattttcttccagaaattttatttttaggtttcacgtttaggtctatgatccattttcacttaatttttttgtatgttgcaaggtacgggttaaggattttcttttgcatttggatgttcagctgtttcactatcatttgtttgaaagacttgtccttacatctgtgggtttatttctgacctatctgcttcattgctttatttgtgtatctttatgccaatagtttgctgatttgattactatatctttttaataattacggaaaccaggtcatgtaggttctccaacttcattattcttcctcagaaataattttgactattctaggcgctttgaatttctatgagttttagattccccttgtcagtttctaccaaaaaccatactgggattttaataggattttgttggatctgtagattagtttgttagatttcaccagtgtgtaatgaaataatgtcctatttctgttctaggatctaacccaagataccacattgcatttttatgattccatttaacttattttatgacttattagctataatgctgttttattatttcagtggctgctttagagtttataatatacatccttaacttatcacaacctaccttcaattgagcgcataatactgcacatataatgtaagaaacatacaacactatatttctccctttctggcctctgtgctattgcattttggtactttttggtttaaactgttgattatatttttaagtaacttaattaaggaagaaaataatcatgatatttttctatgtagttaccattttcagtgctctgtattcctttgttttgatacatttccctctgctatcattttccttttgcttgaaggactccctttaacatttgtggtagtgcaagtttgctgatgatatagcattttacctttccttgtgtgaaaagttctcattttacctttgttttcaaagttgttttccctgggtaaataattctatattggcatggatttcgtccgtactttaaaagtgatacaccactgtcatcttgcttccaacattctttgatactctttgtgtaacatatcctttgtttctgactcctttactggttttgagcaatttgattatgatatagcttggtgtgatgttctttatggattttatgcttggagcttgatgaatctattggatcagtgggcgtgtagctttaatcaaatttgaaagatttttggccatttattcttcaaatatttttatcttcctctttcttcttggtcttcagttacctgtatttttaattcaatttaatttaatttgatttaatttaatttaatttaattttactgtggtaaggtcacagaacttgagatctaccctcaacaaattttatatttataatacagtattgttaactagaagcataatgttgtactgcaaatctcttgcagttatcatcctgcacaactgaaactttatacatattgaatagcagctctacgtttccccctccttcagttcctagcaactgccattctactctctgcttctaagaatttgactattttaaatacctcatatgagtggaatcatgcagtatttctccttctgtgattagcttatttcacttaggattatgtccatgttatctcatattgtaggacttccttcttttttaatgcttaataatattccattgcataaatatactacattgttaattcattcatttaggttgttttcatatcttggctattgtaattaatgccatgataaacacgggagtgcagatatctctttgagatcccgatttcaattcttttggacaaatacctagaagtaggagtgctggatttatatatttttatatatttattatacctgttggccatgtttatgttctttggaataatgtttatggaactcctttgcccagtgttcaatcgggttaatagcttttgtactattggtttgtaggatttcttatattttatacaaattaatccattatcagatatatgatttgcaaatatttcatcctttatgcagtttgccattttactctgtttattgtttcctttgctgtgcagaaacattttaatttgatgtgatcctacttggtcatttttgcttttgttgcctgtgcttttggtgtcatatccattaaatcattgccacaagcaaagtcttgaagtttttctcttatggcttcttgtaggagttttgtagtttcagaagttatgttcagtgtttaatacatttgtagttaatttctgtgtatggtataagataagggtccaatgttatacgtttgcatgtggacatagtttttcccatagcatttattgaaaggactatcatttcttgcattgtgtattcttgtaaactttgtcaaagatcaagtgactgtatgtgggtggattcatttctgggctctctgttttttcccatggcctctatgtctgtttttatggcagtaccatactgttttaattactgcagctttgtaatatattataaaatcaggggataagattgttctggctacttggagtttacatgaatgtaaaaaaaaatgccattgggatttttataaggattatattgaatctgtagattgccttgagtagtatggttaagtcttccaatccatgaacatgtatgtcttcccatatgtttgtgtctaccttaatttctttcatcaatacgttatagtttcatttattgctaagtattttgttctttttggtgctatcataagtgggattgtgtctgaatttccttttcagatagtttgttgatagtgtacagaaacacaactgactttgtatgttgattttgcatcttgtaactttactgaattcatttattaattctaacaatctttttggaattttttgggttttgtacaaataagattttgtcaactgaaaacagcaataatcttaccatttccttctcaattttggtgacttttatttcattttcttgtctaattgctctggttaggtctctaggatctatgttgaatagaaatgtcaagagtggacatccttgtctttttgctgatctttcagtgttttaccattaagtatgacttagctgtgggcttttcatatatggcttttattgtgttgaggtaatttccttctatttttagttgttgagagtttctatcaggaaagggtgttgaattttgtcaaaggctttttctgcatttattgagatgatcatgtgactgttatctttcattctgttgatgtgatatagcacattaattgacttttgcatgctgatctctcctcacatcacagggataaattccactggccgtgttgtatgatacttttaatgtgctgttaaatcagtttgctagtcttttgttgaggatttttacctgtatattcatcagagatagtgtcctctagttttcttttcttgtggaatcttcatctagctttattattagggtagtgctaggctcataaaatgagtttggaagtgtcgcctcttcacttttttggaaaagcttgaaaaggattggcattaactcttctttaagtgtctgtcagaagccaccagtgaagccagctggtcctggccttttctttgttgggaagtttttaattactgtttcaatctccttactaactacaggtctattcagattttctatttatacaggactcagtcttgccagattgtatgcttataggaatttatccattttttatgttatccaatttgttgatatgtgattcttcatagtagtcttatgatcctttctacttctttggcatcagttgtagtgtgtcatctttcatctctgatttcaattagttgattcttttctattttctcttagtctagctaaagatttgtcaattttgtttattttttcaaaaaaaaccctcttagttgcattaaaaaaatttgattctttatttggcttatttctgctctctcttcattatttccttcaaaactgaccaataaatcacatggttaatagaattattagctgatgacattaaaagttattataaatccatttcatatgttcaaaaagcttgaggaaaaactgaccaagtagaggcatggcagaaataaaaaagattcaaataaaaagtctatagatgaaaactattatgtctaagatcaaaaaatttcttagtttagaaaaagagggagaaaagattagtgaacttccagaaatagtaatagaaatcatcccaaacaaaatacatagggttaaagatttttaaaaataaacagtatcagcaaattgtgggacaacttcatttggttaaaaatacagataaccgtcatttaaaaacaaagaagaacattatgtaatgataaaacagtcaattcaccagaaatatgcaacaattataaatatatatacacccaatatcagaacactgaactatataaggaaacattgacaaactgatggtagaaatagacagaaagacaataatagtaagagacttcaataccccacttttaataatggatggaacagtcggacagaaaatcaataaaaaacagcaggcttaagaaacactacagaccaaatggaccttacagacatataaaacattaaacccaagagcaacagaatagatactcttcctaactgtacacagaacattctccaggatagaacacattaagacaattagcacatcttaacaaatgtaagaagatcaaaatcctaccaagtatcttttctgaccacagtgaaattcaacagtagaaggaaaactggaaaattcacaaatacccatcttaagggttatatttttcctgcttatttgtacatctggtaatagtaaagtgtgaatggatgccagaaatagtgaatttcatcttgttggttgctgcatgtatttgtattcctatacttagtatcagttttatccctataagtcttgctgttaagcatagttaagtggaaccaaagtagtgctttgtctagaagtcatttccccagtactaatgcaaaaccttctttgtattttaatgctttatgaattgtgaagttcttctaccttggctattggaaataggtccatgtgggctctgatcactgtcccctttgggtggttattttcctggccttatgtagttttcttatacacgtgtgctaatcaatatttaactgaataattggtggagttggatcctctgaaaattgagagagtcccctttttttcattaaaaaaaaattaaaacggtgctattgcaatagagttctctttctacataggtctacactctccaaaactcttttctgaaaaattttgataccttggcttccccagagtcatggctccatttttttcaattgaaggagactagcaggctctgactgagtttcccttccctgcagcctagaatatttatctaggcatgaagatatagccatcttagggctcatctaagcctttccatcttttggagatcactgaccttacttgcctgaagtccagtgacttaagtgctattttttcatataattttgtcagtttttttctgtttttagttatgcctgggagggtaaatcaggtccctgttactctatcttgactagaagtgaaagtcaaggttatttctcaaatatggtttcaaaagatcagattttgtcatttaagacacatattttacattcaaaaatgtaaagtcagggtgtgtcttaaaatccattggtgttttaatcatgcttaaacatgtgactgctgttggccaggatacagttgtggtggtgtcgtcagtatctgagcacatgtgaactttgccatgactattcatattgtcttctcttaaactgaattatgtccatggttgccaacatgtactgtccatagttgccaccatgtatttaggttgtcatttaaaatgtcctcaaaaagatttcaccatgattctccatcaaaatagaaagctattttgtatgaagaagaactcagaccagaaaagtctgataaaaataatctcttaaataagtctacattaggtctttcaatttgtataaaatgtaaattttgaattataagaaaacaatttgttatactgtaattggtagcattttttcttagtagtgtacaaaataatgtgtaccttacattcaaaggcatcctagattcaattaaataaaataactgattagccaggatattaataatgctaatctaagaaagtcctaaaataacagtgtttaaaacaagacagttttaattctccctcacattattgatctgggaacaaggtatttgtggtttgtggtggtgtttgatattggggacctaggctatttttatattgttgcttcactgtatacagggtttcgccctcatctatatgattcaagcccactgttgtgtacacattttatccaataggaaaatagcaatgggaatggttcttccatttatagtcacaatccagaagttgtagacatcatttctgcttccataaaattggccagaaagttgtcatatggtcacaaatagctgcaaaagggatggggtaatatagtccttatttcagacaacttcatgcccagctgaaaatcagagggtctattgctatagaaagaggggagaatgaatttggggagacaggaagtattgtgttgtttaagagagaaatgagatcagctcagggtatattctgctacaggtctccaattgggtgccacccccagtaccttcttaattctccatctttctgaatgcaaacacagatacaagagcccttatgcactgctggtaagagtatgaactgttatagccatcctgctgagcaaattggcactgcttaatcaaagtaagaatgcacattacctgggcccctgaaatccaactcctgggataaatcaccccccaccaccaccaaaaaaaaattactgagacaggtacaaggctattcacttaaatgttattttggaggtggggagattgaggcaaagtgggagtctgtccctggaagagtcaacagataaaatgtggttgatagccatatatagaagcaaggaattctggatattaacttgagattgctgtgtgaaaaccatattttggaaattggccaatataacaatttttatatacacatatatgtacatatatacacacacacaaatacacacacacacacatatacaggcatgtgccatataatgatgtttcagtgaacaatacaccacatataccatagtgtggtccctgaagattacaatggagctgaaaaactcctatcacctagtgacgtacccactgtaacatcatagtgcaatgtattactcacgtttgtgatgatactgcactgccagtcatataaaagtctagcatataaaattatctacagtacatgatacttgaaaatgataacaaatgactatgttactggtgtatgcatttactatactatactttttatcattattttagagtgtactcctcttacttattaaaaaaaaataactgtaaaacaggttcaggctggacttccaggaggtattccagaagaaggcattgttttcatattccttgaagactttccagtgggacaagatgtagagttgggagacagtgatattgacaatcctaaccctgtgtaggcctaggctaatatgtgtgtttctgtctttatttttatttttatttttttttatttttgaaacctggtctcactctctcacccgggctggagtgcaggggcatgatcatggctcattgaagccttgacatcccaggctcaaacaacccttccacctcagcctcccaagtagctaggaccacaggcatgcaccaccacacctggctaatttatatatttttttaatagagatagggtcttcctatgttgcctaggctggtctcaaactcctggcctcaagcgatcctcctgccttggcctcccaaaatgctggggttacagacttgagccactgtgcccagcctgtatctttatgtttaaccaaaaagtccaaaaagtaaaaataaataaataaatacaaacatagaaaaaacgcttatgaaataaggatataaagaaataaaatatttttgtacagctgtacagtatgtttttgtgtcaagctaagtattattgcaaaagagttgttaaaagaaaagcttcagccaaattaaatttaaaggaggttaattgagcaatgaatgattcatgaattgggcagcccttagaattacagcagatgcagagagactccagcacagccatgtagtggaagaagatttatagacaaaagggaagtgacatacagaaatcggaagtgaggtacagaaacaactggattggttacagctcagtgtttgcactatttgaacacagtttgaaccctcagcagtgtatgagtggttgaactatggctgctaggactggccaagactcagctattgttacaggcacatactcctaagttacgttttcaatcttgtctacctaataagttaggttatgctttgtcctcatggactcaaatgtagaagtacagtccttctcaggctatatttagttggctttaacaattcctcccttttggttactttctcaattttgagatgttgaccaaaactttagtcattgatgtcactatcaccattgtaaatgtacttatttggtcttgaaacccactggaaaacagtagaacagtgggttttacaaggtgggaacaaggacagagtagagggtacctccttatgctgtaacatcctgtttgcaggagaaaaacaaaatctggtctgttctaggatctatgtgtttccttaaagtcttagtttgattatgtcatatttagtatgagtgactccatgtttgtttggtttggtctgttagggcctaatgcaagagctcagtccaaaacaatggcctcccataattttgttttaaaactctacttttcgggtcaggttcttacttaggtgagggtgtgaccaaaacttagggccttagtgccactctgttaccatcattttgggtttctggtctcagcgtgtaattcataagttaccatgtgttcatggttgcatatttttttcagctcttgtcatcccagttgaagagagaccatttgatattctatagatggctgcatgcaaacatttaaaacttttgagagaatgcagcgcacaagggagactactattatgactattgggaggataacaccaacagtttgtagtatgctccttacccagggttcccataaatcaaaccacttaaaattaaatagattaaagaatgggctaaagagtctactcacttaactaagcagtctttccattaatcccctacaactgaatttttatattctacattttatgtatttctccataggcgacaagtgccagcagctgcacagatatttttccattgagccaatgctattatttagtataactttcacaagagaatttaaagtctgttgtgtagccatagcctttacagtaaaatctgctatagagcctatcatgagggatacatttttaatcattgcttcttttactccaaaccaaggaagaaagatctaacaaatgatgtcctctagaagagtaaaggcctcctcataatgttcactttaacccatgatgtgggttaagaggagtgaaccaatgttccctttctgactgattatgaggcaacgtgtgtaccgttaaagcttcttgtctacattgagccttcgtcttttatctgtcaaagtataaggttatccatgtataaggctggctgcaaaatccttcacaaataaaagtataccccataagtacacacaacagaccctcttttcacttctattcttcagaggcataagcaaggaaaaaaatagttagacaagaatctcatgatgctagagaagtcttgatctttgatcttgggaaaagctattcacatcagagatgccatcttcttctggggagaaacttcccaggttagctttactttaagggcttcactgggtgtacagttccaagagtgtggagggacccttctcagttgtgagattatgaacttaaaattcaaggtcctgaagttttgctgtagtgtggatggcaaatacagcctttctctgatgttctcagaagatccaatttttgggttctagattgtgaaggggttgattgtcctcagtcagtgatccataaaaactttctttacctggtgaaaataccctgtagcataataatctactgttataacagcaaccctcatacatgggaaaacttttatacaaccagaaaacatgcattgaaaatgacaactgaatgaaattcttatacaaaatgtttaaatggcccatcagctaaccaaatgcacctgaaggtttgattgttttcccaggaatatgggtgtgacaaaccaaatattgttcataaactattttaggaatttagaagacaccacattaatatataattaatttggatcattttgtcttttccatgatgagtcacagaatacagaacctttaataacaaaagctttaacgactcaggaaggacaaagtggctgtcctgcttctccatgagtccatgcttaattaacattagacttatgtcctcttgaataccagttatttctccaaattaggtacatagcactgataactggtgggttatcataggtaatttgacttagaccgtggagtttattcaaactgtatacctaaacaatttcagtattggctgattcagcattcaaatctggcagagtattttcttgttattccataactttctgttctacttgggttagtagttttataaaccagtccaccttttcattaaaatttcaggaattcttatccggtccaaatgatatgattttatagaaacctgtattgaagagtgattttcagggacctttcaatcctttcatgaacctcctaaaagacaccatattctaggattttgcatgcttgtgaaatttttcagaaacagcatcagcattaagcaactaactgtggaaatgacttcaaaggattatagttaaaaacacaattaaaaagaaaacttcattctttctgttgtctacaataacataataaccataataatgattaatagcaagcactcaaacatattagaaattttgaaatccaatacaatttttgagcatatatatatataattataaatatatataattatatatatatatataattatatatatatataattatatatatatatatatataattatactttaagttttagggtacatgtgtacaatgtgcaggtttgctacatatgtatacacgtgccacgtaggtgtgctgcacccattaactcgtcatttacattaggtatatctcctaatgctatatctccccaattcccccaaccccacaacaggccccggtgtatgatgttccccttcctgcgtccatgtgatctcattgttcaattcccacctatgagtgagaacatgcagtgtttggtttttcgtccttgcgatagtttgctgagaatgatggtttccagcttcatccatgtccctacaaaggacatgaactcatcattttttatggctgcatagtattccacggtgtatatatgccacattttcttaatccagtctatcattgttggacatttggcttggttccaagtctttgctattctgaacagtgccacaataaacatacgtgtgcatgtgtctttatagcagcgtgatttatagtcctttgggtatatacccagtaaggggatggctgggtcaagtggtatttctagttctagatccctgaggaatcgccacactgacttctgcaatggttgaactagtttacagtcccaccaacagtgtgaaagtgttcctatttctccacattctctccagcaccctttgttccctgactttttaatgatcgccattctggtgtgagatgctatctcattgtggttttgatttgcatttctctgatggccagtgatgatgagcactttttcatgtgacttatggctgcataaatgtcttcttttgagaagtgtctgttcatatccttcacccacttgttgaaggggttctttgttttttccttgtaaatttgtttcagttctttgcagattctggatattagccctttgtcagatgagtacattgcaaaaattttctcccattctgtaggttgcctgttcaatctgatggtagtttcctttgccgcccagaagctctttagtttacttagatcccatttgtcaatttcggcttttgttgccattgcttttggtgttttagacatgaagtccttgcccatgcctgtgtcctgaatggtattgcctaggttttcttctaaggtttttatggttttaggtctaacatttaggtctttaatccatcttgaattaatttttgtataaggtgtaaggaagggatccagtttcagctttctaatatggctagccagttttcccagcaccatttattaaatagggaatcctttccccattgcttgtttttgtcaggtttctcaaagatcagatagttgtagatatgtggcattatttctgagggttctgttctgttccattggtctatatctctgttttggtaccagtaccatgctgttttggttactgtagccttgtagtatagtttgaagtcaggtagcgtgatgcctccagctttgttcttttggcttagggttgacttggcaatgagggctcttttttggttccatatgaactttacagtagtttttttttccaattctgtgaagaaagtcattggtaacttgatggggatgacattgaatctataaattaccttgggcagtatggccattttcacgatattgattcttgctatccatgtgcatggaatgttcttccatttgtttgtatcctcctttatttcgttgagcagtggtttgtagttctccttgaagaggtccttcacatctcttgtaagttggattcctaggtattttattctctttgaagcaactgtgaaagggagttcactcatgatttggctctctgtttgtctgttattggtgtataagaatgcttgtgatttttgcacattggttttgtatcctaagactttgctgaagttgcttatcagcttgaggagattttgggctgacatgatggggtcaatattgtgaaaatggccatactgcccaaggtaatttatagattcaatgccatccccatcaagctaccaatgactttcttcacagaattggaagaaactacttgaaagttcatatggaaccaaaaaagagcctgcattgccaagtcaatcctaagccaaaagaacaaagctggaggcatcacactacctgacttcaaactatacttcaaggctacagtaaccaaaacagcatggtactggtaccaaaacagagatatagatcaatggaacagaacagagccctcagaaataacgccacatgtctacaactatctgatctttgacaaacctgagaaaaacaagcaatggggaaaggattccctatttaataaatggtgctgggaaaactggctagccatatgtagaaagctgaaactggatcccttccttataccttatacgaaaatcaattcaagatggattaaagacttaaacgttagacctaaaaccataaaaaccctagaagaaaacctaggcattaccattcaggacatacgaattggcaaggacttcatgtctaaaacaccaagagcaatggcaacaaaagccaaaattgacaaatgggatctaattaaactaaagagcttctgcacagcaaaagaaactaccatcagagtgagcaggcaacctacaaaatgggagaaaatttttgcaacctactcatctgacaaagggctaatatccagaatctacaatgaactcaaacaaatttacaagaaaaaacaaacaaccccatcaaaaaatgggcgaaggacatgaacagacacttctcaaaagaagacatttatgcagccaaaaaacgcatgaaaaaatgctcaccatcactggccatgagagaaatgcaaatcaaaaccaaattgagataccatctcacaccagttagaatggcaatcattaaaaagtcaggaaacaacaggtgctggagaggatgtggagaaataggaacacttttacactgttggtgggactgtaaactagttcaaccgttgtggaagtcagtgtggcgattcctcagggatctagaactagaaataccatttgacccagccatcccattactgggtatatacccaaaggagtataagtcatgctgctatacacatgcacacgtatgtttgttgtggcactattcacaatagcagacttggaaccaagccaaatgtccaacaatgacagactggattaagaaaatgtggcacatatataccgtggaatactatgcagccataaaaaatgatgagttcatttcctttgtagggacatggatgaaattggaaatcatcattctcagtaaactatcgcaaggacaaaaaaccaaacaccgcatgttctcactcataggtgggaattgaacaatgagaacacatggacacaggaaggggaacatcacactctggggactgttgtggggtggggagagtggggagctatggcattaggagatatacctaatgctaaatgacgagttaatgggtgcagcacaccagcatggcaaatgtatacatatgtaactaacctgcacattgtggacatgtactctaaaccttaaagtataataataataataatcaaaaataaaaaagaatccagagccatcagtgtgctgtattcaggaaacccatctcacatgtggagacacacataggcttaaaataaagggatggaggaagatctaccaagcaaatggaaaacaaaaaaggtggggattgcaatcctagtctctgataaaacagactttaaaccaaccaagatcaaaagagacaaagaaggtcatttcataatggtaaagggatcaattcaacaagaagagctaactatcctaaatatatatgcacccaatacaggagcacccagattcataaagcaagtccttagagacctagaaagagacttagactcccacacaataataatgggagactttaacatcccactgtcaacatgagacagatcaacgagacagaaagttaaaaaggatatccaggaattgaactcatctctgcaccgagcagacctaatagacatctacagaattctccaccccaagtcaacagaatatacattcttctcagcaccacaccgcacttattccaaaattgaccacatagttggaagtaaagcagtcctacacaaatgtaaaagaacagaaattataacaaactgtctctcagaccacggtgcaatcaaactagaactcaggattaagaaactcactcaaaaccgctcaactacatggaaactgaacaacctgctcctgaatgactgctaagtacataacgaaatgaaggcagaaataaagatgttctttgaaaccaacgtgaacaaagatacaacataccagaacctctgggacacatttaaagcagtgtgtagagggaaatttatatcactaaatgcccacaagagaaagtaggaaagatctaaaattgacaccctaacatcacaattaaaagaactagagaagcaaaagcaaacacattcaaaagctagcagaaggcaagaaataactaagatcagagcagaactgaaggagatagagacacaaaaaacccttcaaaaaatcagtgaatccaggagctggttttttgaaaagtacaacaaaattgatggaccgatagcaagactaataaagaagaaaagagagtagaatcaaatggatgccataaaaaatgataaaggggatatcaccaccaatcccacagaaatacaaactaccatcagagaatactaggaacatatattaatatcattcactaaaatataacctgaggaaagttaatttttttgacagtgcttcccgtgtaacttgctatgtcaaataattctgtttacctttcctctgggtgcttaagggtccctctggagcattccaagttagaggtcgcataatataattttgaagctgcaatttgattttgggaaggccatcaaatatggtaaagttttaaaacagtttgatatgatgaaatggaattctaggtactgtaagtcattcatttagccaaaatgatgactcaaaaaatttaagaaggcaaaaactgttagtcattgataggcagaaaccttagctttccaaacagtctgtctcttgtctttcccttcttttttggtagtttattcaaaaggcaaagaaaaatcttttattgtcctttactattgcatgaaaatcttgttcaagagagaaagcaaaatttcaccctggcattagtgtaccatgaatgttaaccctaattcttaagaaatcttatagacaaattgattcaatcttaatcatttggaccataaggtgagattcccataaaccttttattaccctttacaaatttttgttgaagagcagattagtgctctaagaaaaccctgttgtgcttttatttcaatgttcaagttatggaaaaaataataatacctctttaaatttagtcaatatgtttacagacaaaatttgttttacaatattaatttttacgaaccttttacaacttggtgaaacgtttacctttatcttatgtaatttaaaacaatcatttagccctttaatctaggcaaacatttacattcccatgccttcttataatattttaccaaaaatactttttattgtcttcacacaccttgcatataaaacttttttcagtagtctcaaatacatgttataatggtaactctccagaattttaatttttggtagaaaacctggcaagtaagtaattttaattatgtagtaggtttgtatccaaggaaatcagacagaagtacagataaggtgtgactctttcatcatttctgttagacttcactgcttcccaggttaacatttatgcatgtgttagccagaggaactcagttcttcagaaattaaaaattaaatttgtacctaaaatattggctttgctctcagattcccctgatgaacttagccaatgatttttcctacctaagtgtgcacaaaaaaaaatgtgaaacaaaggggtagaacgtaaaaatcctcatgaatatccagaagccaattttttttcaatttctacaatattgccatttactgccagtttttttctgacccagtcaggtgtaagagccctctaactggatccaagccagttaatcactggaacgaatccaatcctggaccaagtccggtttctatagtgacttataaaccaagtttggatgagaaattcgcccaaagaaactcaaagagctcaaaacacaaatccatgaagctccaaaacccaaaagagaacttaaccaagatctctagctcctctgatagatcaaacgacacaattgggtccttgcagttaccttgcttgttcactcagtgctcctgggggtcgttaaaagttctacttcagatgccacttctgacatcatctgttaaaagaaaaaaatcagccaaattaaatgtaaaggagtttaactgagcaatgaacaattcatgaatcagacagccatcagaatcacagcagattcagggaggccagcacagccacttcatggaagaagatttataaacaaaaaaaaaaaaaagagaagtgacatacacaaattggaagtgaggtacagaaacaactggattggtcacagctcagtgtttgcattattcacagtttgaacactcagcagcgtatcagtggttgaagtatggtttctgggattagccaaggctcagctattgttacagacacatactcctaaattaggttttcagtcttgtctacgtattaaattaggttgtggttcatccacaaggactcaaatatagaagtgcagagtctttctcagccatatttagtttgcttaacagagtaaaaatgtttttaaaaagtttaaagtttataaagtaaaagcattacaataacctaattttaatttattatggaagaaagacatttttaaagataaatttagtttagcctaggtatacagtctaactatagctggagtcttcaacatacctctatcaacatttgataaaacaagccagaaatcatcaaggatatagaaccatcaccatcaaccagcagaatctcattgacatttatagaacacttcacccagcagcaggatacacattctttgcaagtgctcatggaacatataccaaaatagatagaccatttcctgggatataaaataatccccaacaaatttaaaagaacagaaatacagaaatgtgttgtgtgacattaataaaatcaaactaaaaaccagtaaaccagaaaaaattaccagaaaaatctacacacgcttggacactaaacaacatatatctgaatgatgtgtatttcatagagagtctcaagaaaaataaaaatacactaaactgagtgagctgaaaaatatcaaaaattgtgagatgcagtaaaagcagtaatgaaaaaaattaacagcactaaatgcttacattataacagaagagatgccttaaaacaataatctaagctcccacttcaagaaactcgaggaagaagagaaaaataagatgaaggcaagcaaaaaacagaaactaataaaggtaagaacagaaatcaatgaaattgagactagaaaacaacaaagaaatgaatgaaacatttatatatttaaaacaacatatacacatttcatgcacattacctgtgctgtgaaatcccactcctgagatgaatccctggttgttttaagaatctatctatctatttatctatccaaacatatatatttcatatatataaaacaaccagggtttatccccagtgaaatttatatttaaatagacgtgtgtgtgtgtgtgtgtgtgtgtgtgtgtgtgcacgcatttaaaacaaccaaggggtttttccaagatggctgaataggaacagctctgatctgcagttcccagcaagaccaaagcaggaggtgggtgactgctgcatttccaactgaggtacccggttcctctcgttgggactggttagacagcgggtgcagcccacagagggcgagcagaatcagggtggggtgtcaccttacccaggaagtgcaaaggaccagggacctccctgttctagccaagggaagctgtgaggctgtgctatctgccccagatactacgcttttcttatggtttttgcaacctgcagactaggagattccctcatggacctgtaccaccagggccctgggattcaagcacaaaactgggtggctgtttgggtagacactgagctagctggaggaggttttttttgttttgttttgttttggttttggttttttttcccacacgccaggggcacctggaacccaagcgagagagaactgttcactcctctggaaaggcggtggaagccagaaagccaagtgatctcgcttagcaggtcccacccccacagagcccagcaagctaagatccaccagcttgaaattctcactcccagcacagcagtctgaagttgacctgggatgctcgagcttggtggggggaggggcttccaccattactgagacttgagtaggtggttttccccacacagtgtaaacaaagccaccaggaagttctgacttagcggaaaccatcatagcacagcaaagcagctgtggccagactgcctctctagattcctcctccctgggcagggcgtctcgggaaaaaaggcagcagtcccagttaggggctcatagatggaactcccatccctgggacagaacacctgggagaaggggtggctgtgggggcagcttcagcagacttaaatgttcctgcctgccagctctgaagagagcagaggatctcccatcagagtgctagagctatgctaagggatggactgccttgtcaagtgggtccctgacgcctatgcctcctgactgggagacacctcccagcaggagtcaacagacaccgcatacaggagaggtcagggtggcatctggcaggtgcccctctgggatgaagtttccagaggaaggagtaggtggcaatctttgctcttctgcagcctccactggtgatacccaggctaataggatctggagtggaccaccagcaaactccagcagactgcagaagaggggactcactgttagaaggaaaactaacaaacacaaagcaataacatcaacatcgacataaaggatgcccacacaaaaaccccatttaaaggtcattaaagtcaaagatcaaagttaaataaatacacgaagatgaggaaaaaccagtgcaaaaaagatgaaaattccaaaagctacaatgccacctctcctacaaaggatcacaactcctcgccagcaagggcacgaaactggatggagcaagagtttgacgaaatgacagaagtaggcttcagaaggtgggtaataacaaacttctctgagctaaaggagcatgttctaacccaatgcaaggaagctaagaaattttataaaagttgacaagaactgctaactagaataaccagtttagaggaaaacataaattacctgatggagctgaaaacacagcacgagaacttcatgaagcatgcgcaagaatcaatagccaaatcaatgaagcagaagaaaagatattagagattgaagaccaactttaagaaataaagcatgaagacaagattagagaaaaaaaatgaaaaggagcgaacaaagcctccaagaaatatgggactatgtgaaaagactaaatctatgattgactggtgtacctaaaagtgatggggagaatggaaccaagttggaaaacactcttcaggatattatccagaagaacttccccaacttagcaagacaggccaacattcaaattcagaaagtgcagagagcaccactaagatactcctcaagaagagcaaccctaagacacataagcgtcagattcaccaaggttgaaacaaaggaaaaaatgttaaaggcagacagagaaaaaggtcaggttaccaacaaaagaagcccatcagactaacagtggatctctctgcagaaaccctagaagcaagaagagagtgggggtcaatattcaacattcttaaagaaaaaaaattttgagattgagaccatcctggctaacatggtgaaaccccgtctctactaaaaaaatacaaaacaattagccaggcatggtggcaggcacctgtagtcccagctactcgggaggctgaggcaggagaatggcatgaacctgagaggcagcgcttgcagtgagctgagatcacgccactgcactccagcctgggcaacagagcgagactccatctcaaaaaaaaaaaaaaaaagaaaaaagaaaaaaattttaacccagaatttcatatccagctaaaataagcttcacaagcaaaggagaaagaaaatcctttacagacaagcaaatgctgagggattttgtcaccaccaggcctaccattcaagagctcctgaaggaagcaataaatatggaagggaaaaactggtaccagccactgcaaaaacgtaccaaaatacaaaaaccaatgacactaggaagaaactgcatcaactattgtgcaacaaaccagctagcatcatgattacaggatcagattcactcataacaatattaaccttaaatgtaaacaggctaaattccccaattaaaagacagagactggcaaattggataaaaaagactcaagacccatcactgttctgtattaaggagacccatctcatgtgcaaagatacacatgcgctcaaaataaagggatggatgaatatttaccaagcaaatggaaagcaaaaaaaaagcaggggctgcaatcctagtttctgataaaacagaccttaaacaacaaagatcaagaaagacgaaggatattacatgatggaaaagggatcaatgcaacaagaagagctacctatcctaaatatatatgcacccaatacaggagcaccaagattcataaagcaagttcttagagagctacaaagagactaagacttccacacaataatcatgggaaattttaacaccccactctcaatgttagacatatcaatgagatggaaaaaaatacaaggatattcaggacttgaactcagctctagcccaagcggacctaatagacatctacagaactcttcactccagatcaacagaatatacattcttctcagcaccacatagcactttttctaaaatcaaccacataaaggaagtaaaacactcagcaaatacaacagaacagacataataacaaacagtctgtctgaccacagtgtgatcaaattagaactcaggattaagaaactcattcaaaaccatacaacttcaaaagaagacatttatgcagccaacaaacatgaaaaaaagctcatcatcactggtcattagagaaatgcatatcaaaaccacaatgagataccatctcacaccacttagaatggtgatcattaaaaagtcaggaaacaaaagacgcagtagaggatgtggagaaataggaacacttttacactgttggtgggagtgtaaattagttcaacccttgtgaaagacagtgtggtgattattcaaggatctaattagaaataccatctgacccagcaatcccattactgggtatatacccaaaggattctaaatcattgtactataaagacacatgcacatgtttgcttattgcagcagtattcacaagagcaaaaacttggaaccaatgcaaatgcccatcaatgatagactggataatgaaaatgtggcattatacaccatggaatactatgcaaccagaaaaaagaaggagttcatgtcccttgcatagacattgatgaagctgaaaaccatcattctcagcaaactaacacaggaacagaaaaccaaacaccacatattctcactcataagtgggagttgaacaatgagaacatacaggcacaaggagggaaacatcacacaccaggacctgttggggggtgggggggcaaggggagagatagcatttggagaaatatgtaatgtagatgacaggttgatgggtgcagcaaaccaccttggcacaaacctgcacattctgcacatgtatcccagaaattaaagtataataaaaaaatcaatgaatctaggagctggttttgggaaagattaacaaaatagacggctagccagactaataaaaaagaaaagagaagaatcaaatagacacaataagtagtgataaaggggatatcaacactgaccccatggaaataaaaactaccatcagagaatactaaaaacacctttatgcaaataaactagaaaaatctagaagaaatggataaatttctggacacaaacacactcccaagactaaactagagggaagttgaatccctaattacaccaataacaacttctgaaaatgaggcaataattaatagcctaccaaccaaaaaaaagtccagggccaggcggattcacagccaaattctatcaaaggtaaaaagaggagatggtacaatttcttctgaaactattccaaacagtagaaaaagagggactcctccctaactcattttatgaggccagcattattctgataccaaatcctggcagagacacaacagcaacaacaataacaaagaaaatttcaggccaatattgctgattaacatcaatgagaaatactggcaaaccgaatccagcagcacatcaaaaagctcattcaccatgatcaggttggtttcatccctgggatgcaaggctagttcaacatatgcaaatcaataaacgtaatccatcacataaacagaaacaatgacaaaaacctcatgattatttcaatagatgcagaaaagacattcgataaaattcaacacctcttcatgctaaaaacattccataaactaggtattgatggaacatatctcaaaataataagagctatttatgacaaacccatagccaatatcatactgaatgggcaaaagctggaagcattccctttgaaattcagcaaaagacaagaatgacctctctcaccactcctagtcaacatagtattggaagttctggccagggcaatcaggcaagagaaggaaataatggtattcaaataggaagagaggaagtcaaattgtctctgtttgcaaatgacatgatggtatattcagaaaaccccattgtctcagcccaaagctccttaagctcataagcaactttagcaaagtctcaggatagaaaatcaatgtgcaaaaatcacaagcattcctatacaccaataatagacacacagagagccaaatcatgagtgaactcccattcacaattgctattaagagaataaaatacctaggaatacaacttacaaaggatgtgaaggactgcttcaaggagaactacaaaccactgctcaaggaaataaggacacaaacaaatggaaaaacattccatgctcatggataggaagaatcaatatcgtgaaaatgaccatactgcccaaagtaattcatagattcaatgctattcccatcaagctaccattgaatttattcacagaattaggaaaaagtactttaaatttcatgtggaaccaaaaaagagcccgtatagcaaagacagtcctaagcaaaaagaacaaagctggggatatcacgctacctgacttcaaattatactacaaggctatggtaaccaaaacaccatggtactggtaccaaaacagatatatagaccaacggaacagaacagaggcctcagaaataacaccacacatctacaaccatctgatctttcaccagtctgacaaaaacaagcaatggggaaaggattccccatttaatatgtagtgttgggaaaacaggctagccatatgcagaaaactgaaactggaccccttccttacaccttatacaaaaattaactcaggatgaattaaagacttaaatgtaagacctaaaatcataaaaaagaaaacccaggcagtaccattcaggacataggcatgggcaaagacttcatgactggaacaccaaaagcaattgcaatgaaagcaaaattgacaaatgggatctcattaaactaaagagcttctgcacagcaaaagaaactatcatcagagtgaacaggcaacctacagaatgggagaaaatttttacaatctatccatctgacaaaggtctaatatccagatcctacaaggatcttaaacaagtttactagaaaaaaccaaccccattaaaaagtgggtgaaggttatgaacagacaattctcagaagaagacatttatgtggccaacaaacatatgaagaaaagctcgtcatcactggtcattagagaaatgcaaatcaaaaccaaaatgtgatagtatctcatggcagttagaatggtgatcattaaaacgtcaggaaacaacagaagctggagaggatgtggagaaataaggaagcttttataataattgcaaaaattttctcccattctttaggttgcctgttcccactgataatagtttcttttgctgtgcagaagctctttagtttagttagatcccttttgtcaatttttgcttttggtgccattatttttggtgttttggacatgaagtctgtgcccattactatgtcctgaatggtattgcctaggttttcttctaggatttttatgattttaggtgttatgtttaagtctttcatccatcttgagtaaatctttgtataaggtgtaagtaaggggtcgagtttcagttttctgcatctggctagccagttttgccaacaccatttattaaatagggaatcctttccccattgcttgtttgtgtcaggttggtcaaagatcagatggttgtagatgtgtggtgttatttccgaggcctctgttctgttctatgtatctgttttggtaccagtagcatgcagtttcggtttctgtaaccttgtagtatagtttgaagtcaggtatcgtaacacctccagctttgttctttttgcttaggagtgtcttggctatgtgggctcttttttggttccatatgaagttaaaagtagtttttttccaattctgtgaataaagtcaatggtatcttgatggggatagcattgaatctataaattactttgggcagtatggcaatttttacgatactgattcttcctatccataagcatggaatgtttttccatttgtttgtgtcctctcttatttccttgagcagtggtttgaagttctccttgaagataaccttcacatcccttgaaagttgtattcctaggtattttattctcttagtagcaatggtgaatgggagttcactcatgatttggctctctatgtgtctattattggtgtataggaatgcttgtgatttttgcacattgattttgtatcctgagactttgctgaaattgcttatcagcttaaggagattttgagatgagacaatgaggttttctaaatatatgatcatgtcatctgcaaatagagacaatttgacttcctctctttctatttgaataccctttatttctttcatttgcctgattgtcgtggccagaaattccaatactatgtggaatagaagtggtgagagagggcatccatgtcttgtgccagttttcaaagcaaatgcttccagctgttgcccattaagtatgatattcgctgtaggtttgtcataaataggtcttattattttgagatacatttcattgatacctggtttattgagagtttttagcataaaggggtgttgaattatgtcacaggccttttctgcatctagtgagataatcatgtgacttttttgtcattggttatgtttatgtgatggattgcatttattgatttgcatatgttgaactaactttgcatcccaggtatggagccaacttgatcgtagtggataagctttttaatgtgctgctggattcagtttgccagtattttattgaggattttcacatcgatgttcatcagggatattggcctgaaatttcccttttttgttgtgtctctgccaggttttggtacccggatgatggtggcctcataaaacaagttagagagtattccctctttttctgttgtttggaatagtttcagaaggaatggtataagctgctctttgtacctctggtagaattcggctgtgaatccgtctggtcctggactttttttggttggtagtctgttaattactgcctcaatttcagaacttgttattagtctattcagagattcgacttcttcctggtttagacttgagggggtgtatttgtccaggaatttctccatttcttctagattttctagtttatttgcatagaggtgttcatagtattctctgatgatagtttgtatttctgtgggatcagtagtgatatgccctatgtcgttttttactgtgtctatttgattcttctgtcttttcttctttattagtctggctagcagactatctattttgatgacttttttcaaaaaccagctcttgaattcattgatttttttgaaggttttttcatgtctctagctccttcagttctgttctgatcttagttaattcttgtcttctgcgagcttttgaatttgtttgctcttgcttctctagttcttttcattgtgatgttagggtgtcaattttagatcttttctgctttctcttgtggggatttagtggtataaatgcccctctacacactgctttaattgtgtcccagagatcctggtacgttgtatctctgttctcattggtttcgaagaacatctttatttctgccttcatttcattaattacctagttgtcattcaggagcagattgttcagtttgcatgtagttgtgtggttttgagtgaatttcttaattctgagttctaatttaattgcactgtggtctgagagactgttatgattttcattgttttgcatttgctgaggagtgttttacttctaattatgtggtaaattttagaataagtgcaatgagttgctgagaagaatatatattcttttggtttggagtggagagttctgtagatatctattaggtcagcttggtctagagctgagttcaagtcctgaatattcttgttaattctctttttcgttgatctgtctaatattgacagtggggtgttaaagtctcccactattattgtgtgggagtctgtgtttctttgcaggtctctaagaacttgctttatgaatctgggtgttcctgtattgggtgcatatatatttagaatagttagctcctcttgttgcattgatccctctaacattatgtaatgcccttctttgtctcttttgaccaacaaacacaaccaacaggttagtttcaagtctgctttaccagagattaggattgcaaccccagcttttttttttttctttccatttgcttggtaaatattactctgtctctttattttgagcctatgtgtgtctttgcatgtgagatgggtcccctgaatacagcacactgatggatcttgactctttatccattttgccagtctgtgtcttttaactggggcatttagctcgtttacatttaaggttaatattgttatgtgtgaatatgattctgtcaatttgatgctagctggttattttgcccatttgttgcagtttcttcatagtgtcaatggtctttacaatttgttgtttttgcagtgactggtacctgttgtttctttctatgtttagtgcttccttcaggaggtcttgtaaggcaggcctggtggtgacagaatctctcagcatttgcttgtctgtaaaggattttttttctccttcacttatgaagcttagtttgggtggatatgaaattctgggtttaaaattcttttctttaaaaatgttgaatactggcccccactctcttctggcttctagggtttctgcagagagatctgctgttagtctgatgggcttccctttgtgggtaacccgacctttctctctggcttcccttaacattttttcctttgtttcaaccttggtgaatctgatgattatatgtcttggggttgctcttctcaaggagtatctttgaggtgttctctgtatttcccgaatttgaatgttggtctgtgttgctaggctagtgaagttctcctggataatatcctgaagagtgttttccctgttggttccattctacccatcactttcaggtacaccaatgaaacgtaggtttggtcttttcacatagtcccatatttcttggaggctttgtttgttcctctttattcttttttctctaatcttgtcttcacgctttatttcattaatttgatcttcaatctctgatatactttcttctgcttggtcgattccactattgattcttgtgtatgcttcacgaagttcttgtgccatggtttttatccccatcaggtcatttatgttcttctctaaactggttattctagttagcaattcctctaacctttttcaatgttcttagcttccttgcattgtgttagaacatgctcctttagctcagaggagtttgttattacccaccttccgaagcctaattctgtctgttcatcaaactcattctccatctggttttgttcccttgctgatgaggagttgtgatcctttagaggagaagaggcattctggttttcatctttgtagatttatttacctttggtttttatgttagtgaccttagaatggggtctctgagtggatgtgttattcctttatgtttgttagttttccttctaacagtcgggcccctctgctgcaggtctgctggaatttgctggaggtccactccagaccctgtttgcctgggtatcaccagcggaggctgaagaacggcaacgattgctgcctgttctttcctctggaagttttctcccagaggggcacctgccagatgccagccagagctctcctgtatgaggagtctgttggcccctactgagaggtatctcccactcaggaaacatgggggtcagggactcacttgaggaggcaatctgtcccttagcagagcttgaatgctgtgctgggaggtccactgctctcttcagagctgtcacacagtgacctttaagtctgccgaagctgtgtccaccactgccccttcccactggtgctctgtcccagggagataggggttttatctataagtccctgactggggctcctgcctttttttcagagatgccctgcccagagaggagaaatctggcagtctggccacagcaaacttgctgagctgccatgggctctacccattttgaacttccctgaggcttctttacactgtgaggggaaaactgcctactcaagcctcagaaatggcggacgcccctcctcccaccaaactcgagtgtcccagtcggtatcagactgctgctgtgctggcagagagaatttcaagccagtggatcttagtttgctgggatccatggggttggaacccactgagcaagactacttggctccctggcttcagccgctttccaggggagtgaacatttttttctcgctggcccttaaggtatgggggaaaaaaaaaaaaccctgcagctagttcagcgtctgcccaaagggccgcccagttttgtgctggaaacccagggtcctggtggtgtaggcaccgaaggggatctcctggtctgcgggttgtgaagactgtgggaaaagcacagtatttgagttatagtgcacaatgcagtccctaatggcttcccttggctgggagatggagttccccgaccccttgcacttcccagttgaggcgatgccccaccttgctttggctcgtccttcttggtctgcacccactgtccaaccagtcccaatgagatgaactgtgtacctcagttggaaatgcagaaatcacccaccttctgttttgatctcactgtgagctgcagacagagctgttcctatttggccatcttgccagcaatcaagacacaaattttctgatatcaggaatgaaatagaggatattgctgcagaccccacaggcatcaaaagaataataactatgaacaactgtgtacgtgtaaattggacaaattgcatgaaatggaccagtttatccaaacactaccacagttcacccacaatatattagagaatttgaataaccctatgtcactatttaggaaattgaatttgtaatttaacagtttccaaaaattgaatcttcaggcccagatgttacaatggagtaaaaatgttaaaaattttggagaatattccacatgtttaaggagaatcttccagtcactgcaatctgtttctcaggaagccacagtcctagcagaagggaccacaacaaggtaacaccctgtgggacaaaagaatctgaatagcaggtcttctctcccaggtctctctgctgataggatcagaggtgtccatctgacctgaatagccagaacactgggacaaggttgaggctgtgagttggatagctttcctgcttgcctggcaggggaattgaggtagcttccactcttcacccttataaaacctcagcacatctcattgagagctcctccaacacccttatcaagtctggggtcttagcctaccattatgtatgacatctcacctgccttagctacaactggtgcctatacaggaatatgtttcctcttgacctgaagcctgaatcatcaactcagcaagtataaaaatgggggaaaattaaataaacaaataaagtgtacaccatgagagaaggaaataagctttaagagatccctgccattctgaccccataagaaacagtgaacttgcccacacaccaagaacttaactactaaaaccatcatctgggaaagccagttggaaaagattctctataaataaggaactcatacagagttttcatcctaaaatcaccaagaatcaaactaggctaaaataaacattggcgtatgatccttaagaaagaaaaaaagaagttaaaaaaaaccacagtccaataaaaaataaattcaagaacaatttgattagtctacccaaatgagaaggaagcaggaaagtaattctggtaatatgacaagacagggttctaaatcatcctgaaaagatcctactagctccccagcattggatccaaaccaagaagaaatctctgaagtgccagataaagaattcataaggttgattagtaagctactcaagaagacaacagagaaaggtgaaaaccaacttaaattttaaaaaatcaggatataattaaaattttttcagaggaatagatatcataaaggaaaaaacaatgagagctactggaaatgaaagacacacttagggaaatacaaaatacagtggaaaattttaacaataagctagaacaagtagaagaaagaatttcagagcttgaagacaagactttcgaaataacccaaacagacaaatacaaataaaaaagaatgaaataaatgaacaaagtctccaaggaatatgggattatgtaaaatgaccaaacctaagaataagtggtgattctaagaaagaacagaaatctaaaagtttggaaaacttatttgagggaataattgaggaaaacttccctggccttgctagaggtctagacatccaaactgaagaagtcaaaagaactcctgggaaattcattccaaaacaatcatcattaaggcacagggtcaccaggttatctaaagtcaagattaaaaaaaacataattttaagagctgtgagataaaagataacctataaagcaaaacctatcagattaacagcagatttctcagcagaagctttacaagtcagaagggattggagtcttacctttcacctcctgaaacaaaataatgtcaccctaaaattttctatctagcaaaactaagcttcataaatgaaaggaagataaagtcttcttcaaaaacaaatcctgacagaatttgccacccccaaacaagcactacaataaatgctaaaaggagttctaaatgttgaaagaaaaccttgatatacaccaaaatataaccttcttaaagcataaatctcacagggcctataaaacagtaacacaatgaaaaaaatccaaaacatataggcaacaactacatgataagtacaacagtacctcacatttcaatactaacatcgaatgtaaatgggcctcaacgctacacttaaaagatacataatagcagaatgaattaaataaaccaccaaccaagtatgtgttgttttcaagagactcacctaatgcataaggactcatgtaagcttaaggtaaaggggtggtaaaaaatattccacacaaatggaaaccaaaagcaagcaggagtagctattcttatatcagacaaaacagactttaaagcaacaacagtttaaaaaaaaaagacaagcaaggacattgtataatgataaaaggattagtccaacaggaaaatatcaccatcctaaattatatgcacctaacactggagcacctaaatttataaaacaattggtactagacataagaaatgagataaacaacaacacaataatattggaggacttcaatactatacttacagcactagacagatcatcaagacagaaagtcaacaaagaaacagtggacttaaactataccctagaacaaacagaattaacatatatttacaaaacattatttccaacaactacagaatatgcattctttttttcagtgtatggaacattctccaagatagaccatatcataggtcacacaacaagtttctataaatttaagaaaatcaaaattatatcaagcattttctcagaccacaggggaataaaattggaaatcaacttcaaaaagaaccctcaaaactatagaaatacatggaaagtaagtaatctgctcttgaatgagctttgggtcaacaatgaaatcaagatagaaatttaaaaattatttgaaatgaatgataatagttacacagcttacaaaaacctgtgggatacagcaaaagtggtgctaagacaaaagttcatggtgttaaatgcatcaatcaaaaagtctgaaagagcacaaatggacaacccaatgtcacacctcaaggaacaagggaaacaagaacaaactaaactcaaacccagcagaagaaaagaaataacaagatcagagcaaaactcaatgaaactggaacaaacaaaaacaatgcaaaagataaatgaaacaaaaagctgattctctgaaaagataagcaaaattgatagactgttagtgagattaaccaagaaaagatccaaatgaactcaatcagaaatgagactggagatattacaactgataccatggaaatacaaaagataattgaagtgtactatgaacaccttttcacacacaaactagaatgtgtagaggatgtggacaagttcctggaaatatacaagcctcctagattaaatcaggaagaaacagaaaccctgaacagaccaataacaaaaagcaagattgaaactgtaattttaaaattgccaacaaaataagttcagaaccaggtggattcacagctgaattctatcagacattcaaataagaattggtaccaatcctactgaaaccattccaaaagacagtaaaagaagaaatcctcattaaatcattctatgaagccagtgtcaccccaatacccaaaccaagaaagaacacaaccaaaaacgctacagaccaataccctgatgaacatagattcaaaaatcctcagcaaaatactagctacccaaatccaacagcatattaaaaagataatacaccatgatcaagtcagttttatcatagggatgcaggtatagtttaacatacacaagtcaataaatgtgatacatcacataaacagaatcaaaataaaaaatcatatgattagctcaatagatgcagaaaaagcatctgataaaattatcccttttttataaaaacactcacaaaaactggcatagaagagacatacctcaagataataaaagccatctatgacatacccacaggcaacattatactgaatggggaaaaattgaaaacattccccgtgagaactggaacaagacaaggatgcctattgtcaccacttctattgaacatagtactggaagtcatagccagtgtaatcagacaagagaaagaagtaaagagcatccaaattggaaaagtggaagtcaaaatgtcactgtttgccaatgatatgatcatatgcctagaataccctaaagaataatccaaaagctccttggcctgataaacgaattcagtaaagtctcaggatacaacatcaatgtacacaaatcagtagcactgctatataccaacaatgactaagctgagaattaaatcaagaagtcaacccattttacaacagccgcaaaaataataataataagatatttagaaataaccaaggaggtgaaagatatctgcaaggaaaactacaaaacactcctaaaaaagatcatagatgacacaaacaaatggcaacatattccatgctcatggaggggtagaatcaatagtatgaaaatgaccatactgcccaaagtaatccacagattcaatgcaattctaatcaaaataccatcatcattctttacagaacaagaaaaaagcaatctaaaattcatatggaaccaaaagagagcccacatggctaaagcaagactaagaaaaaggaacaaatctggaagcatcacatttcccgacatcaaattatactacaaagctataagctaccaaaacagcatggtaatggtataaaaataggcatgaagaccaatgaaagacaatagaaaacccagaaataaggccaaatacttacggccttctgtaagtattgacaaagcatacaaaaacataaagtggggaaaggacaccctattcaataaatggtgctgggaaaactggcaagccacatgtagaagaatgaaactagatcctcacctctcaccttatacaaaaattaactcaaaatggatcaaatacttaaatctaagaactgaaactataaaaatactagaaggtagcattgggaaacttttctggacattggcttaggcaaagaattcatgactaagactccaaaatcaaacgcaactaaaacaaaaataaataaatgggacctaattaaactaaaaatcttctgtacagtgaaattatcagcagagtaaacagacagcctatagagtgggggaaaatatttgcaaactatgcatctgacaaaggactaatacccagaatctacaaggaactcaaacaaataagcaaaaacaacaaaaaaaatcccatcaaaaagtgggcaaaggggcaggtgcagtgactcacgcctgtagtcccacaactttgggagtccaaggaaggcagatcactggaggccaggagtttgagactagcctggccagtatggcgaaatcctgcctctactaaaaagaaaacacaaaaattagctggcacggtggcttatgcttgtggtcccaggtatttgggaggctgaggcatgagaattgcttgagcctgagaggtggaggttgcagtgagccgagatcatgtcactgtacctcagcctgggtgacagagtgagactgtgcttcaaaaaaaaaaaaaagaaggagaaagagaagaaaagaaggagaagaaggagaaggaggaggaggagaaggaggaggaggaagagaagaagaagaaggagaagaagaaggagaagaaaaagaagaagaagagaagaagaaaagaagaagaaaagaagaagaaggagaaggagaagaagaagaggaggaggagggggaggaggaggagaagaagaagaggaggaggaagaagaagaagaagaagaagaagaagaagaagaagaagaagaagaagaaggagaaagcaggcaaaggacatgaataggaaattctcaaaagaagatatagaaatggctaataatcatatgaaaaacccgcttaacatcactatactatactacaagtctgcagtaaccaaaacagcatggtactagtaccaaaacagatatatagaccaatggaacagaacagagtccttggatttaatgccacaaatctacaaccatctgatctttgacaaacctgacaaaaacaagtgatgtggaaaggattccctatttaataaatggtgttgggaaaactggctagccataagcagaaaaattaaacaggacaccttctttacaccttatacaaaaattaactcaagattgattacagacttaaatgtaagacctaaaaccataaaattcctagaagaaaacctaggcaataccattcaggacataggcatgggcaaagacttcatgactaaaacaccaaaagaaatggcaacaaaagccaaaattgacaaatgggatgtaattaaactaaagagcttctgcatagcgaaaaaaactatcatcagagtgaacaggcaaactacagaaaaaatttttgcaatctatccatctgacaaaagtctaatatccagaatctacaaggaacttaaacaaatttacaagaataaaagaaagaaccccatcaaaaagtgggtgaaggatatgaacagacacttctcaaaagaagacacttaagtggccgtcaaacatatgaaaaaagctcatcatcactggtcattagagaaatccaaatcgaaaccaaaatgagatactatctcacaccagttagaatggtgatcattaaaaagtctgtaaacaacagatgctgattatgtggagaaataggaatgtgtttacactgttggtggaagtgtaaattagttcaaccattgtggaagacagtgtggtgattcctcaaggatctagaaccagaaataccatttgacccagcaattccattactggatatatacccaaaggattataaatcattgtactataaagacacatgcacacatatgtttattgcaacacagttcacaatagcaaagacttggaaccaacccaaatgcccatcagtaatagactggataaagaaaacgtggcacttatacaccttggaatactatgcagccataaaaatggatgagtttatgtcctttgcagggacatggatgaagctggaaaccaccattgtcagcaaactaacacaggaacagaaaactaaacactacatgttctcactcataagtggtagttgaacaaaaagaacacatggacacagggaggggaacatcacacactggggcctgtcggggtggggggctagggtagggatagcattaggagaaatacctaatgtagataacgggttgatcggtgcagcaaaccaccatggcatatgtatacctatgtaacaaacctgcatgttctgcacatgtgtcccagaacttaaagtataataataaaaaaaagaaagaaaaatttgataaattggacttttaaaaaaaatttaaatactcttccaaagaccctttcaaggtgacaaaaaggcaagctactgcgtgggagaaaatattttcagccacatgtctgcggaaatactcaaatctagaatatataaagaaatattaaaactcaacagtgagaaaacaaatatggttgtccctcagtgtatataggggattggtcctaggcctctacctgtaccaaaatttgcacatatccatactcaatcttacagtcagccctgggcatacaaaaagtcagccctccatatatgcaggtattacatcctgtgaatactgtatttttgatccatattttgttgaaaaaaatccatgtacaagtgaatctatgcagttcaaacccatgttcttcaagggtcaatggtaatccagttagaaaatgaaccaaagacatgagcagacatttcatagaaaaggatatatggatggcaaataagtatgtggaaaggtgttcaacatcaatgggcattagggaaatgcaaattaagatcactttgaagtatcactacatatttattatgatagttaaaataaaatagttggccaggtggagggactggatcactcatattttgctggtgggcatgtgaaatgatacactctggaacagttgggcagtttattgaaaagctaaatgtgcaattatcatataacccagcaattgtactcttggatgaaaacttatggttaccataaaacttgtacatggatattcatagtggctttattcataattaccaaaaattagagtgagtctagatgtcctttaatagacattgtttgagattgccattgcatggtggtaataaagagtagaccaactttagttggttttatttttatattttaattttctacacacagcatacccccttattgtcttcaccccagggtagactgttgttactgccctgcacttgatgcaccactattgaaagatattaatggcaccatcaaagcctgcagtgacattgttgtccctccactaaagcaaggaccaggcttccctcagagaaactgactttacaaatagtaaatagaggctctttctgaaacctatcttcgtaaacatatttccctctcctaacaaggagttttggcccttctgccctttagtcagggtcttggtccttggtatttcttgccacagcaggcaatagacaaaggctcccaaagaccttggatggaggcagacattgtggctatgtaccttgtacccaaaggattaagctgccatcttgctggtggcagcccttcaccccagagagaggaaatgccactggtgctttgaggaaggctttgtgcctttgattttccatgtcaagtcagcacttaactgtgaccctggacacatgaggtgaaaaatctttggtttattttggcattaatgtctcttgcccaataacatgggtttctgtaaacagaagtaggcatggagggaggagggaggattacataaaagggactcatccaagcagggctagctgcactatgctgatttctattaaatggcaatgggagataccctcttacccctgatttcagttagtggtagttactttcatcttaatcgaattaattacaaattgggaaggcttgggtcagcttcataaaatgctgttatttatgttgacatttttatgtggctttagctaatatatgttttaattttagattcagggactacatgtgtacatttgttatatgaatatgttgcataatattgaggtttgggcttctagtgtacccatcacccaaatagtgaacattgtacccaataggtaatttttcaacctttattcccttcccattctcccactaatgattattattttaatctcagtaaccagcaatatacctggccactcatgcatgtgcacacacacaaaccctatttgctgtagtggaaaccactctggtgaaggagatatccatggtggaagagttgggcagagtggagaaagaaggaccctatcatttgttgactgcccaccatgtgccacatactctgcttggtgactttacatgtcttagctcatttaatcctcaccacataatgtgtaaagtagatgctattattattcctgtgttactgatgaggaagccaaggctgagggaagtgaagtgagatgatcagataacgtcactcttccggtgcttaaaattataaaattccccttccactgaggataaaagtcccaactcgtcccattctccaagctatgttttagggcctgtcaacctccctagttttatctaggcccctctccctcttgcagtaggtgctccagccacactgctcttcactcagttcctttaatgtgccatattcttcttctgtggggccattactcatgctattctttttgtctggactgttctcctgtgtgcccacctgcactcaccagcgaactcctattgattcttcaggtctcagcttagatttcacatcctcagttctcagggaagcctcctctgactgtcccctttaccctatagtgtccctcagactatgttaggtccctttgttgtatccttctatcacattctgcatctcctccctaccactaatatgattttacatacaaccttgtgttcaggatcgattttcttcattagatgaaacttgctgtctatatactgtcttgttctctgctctatccctagtacctagtacaatgaatgcctggcacatgataagtattcaataaataattattgactgaatatatattgaaaccctctataattaatacatagtaagtgctcaataaatatagttaaaatacagttgttattattgtccaaaagcaaatagttaatcagaggcagaaccaggatttataattgaagtctgagtctaaagcgcatgcttcttttatgatatgactttgtctgcagaaataggttcttggcccagcactgccctaactggttgtatgacacttagggtgagacactatactactctgaatcttagttttcccatcggtaaaatggttacaggagcaggcaaagttcaggtttatcttcacgtaacctagaaaaggaggagaatagaagtctagatagatggggatataagcaaataagtaattaaccaatacaaatcagtatcttccctctgcaagacagttgatgagctataacaagaacccttgatgtttttatgcccttcagcctggtaaccctgttcaaaggcaatatagagtagtggatggtatggatggtatgtaggctttggtgttagagagccctggttcaaatcccaacatccaatttactagctctgtggtactgggcaagttaccaccctgaacctcactcaattcccttctctacaaatgggataacacccaccttttaacccatttctaaggttacaaaaaaaaaaaaaatacaataacatgaaaagatgttttcttagtatagaaagagaaacttctcccaccatcctacccacctaacagttctttctgtagttctgtgccattgaaggctacctcttgaggcaagaggcacaggcaatgtcaagaaaagagagactgaagacaagcaggctgatggcagaagccagagtccagtgtgtggagttggatcacccataggatagactggggcagaggggaagatcagctactgagggagaagaaaggagactacaaatctgagtaaggggataatggctaggcagatcctgagaagcatggtagggagccagtgggaagacaacaacatgccttagagggtacccctttcaaaactttgtagccctttcccagaggcaggcttcaaattatgttattaaaggcccttgaaactgtgtttcttccaaatctttttcttatttagtcacatccatgtatgttttgaaattgtaatcttagtgtgtacactttttcagcgagtatcttatcttcaacattttctatgtcacaagtcttcagtggctgtcaaatatcctaattttgctgaaagcccagaaagtacacctctgtgtattaactttttgcttccttgaattacctccttaaaatatattcccaagtataggattcctgagccacacggtatacaattgggatttaatgaccaaaaccaggtttttctttttctaagaaagaaattacccataatatcctttccccttccttttctggaactgataaacacaccctctagagttgtgctgtctaatatgacagccagtagccacacgtggctgtttaaattttaagtttgattaaataaaattcaaaactcagttcctcagtagcactggccacatcacaagtgctcagtagccatatgtgcatagtggctattatactggacagcacagatacaaaacatttccatcactgtagtaagtttattggacagtgcttacttagagtttctcaagagatcatttttggtttcttgggtgggagttctttgtgttcaggactttcctgggcattgagaggctatttagcatctctggcccatgtccactaaatgccagtaacacatttccttgagtcaatctaacagccaaaacactccatatttgcaaatgccccataagggaacaaaattaaccccattcgagacccactgagcttttagagggaaacatctcctaactttttcttgagacaaggtcttgctctgtcacctaggttggagtgcagtagtgcaatcatagcttaagcaatcctcctgccttatcctcctgagtagttgagactactggcatgtaccaccatgtgtggctaattctttctttctttctttctttttctttttctttttcttttttttttcttttttctttttcttttttttttttgtagatataaggtctcactatgttgcccatgctggtttcaaactcctgggctcaagtgatcctcctgcctctgtcttccaaattgctgagattactggcatgagccattgcacctggccttcttttttgagatggcctcaggttggctctgcctggagagggggaagcttgtaaagatggcttagaaaaaaagtcctggctccatttctattttctcccttcttttgctggcctgtttcctgctttttgcaaattgcaggaacaagaccctgcagatggagaagatcaaggctcgtttgaaggctgagtttgaggcacttgagtcagaggaaaggcacctgaaggaatacaagcaggagatggaccttctgctacaggagaagatggcccatgtggaggaactccgactgatccacgctgacatcaatgtggtacgtggctgcctggagcctatctctaaagcctttgagaaagaggtagtggtgaatgatagggcctttccttgagatgtggcttaggcctagctcggggagcaggcatcagtgcaggctgtggtagagcagaagaattcaggagttctgagatccagccctggctctgtcactaactgactatatatcactggacaagtcccttctctctgggcctcattttccctctctgcactataagggggactcagtaccctctaaatgtactgatttgatgtgctctcattctgggattctgggagttgagagctagccttggggaaaagcagagcaggcagctgcctctggaatgtagtttaaagcactccaagctttcagtcagaccaaacaaatcatttctgcctgctaccaaagtggagcttcctcattgatatatcctttggaaactcttggaacacagaatatgaactgtctgctaaggtggtaagctcccctctttggaattattcaagcagcatcttaatggacacttgtatgagctactgtactgatgattccttcacaaggaaggaggttggcagtgctgaccagtaaggtcttttcaaacccttatcacccataaccatgaagaatatatttttaaaatttactttcaaaggaactaagtttatatttctggaaaactcatttctgtggcaatactcattttctgatgttgtcagacctaggatcataaaggaaatatgaatgaggtttggacagtaagcaattgggattttctgtgttagagatcgcagaattctagatctcataaagtgttgacagtttggctgccagctaaccaatgatacagggccagttaaatgaggaagatatttgccagaagggctaagaatataagccagtggatctcaaacttgagcatgcatcaaagccactttgagagcctaagacacatattgctagactccacccctgattttctgattttgtatgtctgaggtgaacctaagaatatgcatttctgagttcccaggtgatgctgatgctgctgatcccttggccacattttgagaatcactgatctaggagaaaagactgctggcctgggaggcggaagccctaagtctttatgcaggatttgatactaagaagtatttccccaggaaagtccctttttctctttgagcctcagttttctataaaatgggagtaaggtggactaaatgagctctgaaggacattccagctctaagatactatatttgaacaataccatttatttagcagtaaatattaatttagcccatttactgagtgctttatatgaatcctatcattacatcttcaccaagattgcatgagttaagcactagaatatcaccattataccgatgaagaaactgagacttgaccagagttacatggagagggcatgggagatcaaggacttgaatatagactgaacaagttctggagcttgtgctattattcactcagctatagatcctctctgagaaccttaggatcttttctctgtgcctatcccactctatgttccagatggaaaacactatcaaacaatctgagaatgacctaaacaagctgctagagtctacaaggaggctgcatgatgagtataagccactgaaagaacatgtggatgccctgcgcatgactctgggcctgcagaggctccctgacttgtgtgaagaagaggagaagctttccttggagtaagctacctgcccccagtccctacaacataccctccctccgacccacatacatacttacatacctacacacacacgggcaggtatacatacacaaagcctagcctgaaagtcagagtgcctagttttagtcccaggcctttcagtggcttactcactgtgtgatcttgggcaagtctctgtgccagcttgttaaaacagaaggaggattattaaactggatgaattactagatgaattagaacaactactaggtggctttttaaattctttgtgtgatattgacaatacaagactatgtctataactcttaagagatcatttcccaagtcagggtctagaaggcgatatctagaaacctctaaaaacaaaaaagactgagctttcctggtcttcaggaagtggcctgggacttacttcatctcctggctcagagttaagaactaggcttgccttgcagagagacagaatttgacctggtagaggaaatcatttcctaaaggtagagcaaggtgtctgtggagtttgtgagcttcctactcttagagatatgtcaccagaggccttaggacacttaataggaatactcaaaagagcatgagatagcagataggactgaataccctttaaggatcttgctagccctaagatttcttggtcttcttggcctatcagagctaaggacaaagaggattacccttctcatcagacattgggcctagtacccagggacaatagccttgtgcttgggaaggtgtggggaccttctagaatgagccacagctcaacccttggttgtatggcatggagtctttaagaggagcaaggttctcattgctttcagaatgatctagccagtgtctctcatctccaaagttactttgagaagcagaaagcagaatggcagacagaacctcaggagccccccatccctgagtccctggccgctgcagccgctgccgcccaacagctccaagtggctaggaagcaggatactcggcagacggccaccttcaggcagcagcccccacctatgaaggtaagtgagctgggtaatggttgtggaggaagcaaagtatcctcccatggaagggccgtggaaggctagttctgggtctttggctttatttatgctgggccttcttttaatggcctttgcttgtgacacagtggaaggggtgacatgggtgtgctgtgttggacacacacagcacaggttttgttgccccatgttcccagaggtgttagaatgcagggagattttcaggccctgctagagtgcaattctaaaagttagaaatgactcttacacaaagatgtaatgagcatgtatcataaatgagggaaccagcaggattataaagctggttccaggagcatttggaacaaatatctatatagtcaagaaaggagaggaaggctgaaacaaatttgcaaagttagatgcaaaactggtttacatcccacaggacaataaaactgtaactttatagttactttttcttccaaacagaagtaatttgcatctctactgggcaaaagccatttgcagcttatcagtgtaacatcacagagcctgggtcctaatcaattggtaaatagtcaaacaaagagacattcttctagagcaggggtcatcaaattacagcctacaggtcaaatctaatctgttccctgttttcgttaaagttttattggcccacatgcatgtctgtgtttgcaagctattgcaaacaacatgcatgcaagctattgtctatcacttctttcatgcaaaacagaattgagtagttgcagcaagtttatatgatgtaaaaagtctaaagtatttgctgtcctggcctttacagaaaatgtttgttgacccctgttctagaaaattaaatagtccttaagtgggcctgttagacaatgcttcattataatgacgaaaagatgtgtagttctcattttgccttactttctagttttgtatactttttctcaacaccattctctgaactgggttatgtccttccttcccatcttccatggcatccaagaatacttgagtctactcactgattattgctctcttctgatgggaaatcactttgctttctgggcccctggggaatcagaagtctaagttgttgcctggaagaatctgactactaactttctttttcctgtgtccctcaccaggcctgcttgtcatgtcaccagcaaattcaccggaatgcacctatatgccctctttgcaaggccaagagtcggtcccggaaccccaaaaagccgaaacggaagcaggatgaataaagaaagggagagcacatgaagctttgctaattataacccctcaccttgaccagagtcattgatgtcctgatgtgaaacaacccttgcccaaccccacgaagtctcctatttaatgtgatggaagcacaacccctctctcactttgctcctatttctttctgctcttgggatttctggtttaggaagagatgtggttcaggtgctaaacagtgtgtctgatgatcccttctctcccactcacatttcaacccctgcccttgtttggagctaagggaagggcaaaaggctcagatatgattctctatctcttgtgcctgaggcctggagcctaaggagctgtagggtctgaggggcaggggaggcccatatcttgtttcaggtaaaggacccagtatttcccctccttgtacttttgccttaggttctcaagggacaatagtcttcatgttggattctccaacaggctgggtgcatgtatccccctactcctaccctcatctcatccttaaggcccagaggtagcttggacaagccctccttttcataatcatttgggaggcatggctgtaattctttagctttctccacttctgtctcccacatatactaaaattcttaggtactaggctgtgtgtcttgggatcttaagatcaatgaacctttccccaatatctagtctttgcaaattctagtagaagatttccacagtgaaatcagtgagccagaccaactctacatctcctgcctaacctactgcctaagtcattagggctgagggctcggctgtaggggcttccttaggctgagagtgcccccaggctgacatctgtgttggcttttgttcagaaccattactctggcacatgctcaatggtatattgcagggaggagaggagtagatttagatttgagtaaatgccaatcactttacacatgaaggtgggtgggactttccttccattcatcccttgctctcttggatctgaactcttctggagcctcagctcaggatagctgctggccactcctgtcctgtggattgtgcaggtggcctttcctcccaaaagaaaaggcatcaggctccccaagccccacagctctcctttccaccaaagccaggtttcctggtaaggtcactcgaagataagggatggggatgggggctgactgacaaaaaattttagccccaggtctcagtacctggctggggagggggatatttttccttccttaagtagttttacattgccacagtgtgtatgtgttcactatataaaatgttcctctgctctttgaaagtaagagtgttgtgtctgtacaaatccttttaacatgcattcattggagtaaattctgagtatctactgtgtattggataatacaaaagatgtaatgtcattt

SEQ ID NO: 4650 - DNA, 58505 bp, human
agaaatcatgtgcaaattggaaagcattaaagagatcaggtaagtggcacgttgtccccctccccgcccctctccaacccttcgttgcgggagagggctaattatctattgttgggctgtttgtctagaggagctggaaaggggcccattcaccacagacttgccggagaggtgaggatgggaggggcgctgaggagagttgagagagagagagacctcttgccagatgtggctgagaaagcaaagatgaagaaacacgggtttggtaccaagacagttttattcttctcgaggtggaggtcagggctctgcattcatggacacgttttttaaaagtacttgtgtgccccaaggtgtctttggctccttgctctttaggagtcgggatttttttccagtctcttgttcaacttcagaacctggagttcgggaaaggcttttgagagccaagtctagcgcatcggggctggtggctgctgccaggggctgccaactgggggttgcagaggaatctcagcgggcggagctgggagaatggcgcgcgctcgttttcctttcactcactcgccactttcttccttcctatcccgcgcttgggagggggatgggagcaatggggactggggacgcggtcgctgcgctgatggtgggatcgcgacagctgctctgaggagctggaggtgacaggcgggctggcaaagtgggagttgccgaagtggagtccgctacacggttgctcctggagcagcttttggcaaagcgatgatattgtccttgctcagaacacaatagcgccaggcgggctgtgtgggctggcacaaggtctttcttcacctcgccttctcagcgtgagcccctgctttggcttttgctctcactctgagagtggcctgggtcaagctctctccctggagtgttttctgagaacccaaggtggaagatgtcaagtgtgtttctttaagaaataagactttgatcatgagatttaacccttagagtgctggatgagacctacacatggtgattagtggtggtaggtaaagcaccttggtttcttcttcttcttgaggggttgcatctctctttctacaggagaggtaaaggaagggaactatcatttattgagtcccttcccgcccctgtgtgccaggccctttgacctacttttgctcattcagcaagagtcctgtgagcttcctactcctcctttacagctggggaaatagaggcccagagaatttgagtgattttcccacagccacgcagcttgaaattgccacattttgttggtctgcctgcaaaggtattccttttcccactatgtcccaggtaaagtctggaaaggagaagggaatatgttgcaattttttttttttttttttttttttttggcaaaagcatcagaagctagctagaaagtgagacaccttagtacagtagaatgccagctgtcataacgatgcagctagtcagaagcttaggcttgcaaatggagagcctagacttccactctcaccaagcttcaaaggaaccaccaccccatgcccagagaaggaccagttgtgagcaaggactttaatccccagtgaaaatagacctctcccagtgaagaccatatggagaaccatgacttctacccttaccagtggtaactaggagtttctacctcaaccagctaggatggaatcagcataggcccagagagaaggccaaactttcacctctaaacagcagtaacaaacagcccttctccaaactggatgtcaagagacagtggagaaactggacttctactgtccctcttccatccaagagagtggtagaggactgctaaaacaaaagatttaaataagatccagagtatccaacttttaatcaaaaatcactttccatactaagatatccacttgaatgagaagagaaaataaacagatgccaatactgagataacacccatgttagaattatctgataaggatcttaaagcacctgtcctaaaaacatttcagtgagcagttacaatacacttgaaacaaatgataatgtagaaaatctcagaaaatgaatagaaagtctcaacaaagaaatataaaacataaagaagaacaaagtgacatttttagaactgaaaaatacagtaacataaaaaccccaaaaaactcaatggataggttcaacagtaaggtggagaagagagagggaaaaaatagcttacaaatataaaacaatagaaatcactgtggcactataacaaaagctttaacatttatgccaacaaattcccaggagaaagagggcaggattggaaaagtattgggaaaaataatgactaaaatcttcccaaattgtgcaaaagacataaacatttagattcaagaagaggagcaaacaccaacataattgacacaaagaaacacactccaaaacacattgtaatcaaccttctgaaaatgaaagaaaaaggaaacttcttcaaaacagctgaagagaaacaaaagctacaaaggaaaaaaaaaattagaatgacagatttatcatcagaaactgacgatgccctagcattttgtaagtgctgaaggaaaagaagtgacaacccataaatctatgtccaataataatatccttcagtattgaatgggtaatcaagacattctccaatgaagaaatactaaggaatttagatataccctaaaaaaagatgatagtaagctctgaaaacagaaaagaaacaataaacagtaagcaaaagcatggttaatgcagtagactttctctttcctcttgaaatttcttgtattttgataattgaagctaaatttatactgttatctagtgtggtctcagcatatgtagaggaaatatttaacacatttatattgtaaactggggaatgtaaaggggattgtaaatgtaaagagatgtaaaggggaggacatgcttctacacttcattcaagcatgtaaagtggtaatgtcagaagactattaaataaattatgtatacataatatattactgagagaaaacactgaaaatgctatacaaagaaatgtactcaaaacattataaataaatcaatatgaatttttaaaaaatgctccagtcacccacaggcaggcagggcaaagaaaatggagaaactaaaattacggagaatgaacagaaaaaaaaataaaaaggcagacttagccttcatgtatcaataattatgttcacaacaaatagtctaaataccttgcaaacattaatcaaaataaagcaggaatggccatcttaatatcaaataaaacagacttcagagcaaagaaaattcctagagatggatattacataatgaaaaatagtcaatctaccaagaagacataacaattccaaatgtgtgtgttccaaaagtgacttaaattaaactgcttttgacaattttacagtaatatacaaaggttaagccacttggtttaagaatttaaaatggagaaagtactataaatatatacttgatgttcacatatggacagataaacatgtatgagagatagaaataaggaaggagcaaagggtcaaagaaactgaagaaaggaactaacatttgtcaagcaccttttaatttaaaagctcctggctcatttactctttagtcttcccaaaggaaatctgggataggaattattacccccactttacggataaggacattgaggatcagacagattaggcaactttcccatggttacacagctaggaaagaaaaaataatatatcctcctattcacatggcatgcacatttcaatgttattaactgcccttacaaatgctgattatctgattaaccattattcacagttcttcaactgctataatcctaaatctcctgaagtataagcatagcagcatatttctgttaaagaaataatgtttgctggacagaagcaggaatgatgacagcagcatcatctaatgacctattgaagtcaagctaagagccttacacacatcaagacacgagcccagaaatatatgcattcatactcagcactcacaccaatggcagaatttgcagtgggaaaaacatcagaagcagattctcccaccacagaccattttctgcttctaactctgaacacacgcctacccctgtctttcctcccaatcccaatcacactcccacattatgttcccaacctcagcctccaaatcctacactaatctattttgcccatgttttccttggacttttaaatggtgatgaaggagcatgtagataagtggaagaagagagacaagaatggaacaaaagaagggagatagaaaagagggaaagggaggatagcagtaataaaacagagacagtgagtacaggcaccattaaatggaccagagccctacaccagctccccaagtacaaaacaatatttccttaaaatgcacatgccatccattcatgtgtattgcgtacactcacaccccgatgtacacatatccatacacaaagagctttcctcacttgaaaaaaagaaaaaccattttggaaggagatgttgagttaagtaggtactcttaaatgaatgtttctcgactgggtccttcttttctttttttctttctacacactcttttgagtaaattcctgtacttccatggcttcaaatattatcctccaaatctccaacctctataccccacccacattcatgctttagcccatacatatgacagcctactgggcttgtccgcctggaagtttcacagataaatctcagctttatatctacgtctcttcctacagcaatcaagctcctccccttaaacctttggtttaataccaccattctctgcacagttacctcagatggcaatctgaaagtcaatgttgactcccctttctctttaatgactcacctgcaatcacttagttaattctatttctatcctgaatatcttacccaatacctgccccactctccacctcccagttcactgctccatttcaggccttcattatgaattggcatggatatttgtaatgcagtatccatttccatctgaagaattacttccctgtctacagtctctcctctgtctgcaatggcatccacattgccttgagaactaccttcctaaagcatggttgttattttatttctcaaacatcttcactaacttttcattgtgtatgacaatctttttgaaaaatacaggctgcgtcccattattagctcataaaaagaatttagttggtcactagtagcatttttaaaaaaccttttttaaaataaaaaggaaattatcaacatacattgcatatgaagtagtaggtatactttggagaaggttttgtttagttttaaatatgtgtatgtgtgtattgtgtcatgaggtgaaattcatttctcacttacgtcatttcttactgtgtctctgttgaacacacatttacctatcggtgtttccatggcattcatgctgcctccccggaaatctgtcccatacccactattctgaccttatctgctactgctttttattaatcctatcctttagccatatagaagttcttactgttttatatatttccgttccaccagacctttgcctctgcagattcctcgttctagaatgccactctcccattccaagcatctaaatcctactcatttttcaaggaagacccatatgaaatgcctcgtcttctccaaaaccttctcgagttccccagtcaaaatgaattacaataccccaaccacagactccacagggagatttattatagcactcaagttatcccatctaatgatggaattttgaattgatatcctcccttccttcctcccttccttccttccttcccccctccctccctccctcccttcctctcttcctctcttcctcccttcttcctttccttccgccattggtgtggcagtcttggtaagctcctctgttacctggcttggggattgactcagaaccagtgcttactcaagaccaaggcacaggacaactggaacctctgggacttgtggatgggcaaattaagccaaacaatgctggccacaggagagactgaaaaggtgttggcatttggtattgagatgtaagaaagttatcagaatgaactgttataagaaatctactttgctgacagtagctttgtttccagttgagcaaataaatattacatggaagaatgcttagtacttaggcaatattctcaccagactggagtaagcaggaaaaactagctcctttgtgttcattcagtgacatttactgagcataaatctgggccataatcagggctgggctatcctttggtggcccatcacttaggataaataagacccatcagaaggatcttctaatcaaagtcaatagctctgatctctcccttgagttccagactcacatatctaactgcccatttaacttacacccttgcatgtatcactggcatctcaaacaggccctcaactccagccccacccctaaacatttttatttcccagtcttccccatctcagtaaatgcctcactatgctgaaatctggaagccattctttattcctctttttatgtgaccctctccatccacaccattagcatagtggttattatacttgaccatgcaggaggttacacctaaagggcttttaaatcattgattgctgagccccatttccagggtctctgattcagtagatatggagtggggcctgagaatttacatttctaacaagttcccaggcaatgctgctgctggtggtgcagggactacatgtggagaacaactgcattagtaagacctggccagttatacctatacaatataatctggaattgtccacttctcatcatcccctcaacttattaacaaataccagcacttttccatcaatctccagtaaacagtatcttttcacctaattttcccatcttcaaggcctacaggtcccagctgtcctaccctgctttttgagtgtgcattggggctgagtcacctctgaaactgggtgacagatgagcctgccaagtttgtcccagcaatggatgatccatggccctagaacttctccttctttgcacctgtcctcttccatatttgccagaaagaaatcattgaaaagaaggtatccagctgaatgttttatagtcttggctcaggagactgtctggagaacctgtggcctagcagtctgctatgatttgaatgtaccccaaatttcatgtgttgaaacataatcctaccattttgatggtattaagaggagagacctttcgggaagtaattaagtcatgaagcctctgccattatgaatggattagtgccttagaaaatgacttggaatgagtttagacccttttttgtacttctgtgattccaccatatgaagacacaacattcactccctcttgaaaatgcagcaacaaggtgccatcttggaaggagagaccaagcccctcaccagacaccaaatctgttggcacattgatcttaaacttcctagccttcggacctgggagaaataaatttttgttctttacaaattacccagtctgtggtattgtgttatagaagcacaaacagactaggacaggagctcaggaatactggtccaaaagttacctaagactgtcatcctggtgactgtagaaaccctaaagtaccctgaaaaccctgtggtttccctgtggttcacgagtcatactagctgtgctttagcctcttggaaaaatctcattaggaaattttatatataaaattgcatctttaatgatctggatggcttcctcacttgtagggccaaacattccacagatttcatctcattgaagcatccaacaattccatgcaaggctacactgagtcctactttccaggtagaatttccaaggtgccaagagattccatgaagtgcactatttcaccctgaaaattgatgactgagccaggacaagaattcaccctactggcctggtttttatggctttaaatccatcatatgatgaaagttccttgttgtgatggaaaggtgatcagatttacaacgctggattttccacttcctgaatttgtcttcttgggcaagtcactttacttctctcagcctcaaattcttcatgtgtgaaaataaagtgaaacatacctgccgatatggttcttatgaagattaaattttgatagcataaaaagtgcctaatacagttgctggaacatagtaggcaccacaaatataatagctattgttattaaataaagcctttcttaacagacggttgctttcagttcctgtcacttagatagattcttaataaatatgaaccaaatgaatgaaatccttgccacccatggtaatgtcttttcttctctgaggctactgatgctataatcactcccctggatttactacctaccattcagtagtttctcattccaaatgtaatgattgagccccgcttatggccaaagcagaatgataggtgttgtggaggttaaagagagaaatatggcatagtgccactgtctagaaagccctcgtgtatataattactctgatttcaagttgcttcatgcataaatctgtactttttagaggacccagaggaccatgactatgtgccttgtgctagtccctttcccatcctggacctttatttattcacctctgaaataaagaggatagatttcatgggtgactttgaaataatgttctgacgagcccagggaattctaaggagggttttaaagggccactgtgatagagtcaggtggtggttgaatttgaggacagattaatgactctgggggtcccacttccactttaaccataacagttatgatttgttccattttctatattggatctcaatcagttattttatttgaaggaagggatcttatcattcatccacaagaaccagcgcacttctggataaatggtgcttgcttaatacaatttttaagtctgcttgattgatggaagtttgtaaagagggaatttggtattgtgagtacatctaagcagtgactggcatgacactctttgtagattagagagaggaagggccttttatttagatttaatcttagctcaaacttctcaattgctggacagagaatggaaggctgggaattagatgcaaatcctgaagaccatagtaaaggcaatctacctcaaatgcaacaaattatttatttatttatttattattaagccattaagctccttctcatttctcctggctgccttaatcagcaaactttaaaaaaatccattccctctacgtaagccttttgacaagtcatttatttttctgggaaaacatgagcatgcttagaagttatgtttagtgggagttgtaggtttagatttaattctgggtgcagtaagaggtcattacaggataatttgagttatattttatataccataggaaacatccatttcaagtgtacaattcagcatgttttaataaatttaaagagttgtacaatcatcaccataatattttagaaaatttccatcattccaaaattagctctttgttcagtttcagttgatctttgttcttatccacagccccaggaaacctgtaatatattttctgtctaaatagagtggctttttcttgatgctgcatataaatagttatacaaatgtggccttttgggtctgccttcagtcacttagcttattgtttttgagattcattcacattgtaacatgtaacagtatttcattcctttttgttgacaaataatatcccattgcatggatatcgcacattttgggtgttcactcacaagttgaggagcatttcagttatttccactgttttggctcttatgaataatgctgctctgcacatttgtgtacaagtctttttgtggaaaaatgtttccatttctactgcttagattctcaggagtgagatttctgtttcatattgtaagtatatgtataactttttaagatacaagtgtttttgaaagtggatgtcctagtttccatcccaagagggagtgtatgagggtcccagtttctctacatcctcaacaatacttgttagtgtctgcctcaaaaaggcattatagccatcctagtggtgtgatgtgatagctcacagtagttttaacttgcatattcctaatgaccaatcttgttgagtatctcttcatgagtttatttgccacccatatatcctcttctgtgaagtgtttattcaaaccttttgttcattttttaactgggctgtttgtttactgattgtgagttttgagtgttatttacattttctggaaacacatttttaccagacacttgatttgcaaacatgttctcccagtctgggacttatcttttcattgtcttaacagtgtcttttgaattacaatgtctttttttttttttttttttttgcttctttgtttgaaacaggatatcactccgccacccaagctggagttcagcagtgccatcgtggctcactgaagccttgaattcctgggctccagaagttatcccacttcagcttccccaataactggactacaggcttgtgccaccatgcctggctaatttttcttaaatattttgtagagacagggtctcactatgttacccagggtggtcttgaactcctgggctcaagcgatcctcccgccatggcttcccaaagtgttctgattataggtgtgagacaccgcactgagccagaaacttttaatgttgatgaagaaatccaatttatcagtattttttatggattgtgaattcttgtgccatttaggagaaatgtttgcctaagtcgtattcacaaagattttctcctatattttcttccagaaattttatttttaggtttcacgtttaggtctatgatccattttcacttaatttttttgtatgttgcaaggtacgggttaaggattttcttttgcatttggatgttcagctgtttcactatcatttgtttgaaagacttgtccttacatctgtgggtttatttctgacctatctgcttcattgctttatttgtgtatctttatgccaatagtttgctgatttgattactatatctttttaataattacggaaaccaggtcatgtaggttctccaacttcattattcttcctcagaaataattttgactattctaggcgctttgaatttctatgagttttagattccccttgtcagtttctaccaaaaaccatactgggattttaataggattttgttggatctgtagattagtttgttagatttcaccagtgtgtaatgaaataatgtcctatttctgttctaggatctaacccaagataccacattgcatttttatgattccatttaacttattttatgacttattagctataatgctgttttattatttcagtggctgctttagagtttataatatacatccttaacttatcacaacctaccttcaattgagcgcataatactgcacatataatgtaagaaacatacaacactatatttctccctttctggcctctgtgctattgcattttggtactttttggtttaaactgttgattatatttttaagtaacttaattaaggaagaaaataatcatgatatttttctatgtagttaccattttcagtgctctgtattcctttgttttgatacatttccctctgctatcattttccttttgcttgaaggactccctttaacatttgtggtagtgcaagtttgctgatgatatagcattttacctttccttgtgtgaaaagttctcattttacctttgttttcaaagttgttttccctgggtaaataattctatattggcatggatttcgtccgtactttaaaagtgatacaccactgtcatcttgcttccaacattctttgatactctttgtgtaacatatcctttgtttctgactcctttactggttttgagcaatttgattatgatatagcttggtgtgatgttctttatggattttatgcttggagcttgatgaatctattggatcagtgggcgtgtagctttaatcaaatttgaaagatttttggccatttattcttcaaatatttttatcttcctctttcttcttggtcttcagttacctgtatttttaattcaatttaatttaatttgatttaatttaatttaatttaattttactgtggtaaggtcacagaacttgagatctaccctcaacaaattttatatttataatacagtattgttaactagaagcataatgttgtactgcaaatctcttgcagttatcatcctgcacaactgaaactttatacatattgaatagcagctctacgtttccccctccttcagttcctagcaactgccattctactctctgcttctaagaatttgactattttaaatacctcatatgagtggaatcatgcagtatttctccttctgtgattagcttatttcacttaggattatgtccatgttatctcatattgtaggacttccttcttttttaatgcttaataatattccattgcataaatatactacattgttaattcattcatttaggttgttttcatatcttggctattgtaattaatgccatgataaacacgggagtgcagatatctctttgagatcccgatttcaattcttttggacaaatacctagaagtaggagtgctggatttatatatttttatatatttattatacctgttggccatgtttatgttctttggaataatgtttatggaactcctttgcccagtgttcaatcgggttaatagcttttgtactattggtttgtaggatttcttatattttatacaaattaatccattatcagatatatgatttgcaaatatttcatcctttatgcagtttgccattttactctgtttattgtttcctttgctgtgcagaaacattttaatttgatgtgatcctacttggtcatttttgcttttgttgcctgtgcttttggtgtcatatccattaaatcattgccacaagcaaagtcttgaagtttttctcttatggcttcttgtaggagttttgtagtttcagaagttatgttcagtgtttaatacatttgtagttaatttctgtgtatggtataagataagggtccaatgttatacgtttgcatgtggacatagtttttcccatagcatttattgaaaggactatcatttcttgcattgtgtattcttgtaaactttgtcaaagatcaagtgactgtatgtgggtggattcatttctgggctctctgttttttcccatggcctctatgtctgtttttatggcagtaccatactgttttaattactgcagctttgtaatatattataaaatcaggggataagattgttctggctacttggagtttacatgaatgtaaaaaaaaatgccattgggatttttataaggattatattgaatctgtagattgccttgagtagtatggttaagtcttccaatccatgaacatgtatgtcttcccatatgtttgtgtctaccttaatttctttcatcaatacgttatagtttcatttattgctaagtattttgttctttttggtgctatcataagtgggattgtgtctgaatttccttttcagatagtttgttgatagtgtacagaaacacaactgactttgtatgttgattttgcatcttgtaactttactgaattcatttattaattctaacaatctttttggaattttttgggttttgtacaaataagattttgtcaactgaaaacagcaataatcttaccatttccttctcaattttggtgacttttatttcattttcttgtctaattgctctggttaggtctctaggatctatgttgaatagaaatgtcaagagtggacatccttgtctttttgctgatctttcagtgttttaccattaagtatgacttagctgtgggcttttcatatatggcttttattgtgttgaggtaatttccttctatttttagttgttgagagtttctatcaggaaagggtgttgaattttgtcaaaggctttttctgcatttattgagatgatcatgtgactgttatctttcattctgttgatgtgatatagcacattaattgacttttgcatgctgatctctcctcacatcacagggataaattccactggccgtgttgtatgatacttttaatgtgctgttaaatcagtttgctagtcttttgttgaggatttttacctgtatattcatcagagatagtgtcctctagttttcttttcttgtggaatcttcatctagctttattattagggtagtgctaggctcataaaatgagtttggaagtgtcgcctcttcacttttttggaaaagcttgaaaaggattggcattaactcttctttaagtgtctgtcagaagccaccagtgaagccagctggtcctggccttttctttgttgggaagtttttaattactgtttcaatctccttactaactacaggtctattcagattttctatttatacaggactcagtcttgccagattgtatgcttataggaatttatccattttttatgttatccaatttgttgatatgtgattcttcatagtagtcttatgatcctttctacttctttggcatcagttgtagtgtgtcatctttcatctctgatttcaattagttgattcttttctattttctcttagtctagctaaagatttgtcaattttgtttattttttcaaaaaaaaccctcttagttgcattaaaaaaatttgattctttatttggcttatttctgctctctcttcattatttccttcaaaactgaccaataaatcacatggttaatagaattattagctgatgacattaaaagttattataaatccatttcatatgttcaaaaagcttgaggaaaaactgaccaagtagaggcatggcagaaataaaaaagattcaaataaaaagtctatagatgaaaactattatgtctaagatcaaaaaatttcttagtttagaaaaagagggagaaaagattagtgaacttccagaaatagtaatagaaatcatcccaaacaaaatacatagggttaaagatttttaaaaataaacagtatcagcaaattgtgggacaacttcatttggttaaaaatacagataaccgtcatttaaaaacaaagaagaacattatgtaatgataaaacagtcaattcaccagaaatatgcaacaattataaatatatatacacccaatatcagaacactgaactatataaggaaacattgacaaactgatggtagaaatagacagaaagacaataatagtaagagacttcaataccccacttttaataatggatggaacagtcggacagaaaatcaataaaaaacagcaggcttaagaaacactacagaccaaatggaccttacagacatataaaacattaaacccaagagcaacagaatagatactcttcctaactgtacacagaacattctccaggatagaacacattaagacaattagcacatcttaacaaatgtaagaagatcaaaatcctaccaagtatcttttctgaccacagtgaaattcaacagtagaaggaaaactggaaaattcacaaatacccatcttaagggttatatttttcctgcttatttgtacatctggtaatagtaaagtgtgaatggatgccagaaatagtgaatttcatcttgttggttgctgcatgtatttgtattcctatacttagtatcagttttatccctataagtcttgctgttaagcatagttaagtggaaccaaagtagtgctttgtctagaagtcatttccccagtactaatgcaaaaccttctttgtattttaatgctttatgaattgtgaagttcttctaccttggctattggaaataggtccatgtgggctctgatcactgtcccctttgggtggttattttcctggccttatgtagttttcttatacacgtgtgctaatcaatatttaactgaataattggtggagttggatcctctgaaaattgagagagtcccctttttttcattaaaaaaaaattaaaacggtgctattgcaatagagttctctttctacataggtctacactctccaaaactcttttctgaaaaattttgataccttggcttccccagagtcatggctccatttttttcaattgaaggagactagcaggctctgactgagtttcccttccctgcagcctagaatatttatctaggcatgaagatatagccatcttagggctcatctaagcctttccatcttttggagatcactgaccttacttgcctgaagtccagtgacttaagtgctattttttcatataattttgtcagtttttttctgtttttagttatgcctgggagggtaaatcaggtccctgttactctatcttgactagaagtgaaagtcaaggttatttctcaaatatggtttcaaaagatcagattttgtcatttaagacacatattttacattcaaaaatgtaaagtcagggtgtgtcttaaaatccattggtgttttaatcatgcttaaacatgtgactgctgttggccaggatacagttgtggtggtgtcgtcagtatctgagcacatgtgaactttgccatgactattcatattgtcttctcttaaactgaattatgtccatggttgccaacatgtactgtccatagttgccaccatgtatttaggttgtcatttaaaatgtcctcaaaaagatttcaccatgattctccatcaaaatagaaagctattttgtatgaagaagaactcagaccagaaaagtctgataaaaataatctcttaaataagtctacattaggtctttcaatttgtataaaatgtaaattttgaattataagaaaacaatttgttatactgtaattggtagcattttttcttagtagtgtacaaaataatgtgtaccttacattcaaaggcatcctagattcaattaaataaaataactgattagccaggatattaataatgctaatctaagaaagtcctaaaataacagtgtttaaaacaagacagttttaattctccctcacattattgatctgggaacaaggtatttgtggtttgtggtggtgtttgatattggggacctaggctatttttatattgttgcttcactgtatacagggtttcgccctcatctatatgattcaagcccactgttgtgtacacattttatccaataggaaaatagcaatgggaatggttcttccatttatagtcacaatccagaagttgtagacatcatttctgcttccataaaattggccagaaagttgtcatatggtcacaaatagctgcaaaagggatggggtaatatagtccttatttcagacaacttcatgcccagctgaaaatcagagggtctattgctatagaaagaggggagaatgaatttggggagacaggaagtattgtgttgtttaagagagaaatgagatcagctcagggtatattctgctacaggtctccaattgggtgccacccccagtaccttcttaattctccatctttctgaatgcaaacacagatacaagagcccttatgcactgctggtaagagtatgaactgttatagccatcctgctgagcaaattggcactgcttaatcaaagtaagaatgcacattacctgggcccctgaaatccaactcctgggataaatcaccccccaccaccaccaaaaaaaaattactgagacaggtacaaggctattcacttaaatgttattttggaggtggggagattgaggcaaagtgggagtctgtccctggaagagtcaacagataaaatgtggttgatagccatatatagaagcaaggaattctggatattaacttgagattgctgtgtgaaaaccatattttggaaattggccaatataacaatttttatatacacatatatgtacatatatacacacacacaaatacacacacacacacatatacaggcatgtgccatataatgatgtttcagtgaacaatacaccacatataccatagtgtggtccctgaagattacaatggagctgaaaaactcctatcacctagtgacgtacccactgtaacatcatagtgcaatgtattactcacgtttgtgatgatactgcactgccagtcatataaaagtctagcatataaaattatctacagtacatgatacttgaaaatgataacaaatgactatgttactggtgtatgcatttactatactatactttttatcattattttagagtgtactcctcttacttattaaaaaaaaataactgtaaaacaggttcaggctggacttccaggaggtattccagaagaaggcattgttttcatattccttgaagactttccagtgggacaagatgtagagttgggagacagtgatattgacaatcctaaccctgtgtaggcctaggctaatatgtgtgtttctgtctttatttttatttttatttttttttatttttgaaacctggtctcactctctcacccgggctggagtgcaggggcatgatcatggctcattgaagccttgacatcccaggctcaaacaacccttccacctcagcctcccaagtagctaggaccacaggcatgcaccaccacacctggctaatttatatatttttttaatagagatagggtcttcctatgttgcctaggctggtctcaaactcctggcctcaagcgatcctcctgccttggcctcccaaaatgctggggttacagacttgagccactgtgcccagcctgtatctttatgtttaaccaaaaagtccaaaaagtaaaaataaataaataaatacaaacatagaaaaaacgcttatgaaataaggatataaagaaataaaatatttttgtacagctgtacagtatgtttttgtgtcaagctaagtattattgcaaaagagttgttaaaagaaaagcttcagccaaattaaatttaaaggaggttaattgagcaatgaatgattcatgaattgggcagcccttagaattacagcagatgcagagagactccagcacagccatgtagtggaagaagatttatagacaaaagggaagtgacatacagaaatcggaagtgaggtacagaaacaactggattggttacagctcagtgtttgcactatttgaacacagtttgaaccctcagcagtgtatgagtggttgaactatggctgctaggactggccaagactcagctattgttacaggcacatactcctaagttacgttttcaatcttgtctacctaataagttaggttatgctttgtcctcatggactcaaatgtagaagtacagtccttctcaggctatatttagttggctttaacaattcctcccttttggttactttctcaattttgagatgttgaccaaaactttagtcattgatgtcactatcaccattgtaaatgtacttatttggtcttgaaacccactggaaaacagtagaacagtgggttttacaaggtgggaacaaggacagagtagagggtacctccttatgctgtaacatcctgtttgcaggagaaaaacaaaatctggtctgttctaggatctatgtgtttccttaaagtcttagtttgattatgtcatatttagtatgagtgactccatgtttgtttggtttggtctgttagggcctaatgcaagagctcagtccaaaacaatggcctcccataattttgttttaaaactctacttttcgggtcaggttcttacttaggtgagggtgtgaccaaaacttagggccttagtgccactctgttaccatcattttgggtttctggtctcagcgtgtaattcataagttaccatgtgttcatggttgcatatttttttcagctcttgtcatcccagttgaagagagaccatttgatattctatagatggctgcatgcaaacatttaaaacttttgagagaatgcagcgcacaagggagactactattatgactattgggaggataacaccaacagtttgtagtatgctccttacccagggttcccataaatcaaaccacttaaaattaaatagattaaagaatgggctaaagagtctactcacttaactaagcagtctttccattaatcccctacaactgaatttttatattctacattttatgtatttctccataggcgacaagtgccagcagctgcacagatatttttccattgagccaatgctattatttagtataactttcacaagagaatttaaagtctgttgtgtagccatagcctttacagtaaaatctgctatagagcctatcatgagggatacatttttaatcattgcttcttttactccaaaccaaggaagaaagatctaacaaatgatgtcctctagaagagtaaaggcctcctcataatgttcactttaacccatgatgtgggttaagaggagtgaaccaatgttccctttctgactgattatgaggcaacgtgtgtaccgttaaagcttcttgtctacattgagccttcgtcttttatctgtcaaagtataaggttatccatgtataaggctggctgcaaaatccttcacaaataaaagtataccccataagtacacacaacagaccctcttttcacttctattcttcagaggcataagcaaggaaaaaaatagttagacaagaatctcatgatgctagagaagtcttgatctttgatcttgggaaaagctattcacatcagagatgccatcttcttctggggagaaacttcccaggttagctttactttaagggcttcactgggtgtacagttccaagagtgtggagggacccttctcagttgtgagattatgaacttaaaattcaaggtcctgaagttttgctgtagtgtggatggcaaatacagcctttctctgatgttctcagaagatccaatttttgggttctagattgtgaaggggttgattgtcctcagtcagtgatccataaaaactttctttacctggtgaaaataccctgtagcataataatctactgttataacagcaaccctcatacatgggaaaacttttatacaaccagaaaacatgcattgaaaatgacaactgaatgaaattcttatacaaaatgtttaaatggcccatcagctaaccaaatgcacctgaaggtttgattgttttcccaggaatatgggtgtgacaaaccaaatattgttcataaactattttaggaatttagaagacaccacattaatatataattaatttggatcattttgtcttttccatgatgagtcacagaatacagaacctttaataacaaaagctttaacgactcaggaaggacaaagtggctgtcctgcttctccatgagtccatgcttaattaacattagacttatgtcctcttgaataccagttatttctccaaattaggtacatagcactgataactggtgggttatcataggtaatttgacttagaccgtggagtttattcaaactgtatacctaaacaatttcagtattggctgattcagcattcaaatctggcagagtattttcttgttattccataactttctgttctacttgggttagtagttttataaaccagtccaccttttcattaaaatttcaggaattcttatccggtccaaatgatatgattttatagaaacctgtattgaagagtgattttcagggacctttcaatcctttcatgaacctcctaaaagacaccatattctaggattttgcatgcttgtgaaatttttcagaaacagcatcagcattaagcaactaactgtggaaatgacttcaaaggattatagttaaaaacacaattaaaaagaaaacttcattctttctgttgtctacaataacataataaccataataatgattaatagcaagcactcaaacatattagaaattttgaaatccaatacaatttttgagcatatatatatataattataaatatatataattatatatatatatataattatatatatatataattatatatatatatatatataattatactttaagttttagggtacatgtgtacaatgtgcaggtttgctacatatgtatacacgtgccacgtaggtgtgctgcacccattaactcgtcatttacattaggtatatctcctaatgctatatctccccaattcccccaaccccacaacaggccccggtgtatgatgttccccttcctgcgtccatgtgatctcattgttcaattcccacctatgagtgagaacatgcagtgtttggtttttcgtccttgcgatagtttgctgagaatgatggtttccagcttcatccatgtccctacaaaggacatgaactcatcattttttatggctgcatagtattccacggtgtatatatgccacattttcttaatccagtctatcattgttggacatttggcttggttccaagtctttgctattctgaacagtgccacaataaacatacgtgtgcatgtgtctttatagcagcgtgatttatagtcctttgggtatatacccagtaaggggatggctgggtcaagtggtatttctagttctagatccctgaggaatcgccacactgacttctgcaatggttgaactagtttacagtcccaccaacagtgtgaaagtgttcctatttctccacattctctccagcaccctttgttccctgactttttaatgatcgccattctggtgtgagatgctatctcattgtggttttgatttgcatttctctgatggccagtgatgatgagcactttttcatgtgacttatggctgcataaatgtcttcttttgagaagtgtctgttcatatccttcacccacttgttgaaggggttctttgttttttccttgtaaatttgtttcagttctttgcagattctggatattagccctttgtcagatgagtacattgcaaaaattttctcccattctgtaggttgcctgttcaatctgatggtagtttcctttgccgcccagaagctctttagtttacttagatcccatttgtcaatttcggcttttgttgccattgcttttggtgttttagacatgaagtccttgcccatgcctgtgtcctgaatggtattgcctaggttttcttctaaggtttttatggttttaggtctaacatttaggtctttaatccatcttgaattaatttttgtataaggtgtaaggaagggatccagtttcagctttctaatatggctagccagttttcccagcaccatttattaaatagggaatcctttccccattgcttgtttttgtcaggtttctcaaagatcagatagttgtagatatgtggcattatttctgagggttctgttctgttccattggtctatatctctgttttggtaccagtaccatgctgttttggttactgtagccttgtagtatagtttgaagtcaggtagcgtgatgcctccagctttgttcttttggcttagggttgacttggcaatgagggctcttttttggttccatatgaactttacagtagtttttttttccaattctgtgaagaaagtcattggtaacttgatggggatgacattgaatctataaattaccttgggcagtatggccattttcacgatattgattcttgctatccatgtgcatggaatgttcttccatttgtttgtatcctcctttatttcgttgagcagtggtttgtagttctccttgaagaggtccttcacatctcttgtaagttggattcctaggtattttattctctttgaagcaactgtgaaagggagttcactcatgatttggctctctgtttgtctgttattggtgtataagaatgcttgtgatttttgcacattggttttgtatcctaagactttgctgaagttgcttatcagcttgaggagattttgggctgacatgatggggtcaatattgtgaaaatggccatactgcccaaggtaatttatagattcaatgccatccccatcaagctaccaatgactttcttcacagaattggaagaaactacttgaaagttcatatggaaccaaaaaagagcctgcattgccaagtcaatcctaagccaaaagaacaaagctggaggcatcacactacctgacttcaaactatacttcaaggctacagtaaccaaaacagcatggtactggtaccaaaacagagatatagatcaatggaacagaacagagccctcagaaataacgccacatgtctacaactatctgatctttgacaaacctgagaaaaacaagcaatggggaaaggattccctatttaataaatggtgctgggaaaactggctagccatatgtagaaagctgaaactggatcccttccttataccttatacgaaaatcaattcaagatggattaaagacttaaacgttagacctaaaaccataaaaaccctagaagaaaacctaggcattaccattcaggacatacgaattggcaaggacttcatgtctaaaacaccaagagcaatggcaacaaaagccaaaattgacaaatgggatctaattaaactaaagagcttctgcacagcaaaagaaactaccatcagagtgagcaggcaacctacaaaatgggagaaaatttttgcaacctactcatctgacaaagggctaatatccagaatctacaatgaactcaaacaaatttacaagaaaaaacaaacaaccccatcaaaaaatgggcgaaggacatgaacagacacttctcaaaagaagacatttatgcagccaaaaaacgcatgaaaaaatgctcaccatcactggccatgagagaaatgcaaatcaaaaccaaattgagataccatctcacaccagttagaatggcaatcattaaaaagtcaggaaacaacaggtgctggagaggatgtggagaaataggaacacttttacactgttggtgggactgtaaactagttcaaccgttgtggaagtcagtgtggcgattcctcagggatctagaactagaaataccatttgacccagccatcccattactgggtatatacccaaaggagtataagtcatgctgctatacacatgcacacgtatgtttgttgtggcactattcacaatagcagacttggaaccaagccaaatgtccaacaatgacagactggattaagaaaatgtggcacatatataccgtggaatactatgcagccataaaaaatgatgagttcatttcctttgtagggacatggatgaaattggaaatcatcattctcagtaaactatcgcaaggacaaaaaaccaaacaccgcatgttctcactcataggtgggaattgaacaatgagaacacatggacacaggaaggggaacatcacactctggggactgttgtggggtggggagagtggggagctatggcattaggagatatacctaatgctaaatgacgagttaatgggtgcagcacaccagcatggcaaatgtatacatatgtaactaacctgcacattgtggacatgtactctaaaccttaaagtataataataataataatcaaaaataaaaaagaatccagagccatcagtgtgctgtattcaggaaacccatctcacatgtggagacacacataggcttaaaataaagggatggaggaagatctaccaagcaaatggaaaacaaaaaaggtggggattgcaatcctagtctctgataaaacagactttaaaccaaccaagatcaaaagagacaaagaaggtcatttcataatggtaaagggatcaattcaacaagaagagctaactatcctaaatatatatgcacccaatacaggagcacccagattcataaagcaagtccttagagacctagaaagagacttagactcccacacaataataatgggagactttaacatcccactgtcaacatgagacagatcaacgagacagaaagttaaaaaggatatccaggaattgaactcatctctgcaccgagcagacctaatagacatctacagaattctccaccccaagtcaacagaatatacattcttctcagcaccacaccgcacttattccaaaattgaccacatagttggaagtaaagcagtcctacacaaatgtaaaagaacagaaattataacaaactgtctctcagaccacggtgcaatcaaactagaactcaggattaagaaactcactcaaaaccgctcaactacatggaaactgaacaacctgctcctgaatgactgctaagtacataacgaaatgaaggcagaaataaagatgttctttgaaaccaacgtgaacaaagatacaacataccagaacctctgggacacatttaaagcagtgtgtagagggaaatttatatcactaaatgcccacaagagaaagtaggaaagatctaaaattgacaccctaacatcacaattaaaagaactagagaagcaaaagcaaacacattcaaaagctagcagaaggcaagaaataactaagatcagagcagaactgaaggagatagagacacaaaaaacccttcaaaaaatcagtgaatccaggagctggttttttgaaaagtacaacaaaattgatggaccgatagcaagactaataaagaagaaaagagagtagaatcaaatggatgccataaaaaatgataaaggggatatcaccaccaatcccacagaaatacaaactaccatcagagaatactaggaacatatattaatatcattcactaaaatataacctgaggaaagttaatttttttgacagtgcttcccgtgtaacttgctatgtcaaataattctgtttacctttcctctgggtgcttaagggtccctctggagcattccaagttagaggtcgcataatataattttgaagctgcaatttgattttgggaaggccatcaaatatggtaaagttttaaaacagtttgatatgatgaaatggaattctaggtactgtaagtcattcatttagccaaaatgatgactcaaaaaatttaagaaggcaaaaactgttagtcattgataggcagaaaccttagctttccaaacagtctgtctcttgtctttcccttcttttttggtagtttattcaaaaggcaaagaaaaatcttttattgtcctttactattgcatgaaaatcttgttcaagagagaaagcaaaatttcaccctggcattagtgtaccatgaatgttaaccctaattcttaagaaatcttatagacaaattgattcaatcttaatcatttggaccataaggtgagattcccataaaccttttattaccctttacaaatttttgttgaagagcagattagtgctctaagaaaaccctgttgtgcttttatttcaatgttcaagttatggaaaaaataataatacctctttaaatttagtcaatatgtttacagacaaaatttgttttacaatattaatttttacgaaccttttacaacttggtgaaacgtttacctttatcttatgtaatttaaaacaatcatttagccctttaatctaggcaaacatttacattcccatgccttcttataatattttaccaaaaatactttttattgtcttcacacaccttgcatataaaacttttttcagtagtctcaaatacatgttataatggtaactctccagaattttaatttttggtagaaaacctggcaagtaagtaattttaattatgtagtaggtttgtatccaaggaaatcagacagaagtacagataaggtgtgactctttcatcatttctgttagacttcactgcttcccaggttaacatttatgcatgtgttagccagaggaactcagttcttcagaaattaaaaattaaatttgtacctaaaatattggctttgctctcagattcccctgatgaacttagccaatgatttttcctacctaagtgtgcacaaaaaaaaatgtgaaacaaaggggtagaacgtaaaaatcctcatgaatatccagaagccaattttttttcaatttctacaatattgccatttactgccagtttttttctgacccagtcaggtgtaagagccctctaactggatccaagccagttaatcactggaacgaatccaatcctggaccaagtccggtttctatagtgacttataaaccaagtttggatgagaaattcgcccaaagaaactcaaagagctcaaaacacaaatccatgaagctccaaaacccaaaagagaacttaaccaagatctctagctcctctgatagatcaaacgacacaattgggtccttgcagttaccttgcttgttcactcagtgctcctgggggtcgttaaaagttctacttcagatgccacttctgacatcatctgttaaaagaaaaaaatcagccaaattaaatgtaaaggagtttaactgagcaatgaacaattcatgaatcagacagccatcagaatcacagcagattcagggaggccagcacagccacttcatggaagaagatttataaacaaaaaaaaaaaaaagagaagtgacatacacaaattggaagtgaggtacagaaacaactggattggtcacagctcagtgtttgcattattcacagtttgaacactcagcagcgtatcagtggttgaagtatggtttctgggattagccaaggctcagctattgttacagacacatactcctaaattaggttttcagtcttgtctacgtattaaattaggttgtggttcatccacaaggactcaaatatagaagtgcagagtctttctcagccatatttagtttgcttaacagagtaaaaatgtttttaaaaagtttaaagtttataaagtaaaagcattacaataacctaattttaatttattatggaagaaagacatttttaaagataaatttagtttagcctaggtatacagtctaactatagctggagtcttcaacatacctctatcaacatttgataaaacaagccagaaatcatcaaggatatagaaccatcaccatcaaccagcagaatctcattgacatttatagaacacttcacccagcagcaggatacacattctttgcaagtgctcatggaacatataccaaaatagatagaccatttcctgggatataaaataatccccaacaaatttaaaagaacagaaatacagaaatgtgttgtgtgacattaataaaatcaaactaaaaaccagtaaaccagaaaaaattaccagaaaaatctacacacgcttggacactaaacaacatatatctgaatgatgtgtatttcatagagagtctcaagaaaaataaaaatacactaaactgagtgagctgaaaaatatcaaaaattgtgagatgcagtaaaagcagtaatgaaaaaaattaacagcactaaatgcttacattataacagaagagatgccttaaaacaataatctaagctcccacttcaagaaactcgaggaagaagagaaaaataagatgaaggcaagcaaaaaacagaaactaataaaggtaagaacagaaatcaatgaaattgagactagaaaacaacaaagaaatgaatgaaacatttatatatttaaaacaacatatacacatttcatgcacattacctgtgctgtgaaatcccactcctgagatgaatccctggttgttttaagaatctatctatctatttatctatccaaacatatatatttcatatatataaaacaaccagggtttatccccagtgaaatttatatttaaatagacgtgtgtgtgtgtgtgtgtgtgtgtgtgtgtgtgcacgcatttaaaacaaccaaggggtttttccaagatggctgaataggaacagctctgatctgcagttcccagcaagaccaaagcaggaggtgggtgactgctgcatttccaactgaggtacccggttcctctcgttgggactggttagacagcgggtgcagcccacagagggcgagcagaatcagggtggggtgtcaccttacccaggaagtgcaaaggaccagggacctccctgttctagccaagggaagctgtgaggctgtgctatctgccccagatactacgcttttcttatggtttttgcaacctgcagactaggagattccctcatggacctgtaccaccagggccctgggattcaagcacaaaactgggtggctgtttgggtagacactgagctagctggaggaggttttttttgttttgttttgttttggttttggttttttttcccacacgccaggggcacctggaacccaagcgagagagaactgttcactcctctggaaaggcggtggaagccagaaagccaagtgatctcgcttagcaggtcccacccccacagagcccagcaagctaagatccaccagcttgaaattctcactcccagcacagcagtctgaagttgacctgggatgctcgagcttggtggggggaggggcttccaccattactgagacttgagtaggtggttttccccacacagtgtaaacaaagccaccaggaagttctgacttagcggaaaccatcatagcacagcaaagcagctgtggccagactgcctctctagattcctcctccctgggcagggcgtctcgggaaaaaaggcagcagtcccagttaggggctcatagatggaactcccatccctgggacagaacacctgggagaaggggtggctgtgggggcagcttcagcagacttaaatgttcctgcctgccagctctgaagagagcagaggatctcccatcagagtgctagagctatgctaagggatggactgccttgtcaagtgggtccctgacgcctatgcctcctgactgggagacacctcccagcaggagtcaacagacaccgcatacaggagaggtcagggtggcatctggcaggtgcccctctgggatgaagtttccagaggaaggagtaggtggcaatctttgctcttctgcagcctccactggtgatacccaggctaataggatctggagtggaccaccagcaaactccagcagactgcagaagaggggactcactgttagaaggaaaactaacaaacacaaagcaataacatcaacatcgacataaaggatgcccacacaaaaaccccatttaaaggtcattaaagtcaaagatcaaagttaaataaatacacgaagatgaggaaaaaccagtgcaaaaaagatgaaaattccaaaagctacaatgccacctctcctacaaaggatcacaactcctcgccagcaagggcacgaaactggatggagcaagagtttgacgaaatgacagaagtaggcttcagaaggtgggtaataacaaacttctctgagctaaaggagcatgttctaacccaatgcaaggaagctaagaaattttataaaagttgacaagaactgctaactagaataaccagtttagaggaaaacataaattacctgatggagctgaaaacacagcacgagaacttcatgaagcatgcgcaagaatcaatagccaaatcaatgaagcagaagaaaagatattagagattgaagaccaactttaagaaataaagcatgaagacaagattagagaaaaaaaatgaaaaggagcgaacaaagcctccaagaaatatgggactatgtgaaaagactaaatctatgattgactggtgtacctaaaagtgatggggagaatggaaccaagttggaaaacactcttcaggatattatccagaagaacttccccaacttagcaagacaggccaacattcaaattcagaaagtgcagagagcaccactaagatactcctcaagaagagcaaccctaagacacataagcgtcagattcaccaaggttgaaacaaaggaaaaaatgttaaaggcagacagagaaaaaggtcaggttaccaacaaaagaagcccatcagactaacagtggatctctctgcagaaaccctagaagcaagaagagagtgggggtcaatattcaacattcttaaagaaaaaaaattttgagattgagaccatcctggctaacatggtgaaaccccgtctctactaaaaaaatacaaaacaattagccaggcatggtggcaggcacctgtagtcccagctactcgggaggctgaggcaggagaatggcatgaacctgagaggcagcgcttgcagtgagctgagatcacgccactgcactccagcctgggcaacagagcgagactccatctcaaaaaaaaaaaaaaaaagaaaaaagaaaaaaattttaacccagaatttcatatccagctaaaataagcttcacaagcaaaggagaaagaaaatcctttacagacaagcaaatgctgagggattttgtcaccaccaggcctaccattcaagagctcctgaaggaagcaataaatatggaagggaaaaactggtaccagccactgcaaaaacgtaccaaaatacaaaaaccaatgacactaggaagaaactgcatcaactattgtgcaacaaaccagctagcatcatgattacaggatcagattcactcataacaatattaaccttaaatgtaaacaggctaaattccccaattaaaagacagagactggcaaattggataaaaaagactcaagacccatcactgttctgtattaaggagacccatctcatgtgcaaagatacacatgcgctcaaaataaagggatggatgaatatttaccaagcaaatggaaagcaaaaaaaaagcaggggctgcaatcctagtttctgataaaacagaccttaaacaacaaagatcaagaaagacgaaggatattacatgatggaaaagggatcaatgcaacaagaagagctacctatcctaaatatatatgcacccaatacaggagcaccaagattcataaagcaagttcttagagagctacaaagagactaagacttccacacaataatcatgggaaattttaacaccccactctcaatgttagacatatcaatgagatggaaaaaaatacaaggatattcaggacttgaactcagctctagcccaagcggacctaatagacatctacagaactcttcactccagatcaacagaatatacattcttctcagcaccacatagcactttttctaaaatcaaccacataaaggaagtaaaacactcagcaaatacaacagaacagacataataacaaacagtctgtctgaccacagtgtgatcaaattagaactcaggattaagaaactcattcaaaaccatacaacttcaaaagaagacatttatgcagccaacaaacatgaaaaaaagctcatcatcactggtcattagagaaatgcatatcaaaaccacaatgagataccatctcacaccacttagaatggtgatcattaaaaagtcaggaaacaaaagacgcagtagaggatgtggagaaataggaacacttttacactgttggtgggagtgtaaattagttcaacccttgtgaaagacagtgtggtgattattcaaggatctaattagaaataccatctgacccagcaatcccattactgggtatatacccaaaggattctaaatcattgtactataaagacacatgcacatgtttgcttattgcagcagtattcacaagagcaaaaacttggaaccaatgcaaatgcccatcaatgatagactggataatgaaaatgtggcattatacaccatggaatactatgcaaccagaaaaaagaaggagttcatgtcccttgcatagacattgatgaagctgaaaaccatcattctcagcaaactaacacaggaacagaaaaccaaacaccacatattctcactcataagtgggagttgaacaatgagaacatacaggcacaaggagggaaacatcacacaccaggacctgttggggggtgggggggcaaggggagagatagcatttggagaaatatgtaatgtagatgacaggttgatgggtgcagcaaaccaccttggcacaaacctgcacattctgcacatgtatcccagaaattaaagtataataaaaaaatcaatgaatctaggagctggttttgggaaagattaacaaaatagacggctagccagactaataaaaaagaaaagagaagaatcaaatagacacaataagtagtgataaaggggatatcaacactgaccccatggaaataaaaactaccatcagagaatactaaaaacacctttatgcaaataaactagaaaaatctagaagaaatggataaatttctggacacaaacacactcccaagactaaactagagggaagttgaatccctaattacaccaataacaacttctgaaaatgaggcaataattaatagcctaccaaccaaaaaaaagtccagggccaggcggattcacagccaaattctatcaaaggtaaaaagaggagatggtacaatttcttctgaaactattccaaacagtagaaaaagagggactcctccctaactcattttatgaggccagcattattctgataccaaatcctggcagagacacaacagcaacaacaataacaaagaaaatttcaggccaatattgctgattaacatcaatgagaaatactggcaaaccgaatccagcagcacatcaaaaagctcattcaccatgatcaggttggtttcatccctgggatgcaaggctagttcaacatatgcaaatcaataaacgtaatccatcacataaacagaaacaatgacaaaaacctcatgattatttcaatagatgcagaaaagacattcgataaaattcaacacctcttcatgctaaaaacattccataaactaggtattgatggaacatatctcaaaataataagagctatttatgacaaacccatagccaatatcatactgaatgggcaaaagctggaagcattccctttgaaattcagcaaaagacaagaatgacctctctcaccactcctagtcaacatagtattggaagttctggccagggcaatcaggcaagagaaggaaataatggtattcaaataggaagagaggaagtcaaattgtctctgtttgcaaatgacatgatggtatattcagaaaaccccattgtctcagcccaaagctccttaagctcataagcaactttagcaaagtctcaggatagaaaatcaatgtgcaaaaatcacaagcattcctatacaccaataatagacacacagagagccaaatcatgagtgaactcccattcacaattgctattaagagaataaaatacctaggaatacaacttacaaaggatgtgaaggactgcttcaaggagaactacaaaccactgctcaaggaaataaggacacaaacaaatggaaaaacattccatgctcatggataggaagaatcaatatcgtgaaaatgaccatactgcccaaagtaattcatagattcaatgctattcccatcaagctaccattgaatttattcacagaattaggaaaaagtactttaaatttcatgtggaaccaaaaaagagcccgtatagcaaagacagtcctaagcaaaaagaacaaagctggggatatcacgctacctgacttcaaattatactacaaggctatggtaaccaaaacaccatggtactggtaccaaaacagatatatagaccaacggaacagaacagaggcctcagaaataacaccacacatctacaaccatctgatctttcaccagtctgacaaaaacaagcaatggggaaaggattccccatttaatatgtagtgttgggaaaacaggctagccatatgcagaaaactgaaactggaccccttccttacaccttatacaaaaattaactcaggatgaattaaagacttaaatgtaagacctaaaatcataaaaaagaaaacccaggcagtaccattcaggacataggcatgggcaaagacttcatgactggaacaccaaaagcaattgcaatgaaagcaaaattgacaaatgggatctcattaaactaaagagcttctgcacagcaaaagaaactatcatcagagtgaacaggcaacctacagaatgggagaaaatttttacaatctatccatctgacaaaggtctaatatccagatcctacaaggatcttaaacaagtttactagaaaaaaccaaccccattaaaaagtgggtgaaggttatgaacagacaattctcagaagaagacatttatgtggccaacaaacatatgaagaaaagctcgtcatcactggtcattagagaaatgcaaatcaaaaccaaaatgtgatagtatctcatggcagttagaatggtgatcattaaaacgtcaggaaacaacagaagctggagaggatgtggagaaataaggaagcttttataataattgcaaaaattttctcccattctttaggttgcctgttcccactgataatagtttcttttgctgtgcagaagctctttagtttagttagatcccttttgtcaatttttgcttttggtgccattatttttggtgttttggacatgaagtctgtgcccattactatgtcctgaatggtattgcctaggttttcttctaggatttttatgattttaggtgttatgtttaagtctttcatccatcttgagtaaatctttgtataaggtgtaagtaaggggtcgagtttcagttttctgcatctggctagccagttttgccaacaccatttattaaatagggaatcctttccccattgcttgtttgtgtcaggttggtcaaagatcagatggttgtagatgtgtggtgttatttccgaggcctctgttctgttctatgtatctgttttggtaccagtagcatgcagtttcggtttctgtaaccttgtagtatagtttgaagtcaggtatcgtaacacctccagctttgttctttttgcttaggagtgtcttggctatgtgggctcttttttggttccatatgaagttaaaagtagtttttttccaattctgtgaataaagtcaatggtatcttgatggggatagcattgaatctataaattactttgggcagtatggcaatttttacgatactgattcttcctatccataagcatggaatgtttttccatttgtttgtgtcctctcttatttccttgagcagtggtttgaagttctccttgaagataaccttcacatcccttgaaagttgtattcctaggtattttattctcttagtagcaatggtgaatgggagttcactcatgatttggctctctatgtgtctattattggtgtataggaatgcttgtgatttttgcacattgattttgtatcctgagactttgctgaaattgcttatcagcttaaggagattttgagatgagacaatgaggttttctaaatatatgatcatgtcatctgcaaatagagacaatttgacttcctctctttctatttgaataccctttatttctttcatttgcctgattgtcgtggccagaaattccaatactatgtggaatagaagtggtgagagagggcatccatgtcttgtgccagttttcaaagcaaatgcttccagctgttgcccattaagtatgatattcgctgtaggtttgtcataaataggtcttattattttgagatacatttcattgatacctggtttattgagagtttttagcataaaggggtgttgaattatgtcacaggccttttctgcatctagtgagataatcatgtgacttttttgtcattggttatgtttatgtgatggattgcatttattgatttgcatatgttgaactaactttgcatcccaggtatggagccaacttgatcgtagtggataagctttttaatgtgctgctggattcagtttgccagtattttattgaggattttcacatcgatgttcatcagggatattggcctgaaatttcccttttttgttgtgtctctgccaggttttggtacccggatgatggtggcctcataaaacaagttagagagtattccctctttttctgttgtttggaatagtttcagaaggaatggtataagctgctctttgtacctctggtagaattcggctgtgaatccgtctggtcctggactttttttggttggtagtctgttaattactgcctcaatttcagaacttgttattagtctattcagagattcgacttcttcctggtttagacttgagggggtgtatttgtccaggaatttctccatttcttctagattttctagtttatttgcatagaggtgttcatagtattctctgatgatagtttgtatttctgtgggatcagtagtgatatgccctatgtcgttttttactgtgtctatttgattcttctgtcttttcttctttattagtctggctagcagactatctattttgatgacttttttcaaaaaccagctcttgaattcattgatttttttgaaggttttttcatgtctctagctccttcagttctgttctgatcttagttaattcttgtcttctgcgagcttttgaatttgtttgctcttgcttctctagttcttttcattgtgatgttagggtgtcaattttagatcttttctgctttctcttgtggggatttagtggtataaatgcccctctacacactgctttaattgtgtcccagagatcctggtacgttgtatctctgttctcattggtttcgaagaacatctttatttctgccttcatttcattaattacctagttgtcattcaggagcagattgttcagtttgcatgtagttgtgtggttttgagtgaatttcttaattctgagttctaatttaattgcactgtggtctgagagactgttatgattttcattgttttgcatttgctgaggagtgttttacttctaattatgtggtaaattttagaataagtgcaatgagttgctgagaagaatatatattcttttggtttggagtggagagttctgtagatatctattaggtcagcttggtctagagctgagttcaagtcctgaatattcttgttaattctctttttcgttgatctgtctaatattgacagtggggtgttaaagtctcccactattattgtgtgggagtctgtgtttctttgcaggtctctaagaacttgctttatgaatctgggtgttcctgtattgggtgcatatatatttagaatagttagctcctcttgttgcattgatccctctaacattatgtaatgcccttctttgtctcttttgaccaacaaacacaaccaacaggttagtttcaagtctgctttaccagagattaggattgcaaccccagcttttttttttttctttccatttgcttggtaaatattactctgtctctttattttgagcctatgtgtgtctttgcatgtgagatgggtcccctgaatacagcacactgatggatcttgactctttatccattttgccagtctgtgtcttttaactggggcatttagctcgtttacatttaaggttaatattgttatgtgtgaatatgattctgtcaatttgatgctagctggttattttgcccatttgttgcagtttcttcatagtgtcaatggtctttacaatttgttgtttttgcagtgactggtacctgttgtttctttctatgtttagtgcttccttcaggaggtcttgtaaggcaggcctggtggtgacagaatctctcagcatttgcttgtctgtaaaggattttttttctccttcacttatgaagcttagtttgggtggatatgaaattctgggtttaaaattcttttctttaaaaatgttgaatactggcccccactctcttctggcttctagggtttctgcagagagatctgctgttagtctgatgggcttccctttgtgggtaacccgacctttctctctggcttcccttaacattttttcctttgtttcaaccttggtgaatctgatgattatatgtcttggggttgctcttctcaaggagtatctttgaggtgttctctgtatttcccgaatttgaatgttggtctgtgttgctaggctagtgaagttctcctggataatatcctgaagagtgttttccctgttggttccattctacccatcactttcaggtacaccaatgaaacgtaggtttggtcttttcacatagtcccatatttcttggaggctttgtttgttcctctttattcttttttctctaatcttgtcttcacgctttatttcattaatttgatcttcaatctctgatatactttcttctgcttggtcgattccactattgattcttgtgtatgcttcacgaagttcttgtgccatggtttttatccccatcaggtcatttatgttcttctctaaactggttattctagttagcaattcctctaacctttttcaatgttcttagcttccttgcattgtgttagaacatgctcctttagctcagaggagtttgttattacccaccttccgaagcctaattctgtctgttcatcaaactcattctccatctggttttgttcccttgctgatgaggagttgtgatcctttagaggagaagaggcattctggttttcatctttgtagatttatttacctttggtttttatgttagtgaccttagaatggggtctctgagtggatgtgttattcctttatgtttgttagttttccttctaacagtcgggcccctctgctgcaggtctgctggaatttgctggaggtccactccagaccctgtttgcctgggtatcaccagcggaggctgaagaacggcaacgattgctgcctgttctttcctctggaagttttctcccagaggggcacctgccagatgccagccagagctctcctgtatgaggagtctgttggcccctactgagaggtatctcccactcaggaaacatgggggtcagggactcacttgaggaggcaatctgtcccttagcagagcttgaatgctgtgctgggaggtccactgctctcttcagagctgtcacacagtgacctttaagtctgccgaagctgtgtccaccactgccccttcccactggtgctctgtcccagggagataggggttttatctataagtccctgactggggctcctgcctttttttcagagatgccctgcccagagaggagaaatctggcagtctggccacagcaaacttgctgagctgccatgggctctacccattttgaacttccctgaggcttctttacactgtgaggggaaaactgcctactcaagcctcagaaatggcggacgcccctcctcccaccaaactcgagtgtcccagtcggtatcagactgctgctgtgctggcagagagaatttcaagccagtggatcttagtttgctgggatccatggggttggaacccactgagcaagactacttggctccctggcttcagccgctttccaggggagtgaacatttttttctcgctggcccttaaggtatgggggaaaaaaaaaaaaccctgcagctagttcagcgtctgcccaaagggccgcccagttttgtgctggaaacccagggtcctggtggtgtaggcaccgaaggggatctcctggtctgcgggttgtgaagactgtgggaaaagcacagtatttgagttatagtgcacaatgcagtccctaatggcttcccttggctgggagatggagttccccgaccccttgcacttcccagttgaggcgatgccccaccttgctttggctcgtccttcttggtctgcacccactgtccaaccagtcccaatgagatgaactgtgtacctcagttggaaatgcagaaatcacccaccttctgttttgatctcactgtgagctgcagacagagctgttcctatttggccatcttgccagcaatcaagacacaaattttctgatatcaggaatgaaatagaggatattgctgcagaccccacaggcatcaaaagaataataactatgaacaactgtgtacgtgtaaattggacaaattgcatgaaatggaccagtttatccaaacactaccacagttcacccacaatatattagagaatttgaataaccctatgtcactatttaggaaattgaatttgtaatttaacagtttccaaaaattgaatcttcaggcccagatgttacaatggagtaaaaatgttaaaaattttggagaatattccacatgtttaaggagaatcttccagtcactgcaatctgtttctcaggaagccacagtcctagcagaagggaccacaacaaggtaacaccctgtgggacaaaagaatctgaatagcaggtcttctctcccaggtctctctgctgataggatcagaggtgtccatctgacctgaatagccagaacactgggacaaggttgaggctgtgagttggatagctttcctgcttgcctggcaggggaattgaggtagcttccactcttcacccttataaaacctcagcacatctcattgagagctcctccaacacccttatcaagtctggggtcttagcctaccattatgtatgacatctcacctgccttagctacaactggtgcctatacaggaatatgtttcctcttgacctgaagcctgaatcatcaactcagcaagtataaaaatgggggaaaattaaataaacaaataaagtgtacaccatgagagaaggaaataagctttaagagatccctgccattctgaccccataagaaacagtgaacttgcccacacaccaagaacttaactactaaaaccatcatctgggaaagccagttggaaaagattctctataaataaggaactcatacagagttttcatcctaaaatcaccaagaatcaaactaggctaaaataaacattggcgtatgatccttaagaaagaaaaaaagaagttaaaaaaaaccacagtccaataaaaaataaattcaagaacaatttgattagtctacccaaatgagaaggaagcaggaaagtaattctggtaatatgacaagacagggttctaaatcatcctgaaaagatcctactagctccccagcattggatccaaaccaagaagaaatctctgaagtgccagataaagaattcataaggttgattagtaagctactcaagaagacaacagagaaaggtgaaaaccaacttaaattttaaaaaatcaggatataattaaaattttttcagaggaatagatatcataaaggaaaaaacaatgagagctactggaaatgaaagacacacttagggaaatacaaaatacagtggaaaattttaacaataagctagaacaagtagaagaaagaatttcagagcttgaagacaagactttcgaaataacccaaacagacaaatacaaataaaaaagaatgaaataaatgaacaaagtctccaaggaatatgggattatgtaaaatgaccaaacctaagaataagtggtgattctaagaaagaacagaaatctaaaagtttggaaaacttatttgagggaataattgaggaaaacttccctggccttgctagaggtctagacatccaaactgaagaagtcaaaagaactcctgggaaattcattccaaaacaatcatcattaaggcacagggtcaccaggttatctaaagtcaagattaaaaaaaacataattttaagagctgtgagataaaagataacctataaagcaaaacctatcagattaacagcagatttctcagcagaagctttacaagtcagaagggattggagtcttacctttcacctcctgaaacaaaataatgtcaccctaaaattttctatctagcaaaactaagcttcataaatgaaaggaagataaagtcttcttcaaaaacaaatcctgacagaatttgccacccccaaacaagcactacaataaatgctaaaaggagttctaaatgttgaaagaaaaccttgatatacaccaaaatataaccttcttaaagcataaatctcacagggcctataaaacagtaacacaatgaaaaaaatccaaaacatataggcaacaactacatgataagtacaacagtacctcacatttcaatactaacatcgaatgtaaatgggcctcaacgctacacttaaaagatacataatagcagaatgaattaaataaaccaccaaccaagtatgtgttgttttcaagagactcacctaatgcataaggactcatgtaagcttaaggtaaaggggtggtaaaaaatattccacacaaatggaaaccaaaagcaagcaggagtagctattcttatatcagacaaaacagactttaaagcaacaacagtttaaaaaaaaaagacaagcaaggacattgtataatgataaaaggattagtccaacaggaaaatatcaccatcctaaattatatgcacctaacactggagcacctaaatttataaaacaattggtactagacataagaaatgagataaacaacaacacaataatattggaggacttcaatactatacttacagcactagacagatcatcaagacagaaagtcaacaaagaaacagtggacttaaactataccctagaacaaacagaattaacatatatttacaaaacattatttccaacaactacagaatatgcattctttttttcagtgtatggaacattctccaagatagaccatatcataggtcacacaacaagtttctataaatttaagaaaatcaaaattatatcaagcattttctcagaccacaggggaataaaattggaaatcaacttcaaaaagaaccctcaaaactatagaaatacatggaaagtaagtaatctgctcttgaatgagctttgggtcaacaatgaaatcaagatagaaatttaaaaattatttgaaatgaatgataatagttacacagcttacaaaaacctgtgggatacagcaaaagtggtgctaagacaaaagttcatggtgttaaatgcatcaatcaaaaagtctgaaagagcacaaatggacaacccaatgtcacacctcaaggaacaagggaaacaagaacaaactaaactcaaacccagcagaagaaaagaaataacaagatcagagcaaaactcaatgaaactggaacaaacaaaaacaatgcaaaagataaatgaaacaaaaagctgattctctgaaaagataagcaaaattgatagactgttagtgagattaaccaagaaaagatccaaatgaactcaatcagaaatgagactggagatattacaactgataccatggaaatacaaaagataattgaagtgtactatgaacaccttttcacacacaaactagaatgtgtagaggatgtggacaagttcctggaaatatacaagcctcctagattaaatcaggaagaaacagaaaccctgaacagaccaataacaaaaagcaagattgaaactgtaattttaaaattgccaacaaaataagttcagaaccaggtggattcacagctgaattctatcagacattcaaataagaattggtaccaatcctactgaaaccattccaaaagacagtaaaagaagaaatcctcattaaatcattctatgaagccagtgtcaccccaatacccaaaccaagaaagaacacaaccaaaaacgctacagaccaataccctgatgaacatagattcaaaaatcctcagcaaaatactagctacccaaatccaacagcatattaaaaagataatacaccatgatcaagtcagttttatcatagggatgcaggtatagtttaacatacacaagtcaataaatgtgatacatcacataaacagaatcaaaataaaaaatcatatgattagctcaatagatgcagaaaaagcatctgataaaattatcccttttttataaaaacactcacaaaaactggcatagaagagacatacctcaagataataaaagccatctatgacatacccacaggcaacattatactgaatggggaaaaattgaaaacattccccgtgagaactggaacaagacaaggatgcctattgtcaccacttctattgaacatagtactggaagtcatagccagtgtaatcagacaagagaaagaagtaaagagcatccaaattggaaaagtggaagtcaaaatgtcactgtttgccaatgatatgatcatatgcctagaataccctaaagaataatccaaaagctccttggcctgataaacgaattcagtaaagtctcaggatacaacatcaatgtacacaaatcagtagcactgctatataccaacaatgactaagctgagaattaaatcaagaagtcaacccattttacaacagccgcaaaaataataataataagatatttagaaataaccaaggaggtgaaagatatctgcaaggaaaactacaaaacactcctaaaaaagatcatagatgacacaaacaaatggcaacatattccatgctcatggaggggtagaatcaatagtatgaaaatgaccatactgcccaaagtaatccacagattcaatgcaattctaatcaaaataccatcatcattctttacagaacaagaaaaaagcaatctaaaattcatatggaaccaaaagagagcccacatggctaaagcaagactaagaaaaaggaacaaatctggaagcatcacatttcccgacatcaaattatactacaaagctataagctaccaaaacagcatggtaatggtataaaaataggcatgaagaccaatgaaagacaatagaaaacccagaaataaggccaaatacttacggccttctgtaagtattgacaaagcatacaaaaacataaagtggggaaaggacaccctattcaataaatggtgctgggaaaactggcaagccacatgtagaagaatgaaactagatcctcacctctcaccttatacaaaaattaactcaaaatggatcaaatacttaaatctaagaactgaaactataaaaatactagaaggtagcattgggaaacttttctggacattggcttaggcaaagaattcatgactaagactccaaaatcaaacgcaactaaaacaaaaataaataaatgggacctaattaaactaaaaatcttctgtacagtgaaattatcagcagagtaaacagacagcctatagagtgggggaaaatatttgcaaactatgcatctgacaaaggactaatacccagaatctacaaggaactcaaacaaataagcaaaaacaacaaaaaaaatcccatcaaaaagtgggcaaaggggcaggtgcagtgactcacgcctgtagtcccacaactttgggagtccaaggaaggcagatcactggaggccaggagtttgagactagcctggccagtatggcgaaatcctgcctctactaaaaagaaaacacaaaaattagctggcacggtggcttatgcttgtggtcccaggtatttgggaggctgaggcatgagaattgcttgagcctgagaggtggaggttgcagtgagccgagatcatgtcactgtacctcagcctgggtgacagagtgagactgtgcttcaaaaaaaaaaaaaagaaggagaaagagaagaaaagaaggagaagaaggagaaggaggaggaggagaaggaggaggaggaagagaagaagaagaaggagaagaagaaggagaagaaaaagaagaagaagagaagaagaaaagaagaagaaaagaagaagaaggagaaggagaagaagaagaggaggaggagggggaggaggaggagaagaagaagaggaggaggaagaagaagaagaagaagaagaagaagaagaagaagaagaagaagaagaaggagaaagcaggcaaaggacatgaataggaaattctcaaaagaagatatagaaatggctaataatcatatgaaaaacccgcttaacatcactatactatactacaagtctgcagtaaccaaaacagcatggtactagtaccaaaacagatatatagaccaatggaacagaacagagtccttggatttaatgccacaaatctacaaccatctgatctttgacaaacctgacaaaaacaagtgatgtggaaaggattccctatttaataaatggtgttgggaaaactggctagccataagcagaaaaattaaacaggacaccttctttacaccttatacaaaaattaactcaagattgattacagacttaaatgtaagacctaaaaccataaaattcctagaagaaaacctaggcaataccattcaggacataggcatgggcaaagacttcatgactaaaacaccaaaagaaatggcaacaaaagccaaaattgacaaatgggatgtaattaaactaaagagcttctgcatagcgaaaaaaactatcatcagagtgaacaggcaaactacagaaaaaatttttgcaatctatccatctgacaaaagtctaatatccagaatctacaaggaacttaaacaaatttacaagaataaaagaaagaaccccatcaaaaagtgggtgaaggatatgaacagacacttctcaaaagaagacacttaagtggccgtcaaacatatgaaaaaagctcatcatcactggtcattagagaaatccaaatcgaaaccaaaatgagatactatctcacaccagttagaatggtgatcattaaaaagtctgtaaacaacagatgctgattatgtggagaaataggaatgtgtttacactgttggtggaagtgtaaattagttcaaccattgtggaagacagtgtggtgattcctcaaggatctagaaccagaaataccatttgacccagcaattccattactggatatatacccaaaggattataaatcattgtactataaagacacatgcacacatatgtttattgcaacacagttcacaatagcaaagacttggaaccaacccaaatgcccatcagtaatagactggataaagaaaacgtggcacttatacaccttggaatactatgcagccataaaaatggatgagtttatgtcctttgcagggacatggatgaagctggaaaccaccattgtcagcaaactaacacaggaacagaaaactaaacactacatgttctcactcataagtggtagttgaacaaaaagaacacatggacacagggaggggaacatcacacactggggcctgtcggggtggggggctagggtagggatagcattaggagaaatacctaatgtagataacgggttgatcggtgcagcaaaccaccatggcatatgtatacctatgtaacaaacctgcatgttctgcacatgtgtcccagaacttaaagtataataataaaaaaaagaaagaaaaatttgataaattggacttttaaaaaaaatttaaatactcttccaaagaccctttcaaggtgacaaaaaggcaagctactgcgtgggagaaaatattttcagccacatgtctgcggaaatactcaaatctagaatatataaagaaatattaaaactcaacagtgagaaaacaaatatggttgtccctcagtgtatataggggattggtcctaggcctctacctgtaccaaaatttgcacatatccatactcaatcttacagtcagccctgggcatacaaaaagtcagccctccatatatgcaggtattacatcctgtgaatactgtatttttgatccatattttgttgaaaaaaatccatgtacaagtgaatctatgcagttcaaacccatgttcttcaagggtcaatggtaatccagttagaaaatgaaccaaagacatgagcagacatttcatagaaaaggatatatggatggcaaataagtatgtggaaaggtgttcaacatcaatgggcattagggaaatgcaaattaagatcactttgaagtatcactacatatttattatgatagttaaaataaaatagttggccaggtggagggactggatcactcatattttgctggtgggcatgtgaaatgatacactctggaacagttgggcagtttattgaaaagctaaatgtgcaattatcatataacccagcaattgtactcttggatgaaaacttatggttaccataaaacttgtacatggatattcatagtggctttattcataattaccaaaaattagagtgagtctagatgtcctttaatagacattgtttgagattgccattgcatggtggtaataaagagtagaccaactttagttggttttatttttatattttaattttctacacacagcatacccccttattgtcttcaccccagggtagactgttgttactgccctgcacttgatgcaccactattgaaagatattaatggcaccatcaaagcctgcagtgacattgttgtccctccactaaagcaaggaccaggcttccctcagagaaactgactttacaaatagtaaatagaggctctttctgaaacctatcttcgtaaacatatttccctctcctaacaaggagttttggcccttctgccctttagtcagggtcttggtccttggtatttcttgccacagcaggcaatagacaaaggctcccaaagaccttggatggaggcagacattgtggctatgtaccttgtacccaaaggattaagctgccatcttgctggtggcagcccttcaccccagagagaggaaatgccactggtgctttgaggaaggctttgtgcctttgattttccatgtcaagtcagcacttaactgtgaccctggacacatgaggtgaaaaatctttggtttattttggcattaatgtctcttgcccaataacatgggtttctgtaaacagaagtaggcatggagggaggagggaggattacataaaagggactcatccaagcagggctagctgcactatgctgatttctattaaatggcaatgggagataccctcttacccctgatttcagttagtggtagttactttcatcttaatcgaattaattacaaattgggaaggcttgggtcagcttcataaaatgctgttatttatgttgacatttttatgtggctttagctaatatatgttttaattttagattcagggactacatgtgtacatttgttatatgaatatgttgcataatattgaggtttgggcttctagtgtacccatcacccaaatagtgaacattgtacccaataggtaatttttcaacctttattcccttcccattctcccactaatgattattattttaatctcagtaaccagcaatatacctggccactcatgcatgtgcacacacacaaaccctatttgctgtagtggaaaccactctggtgaaggagatatccatggtggaagagttgggcagagtggagaaagaaggaccctatcatttgttgactgcccaccatgtgccacatactctgcttggtgactttacatgtcttagctcatttaatcctcaccacataatgtgtaaagtagatgctattattattcctgtgttactgatgaggaagccaaggctgagggaagtgaagtgagatgatcagataacgtcactcttccggtgcttaaaattataaaattccccttccactgaggataaaagtcccaactcgtcccattctccaagctatgttttagggcctgtcaacctccctagttttatctaggcccctctccctcttgcagtaggtgctccagccacactgctcttcactcagttcctttaatgtgccatattcttcttctgtggggccattactcatgctattctttttgtctggactgttctcctgtgtgcccacctgcactcaccagcgaactcctattgattcttcaggtctcagcttagatttcacatcctcagttctcagggaagcctcctctgactgtcccctttaccctatagtgtccctcagactatgttaggtccctttgttgtatccttctatcacattctgcatctcctccctaccactaatatgattttacatacaaccttgtgttcaggatcgattttcttcattagatgaaacttgctgtctatatactgtcttgttctctgctctatccctagtacctagtacaatgaatgcctggcacatgataagtattcaataaataattattgactgaatatatattgaaaccctctataattaatacatagtaagtgctcaataaatatagttaaaatacagttgttattattgtccaaaagcaaatagttaatcagaggcagaaccaggatttataattgaagtctgagtctaaagcgcatgcttcttttatgatatgactttgtctgcagaaataggttcttggcccagcactgccctaactggttgtatgacacttagggtgagacactatactactctgaatcttagttttcccatcggtaaaatggttacaggagcaggcaaagttcaggtttatcttcacgtaacctagaaaaggaggagaatagaagtctagatagatggggatataagcaaataagtaattaaccaatacaaatcagtatcttccctctgcaagacagttgatgagctataacaagaacccttgatgtttttatgcccttcagcctggtaaccctgttcaaaggcaatatagagtagtggatggtatggatggtatgtaggctttggtgttagagagccctggttcaaatcccaacatccaatttactagctctgtggtactgggcaagttaccaccctgaacctcactcaattcccttctctacaaatgggataacacccaccttttaacccatttctaaggttacaaaaaaaaaaaaaatacaataacatgaaaagatgttttcttagtatagaaagagaaacttctcccaccatcctacccacctaacagttctttctgtagttctgtgccattgaaggctacctcttgaggcaagaggcacaggcaatgtcaagaaaagagagactgaagacaagcaggctgatggcagaagccagagtccagtgtgtggagttggatcacccataggatagactggggcagaggggaagatcagctactgagggagaagaaaggagactacaaatctgagtaaggggataatggctaggcagatcctgagaagcatggtagggagccagtgggaagacaacaacatgccttagagggtacccctttcaaaactttgtagccctttcccagaggcaggcttcaaattatgttattaaaggcccttgaaactgtgtttcttccaaatctttttcttatttagtcacatccatgtatgttttgaaattgtaatcttagtgtgtacactttttcagcgagtatcttatcttcaacattttctatgtcacaagtcttcagtggctgtcaaatatcctaattttgctgaaagcccagaaagtacacctctgtgtattaactttttgcttccttgaattacctccttaaaatatattcccaagtataggattcctgagccacacggtatacaattgggatttaatgaccaaaaccaggtttttctttttctaagaaagaaattacccataatatcctttccccttccttttctggaactgataaacacaccctctagagttgtgctgtctaatatgacagccagtagccacacgtggctgtttaaattttaagtttgattaaataaaattcaaaactcagttcctcagtagcactggccacatcacaagtgctcagtagccatatgtgcatagtggctattatactggacagcacagatacaaaacatttccatcactgtagtaagtttattggacagtgcttacttagagtttctcaagagatcatttttggtttcttgggtgggagttctttgtgttcaggactttcctgggcattgagaggctatttagcatctctggcccatgtccactaaatgccagtaacacatttccttgagtcaatctaacagccaaaacactccatatttgcaaatgccccataagggaacaaaattaaccccattcgagacccactgagcttttagagggaaacatctcctaactttttcttgagacaaggtcttgctctgtcacctaggttggagtgcagtagtgcaatcatagcttaagcaatcctcctgccttatcctcctgagtagttgagactactggcatgtaccaccatgtgtggctaattctttctttctttctttctttttctttttctttttcttttttttttcttttttctttttcttttttttttttgtagatataaggtctcactatgttgcccatgctggtttcaaactcctgggctcaagtgatcctcctgcctctgtcttccaaattgctgagattactggcatgagccattgcacctggccttcttttttgagatggcctcaggttggctctgcctggagagggggaagcttgtaaagatggcttagaaaaaaagtcctggctccatttctattttctcccttcttttgctggcctgtttcctgctttttgcaaattgcaggaacaagaccctgcagatggagaagatcaaggctcgtttgaaggctgagtttgaggcacttgagtcagaggaaaggcacctgaaggaatacaagcaggagatggaccttctgctacaggagaagatggcccatgtggaggaactccgactgatccacgctgacatcaatgtggtacgtggctgcctggagcctatctctaaagcctttgagaaagaggtagtggtgaatgatagggcctttccttgagatgtggcttaggcctagctcggggagcaggcatcagtgcaggctgtggtagagcagaagaattcaggagttctgagatccagccctggctctgtcactaactgactatatatcactggacaagtcccttctctctgggcctcattttccctctctgcactataagggggactcagtaccctctaaatgtactgatttgatgtgctctcattctgggattctgggagttgagagctagccttggggaaaagcagagcaggcagctgcctctggaatgtagtttaaagcactccaagctttcagtcagaccaaacaaatcatttctgcctgctaccaaagtggagcttcctcattgatatatcctttggaaactcttggaacacagaatatgaactgtctgctaaggtggtaagctcccctctttggaattattcaagcagcatcttaatggacacttgtatgagctactgtactgatgattccttcacaaggaaggaggttggcagtgctgaccagtaaggtcttttcaaacccttatcacccataaccatgaagaatatatttttaaaatttactttcaaaggaactaagtttatatttctggaaaactcatttctgtggcaatactcattttctgatgttgtcagacctaggatcataaaggaaatatgaatgaggtttggacagtaagcaattgggattttctgtgttagagatcgcagaattctagatctcataaagtgttgacagtttggctgccagctaaccaatgatacagggccagttaaatgaggaagatatttgccagaagggctaagaatataagccagtggatctcaaacttgagcatgcatcaaagccactttgagagcctaagacacatattgctagactccacccctgattttctgattttgtatgtctgaggtgaacctaagaatatgcatttctgagttcccaggtgatgctgatgctgctgatcccttggccacattttgagaatcactgatctaggagaaaagactgctggcctgggaggcggaagccctaagtctttatgcaggatttgatactaagaagtatttccccaggaaagtccctttttctctttgagcctcagttttctataaaatgggagtaaggtggactaaatgagctctgaaggacattccagctctaagatactatatttgaacaataccatttatttagcagtaaatattaatttagcccatttactgagtgctttatatgaatcctatcattacatcttcaccaagattgcatgagttaagcactagaatatcaccattataccgatgaagaaactgagacttgaccagagttacatggagagggcatgggagatcaaggacttgaatatagactgaacaagttctggagcttgtgctattattcactcagctatagatcctctctgagaaccttaggatcttttctctgtgcctatcccactctatgttccagatggaaaacactatcaaacaatctgagaatgacctaaacaagctgctagagtctacaaggaggctgcatgatgagtataagccactgaaagaacatgtggatgccctgcgcatgactctgggcctgcagaggctccctgacttgtgtgaagaagaggagaagctttccttggagtaagctacctgcccccagtccctacaacataccctccctccgacccacatacatacttacatacctacacacacacgggcaggtatacatacacaaagcctagcctgaaagtcagagtgcctagttttagtcccaggcctttcagtggcttactcactgtgtgatcttgggcaagtctctgtgccagcttgttaaaacagaaggaggattattaaactggatgaattactagatgaattagaacaactactaggtggctttttaaattctttgtgtgatattgacaatacaagactatgtctataactcttaagagatcatttcccaagtcagggtctagaaggcgatatctagaaacctctaaaaacaaaaaagactgagctttcctggtcttcaggaagtggcctgggacttacttcatctcctggctcagagttaagaactaggcttgccttgcagagagacagaatttgacctggtagaggaaatcatttcctaaaggtagagcaaggtgtctgtggagtttgtgagcttcctactcttagagatatgtcaccagaggccttaggacacttaataggaatactcaaaagagcatgagatagcagataggactgaataccctttaaggatcttgctagccctaagatttcttggtcttcttggcctatcagagctaaggacaaagaggattacccttctcatcagacattgggcctagtacccagggacaatagccttgtgcttgggaaggtgtggggaccttctagaatgagccacagctcaacccttggttgtatggcatggagtctttaagaggagcaaggttctcattgctttcagaatgatctagccagtgtctctcatctccaaagttactttgagaagcagaaagcagaatggcagacagaacctcaggagccccccatccctgagtccctggccgctgcagccgctgccgcccaacagctccaagtggctaggaagcaggatactcggcagacggccaccttcaggcagcagcccccacctatgaaggtaagtgagctgggtaatggttgtggaggaagcaaagtatcctcccatggaagggccgtggaaggctagttctgggtctttggctttatttatgctgggccttcttttaatggcctttgcttgtgacacagtggaaggggtgacatgggtgtgctgtgttggacacacacagcacaggttttgttgccccatgttcccagaggtgttagaatgcagggagattttcaggccctgctagagtgcaattctaaaagttagaaatgactcttacacaaagatgtaatgagcatgtatcataaatgagggaaccagcaggattataaagctggttccaggagcatttggaacaaatatctatatagtcaagaaaggagaggaaggctgaaacaaatttgcaaagttagatgcaaaactggtttacatcccacaggacaataaaactgtaactttatagttactttttcttccaaacagaagtaatttgcatctctactgggcaaaagccatttgcagcttatcagtgtaacatcacagagcctgggtcctaatcaattggtaaatagtcaaacaaagagacattcttctagagcaggggtcatcaaattacagcctacaggtcaaatctaatctgttccctgttttcgttaaagttttattggcccacatgcatgtctgtgtttgcaagctattgcaaacaacatgcatgcaagctattgtctatcacttctttcatgcaaaacagaattgagtagttgcagcaagtttatatgatgtaaaaagtctaaagtatttgctgtcctggcctttacagaaaatgtttgttgacccctgttctagaaaattaaatagtccttaagtgggcctgttagacaatgcttcattataatgacgaaaagatgtgtagttctcattttgccttactttctagttttgtatactttttctcaacaccattctctgaactgggttatgtccttccttcccatcttccatggcatccaagaatacttgagtctactcactgattattgctctcttctgatgggaaatcactttgctttctgggcccctggggaatcagaagtctaagttgttgcctggaagaatctgactactaactttctttttcctgtgtccctcaccaggcctgcttgtcatgtcaccagcaaattcaccggaatgc

SEQ ID NO: 4651 - DNA, 60045 bp, human
cctgaagctccggactacagctcccaggcctctccaagcccctaccgcacaggctcatagccccaagcccggaggaggtggctacattgtgtctattgtatcccttggctggtgtatttgtacatctctcgggacgtgaaattgacagtgaaaagtatggcagatgagcaagaaatcatgtgcaaattggaaagcattaaagagatcaggtaagtggcacgttgtccccctccccgcccctctccaacccttcgttgcgggagagggctaattatctattgttgggctgtttgtctagaggagctggaaaggggcccattcaccacagacttgccggagaggtgaggatgggaggggcgctgaggagagttgagagagagagagacctcttgccagatgtggctgagaaagcaaagatgaagaaacacgggtttggtaccaagacagttttattcttctcgaggtggaggtcagggctctgcattcatggacacgttttttaaaagtacttgtgtgccccaaggtgtctttggctccttgctctttaggagtcgggatttttttccagtctcttgttcaacttcagaacctggagttcgggaaaggcttttgagagccaagtctagcgcatcggggctggtggctgctgccaggggctgccaactgggggttgcagaggaatctcagcgggcggagctgggagaatggcgcgcgctcgttttcctttcactcactcgccactttcttccttcctatcccgcgcttgggagggggatgggagcaatggggactggggacgcggtcgctgcgctgatggtgggatcgcgacagctgctctgaggagctggaggtgacaggcgggctggcaaagtgggagttgccgaagtggagtccgctacacggttgctcctggagcagcttttggcaaagcgatgatattgtccttgctcagaacacaatagcgccaggcgggctgtgtgggctggcacaaggtctttcttcacctcgccttctcagcgtgagcccctgctttggcttttgctctcactctgagagtggcctgggtcaagctctctccctggagtgttttctgagaacccaaggtggaagatgtcaagtgtgtttctttaagaaataagactttgatcatgagatttaacccttagagtgctggatgagacctacacatggtgattagtggtggtaggtaaagcaccttggtttcttcttcttcttgaggggttgcatctctctttctacaggagaggtaaaggaagggaactatcatttattgagtcccttcccgcccctgtgtgccaggccctttgacctacttttgctcattcagcaagagtcctgtgagcttcctactcctcctttacagctggggaaatagaggcccagagaatttgagtgattttcccacagccacgcagcttgaaattgccacattttgttggtctgcctgcaaaggtattccttttcccactatgtcccaggtaaagtctggaaaggagaagggaatatgttgcaattttttttttttttttttttttttttggcaaaagcatcagaagctagctagaaagtgagacaccttagtacagtagaatgccagctgtcataacgatgcagctagtcagaagcttaggcttgcaaatggagagcctagacttccactctcaccaagcttcaaaggaaccaccaccccatgcccagagaaggaccagttgtgagcaaggactttaatccccagtgaaaatagacctctcccagtgaagaccatatggagaaccatgacttctacccttaccagtggtaactaggagtttctacctcaaccagctaggatggaatcagcataggcccagagagaaggccaaactttcacctctaaacagcagtaacaaacagcccttctccaaactggatgtcaagagacagtggagaaactggacttctactgtccctcttccatccaagagagtggtagaggactgctaaaacaaaagatttaaataagatccagagtatccaacttttaatcaaaaatcactttccatactaagatatccacttgaatgagaagagaaaataaacagatgccaatactgagataacacccatgttagaattatctgataaggatcttaaagcacctgtcctaaaaacatttcagtgagcagttacaatacacttgaaacaaatgataatgtagaaaatctcagaaaatgaatagaaagtctcaacaaagaaatataaaacataaagaagaacaaagtgacatttttagaactgaaaaatacagtaacataaaaaccccaaaaaactcaatggataggttcaacagtaaggtggagaagagagagggaaaaaatagcttacaaatataaaacaatagaaatcactgtggcactataacaaaagctttaacatttatgccaacaaattcccaggagaaagagggcaggattggaaaagtattgggaaaaataatgactaaaatcttcccaaattgtgcaaaagacataaacatttagattcaagaagaggagcaaacaccaacataattgacacaaagaaacacactccaaaacacattgtaatcaaccttctgaaaatgaaagaaaaaggaaacttcttcaaaacagctgaagagaaacaaaagctacaaaggaaaaaaaaaattagaatgacagatttatcatcagaaactgacgatgccctagcattttgtaagtgctgaaggaaaagaagtgacaacccataaatctatgtccaataataatatccttcagtattgaatgggtaatcaagacattctccaatgaagaaatactaaggaatttagatataccctaaaaaaagatgatagtaagctctgaaaacagaaaagaaacaataaacagtaagcaaaagcatggttaatgcagtagactttctctttcctcttgaaatttcttgtattttgataattgaagctaaatttatactgttatctagtgtggtctcagcatatgtagaggaaatatttaacacatttatattgtaaactggggaatgtaaaggggattgtaaatgtaaagagatgtaaaggggaggacatgcttctacacttcattcaagcatgtaaagtggtaatgtcagaagactattaaataaattatgtatacataatatattactgagagaaaacactgaaaatgctatacaaagaaatgtactcaaaacattataaataaatcaatatgaatttttaaaaaatgctccagtcacccacaggcaggcagggcaaagaaaatggagaaactaaaattacggagaatgaacagaaaaaaaaataaaaaggcagacttagccttcatgtatcaataattatgttcacaacaaatagtctaaataccttgcaaacattaatcaaaataaagcaggaatggccatcttaatatcaaataaaacagacttcagagcaaagaaaattcctagagatggatattacataatgaaaaatagtcaatctaccaagaagacataacaattccaaatgtgtgtgttccaaaagtgacttaaattaaactgcttttgacaattttacagtaatatacaaaggttaagccacttggtttaagaatttaaaatggagaaagtactataaatatatacttgatgttcacatatggacagataaacatgtatgagagatagaaataaggaaggagcaaagggtcaaagaaactgaagaaaggaactaacatttgtcaagcaccttttaatttaaaagctcctggctcatttactctttagtcttcccaaaggaaatctgggataggaattattacccccactttacggataaggacattgaggatcagacagattaggcaactttcccatggttacacagctaggaaagaaaaaataatatatcctcctattcacatggcatgcacatttcaatgttattaactgcccttacaaatgctgattatctgattaaccattattcacagttcttcaactgctataatcctaaatctcctgaagtataagcatagcagcatatttctgttaaagaaataatgtttgctggacagaagcaggaatgatgacagcagcatcatctaatgacctattgaagtcaagctaagagccttacacacatcaagacacgagcccagaaatatatgcattcatactcagcactcacaccaatggcagaatttgcagtgggaaaaacatcagaagcagattctcccaccacagaccattttctgcttctaactctgaacacacgcctacccctgtctttcctcccaatcccaatcacactcccacattatgttcccaacctcagcctccaaatcctacactaatctattttgcccatgttttccttggacttttaaatggtgatgaaggagcatgtagataagtggaagaagagagacaagaatggaacaaaagaagggagatagaaaagagggaaagggaggatagcagtaataaaacagagacagtgagtacaggcaccattaaatggaccagagccctacaccagctccccaagtacaaaacaatatttccttaaaatgcacatgccatccattcatgtgtattgcgtacactcacaccccgatgtacacatatccatacacaaagagctttcctcacttgaaaaaaagaaaaaccattttggaaggagatgttgagttaagtaggtactcttaaatgaatgtttctcgactgggtccttcttttctttttttctttctacacactcttttgagtaaattcctgtacttccatggcttcaaatattatcctccaaatctccaacctctataccccacccacattcatgctttagcccatacatatgacagcctactgggcttgtccgcctggaagtttcacagataaatctcagctttatatctacgtctcttcctacagcaatcaagctcctccccttaaacctttggtttaataccaccattctctgcacagttacctcagatggcaatctgaaagtcaatgttgactcccctttctctttaatgactcacctgcaatcacttagttaattctatttctatcctgaatatcttacccaatacctgccccactctccacctcccagttcactgctccatttcaggccttcattatgaattggcatggatatttgtaatgcagtatccatttccatctgaagaattacttccctgtctacagtctctcctctgtctgcaatggcatccacattgccttgagaactaccttcctaaagcatggttgttattttatttctcaaacatcttcactaacttttcattgtgtatgacaatctttttgaaaaatacaggctgcgtcccattattagctcataaaaagaatttagttggtcactagtagcatttttaaaaaaccttttttaaaataaaaaggaaattatcaacatacattgcatatgaagtagtaggtatactttggagaaggttttgtttagttttaaatatgtgtatgtgtgtattgtgtcatgaggtgaaattcatttctcacttacgtcatttcttactgtgtctctgttgaacacacatttacctatcggtgtttccatggcattcatgctgcctccccggaaatctgtcccatacccactattctgaccttatctgctactgctttttattaatcctatcctttagccatatagaagttcttactgttttatatatttccgttccaccagacctttgcctctgcagattcctcgttctagaatgccactctcccattccaagcatctaaatcctactcatttttcaaggaagacccatatgaaatgcctcgtcttctccaaaaccttctcgagttccccagtcaaaatgaattacaataccccaaccacagactccacagggagatttattatagcactcaagttatcccatctaatgatggaattttgaattgatatcctcccttccttcctcccttccttccttccttcccccctccctccctccctcccttcctctcttcctctcttcctcccttcttcctttccttccgccattggtgtggcagtcttggtaagctcctctgttacctggcttggggattgactcagaaccagtgcttactcaagaccaaggcacaggacaactggaacctctgggacttgtggatgggcaaattaagccaaacaatgctggccacaggagagactgaaaaggtgttggcatttggtattgagatgtaagaaagttatcagaatgaactgttataagaaatctactttgctgacagtagctttgtttccagttgagcaaataaatattacatggaagaatgcttagtacttaggcaatattctcaccagactggagtaagcaggaaaaactagctcctttgtgttcattcagtgacatttactgagcataaatctgggccataatcagggctgggctatcctttggtggcccatcacttaggataaataagacccatcagaaggatcttctaatcaaagtcaatagctctgatctctcccttgagttccagactcacatatctaactgcccatttaacttacacccttgcatgtatcactggcatctcaaacaggccctcaactccagccccacccctaaacatttttatttcccagtcttccccatctcagtaaatgcctcactatgctgaaatctggaagccattctttattcctctttttatgtgaccctctccatccacaccattagcatagtggttattatacttgaccatgcaggaggttacacctaaagggcttttaaatcattgattgctgagccccatttccagggtctctgattcagtagatatggagtggggcctgagaatttacatttctaacaagttcccaggcaatgctgctgctggtggtgcagggactacatgtggagaacaactgcattagtaagacctggccagttatacctatacaatataatctggaattgtccacttctcatcatcccctcaacttattaacaaataccagcacttttccatcaatctccagtaaacagtatcttttcacctaattttcccatcttcaaggcctacaggtcccagctgtcctaccctgctttttgagtgtgcattggggctgagtcacctctgaaactgggtgacagatgagcctgccaagtttgtcccagcaatggatgatccatggccctagaacttctccttctttgcacctgtcctcttccatatttgccagaaagaaatcattgaaaagaaggtatccagctgaatgttttatagtcttggctcaggagactgtctggagaacctgtggcctagcagtctgctatgatttgaatgtaccccaaatttcatgtgttgaaacataatcctaccattttgatggtattaagaggagagacctttcgggaagtaattaagtcatgaagcctctgccattatgaatggattagtgccttagaaaatgacttggaatgagtttagacccttttttgtacttctgtgattccaccatatgaagacacaacattcactccctcttgaaaatgcagcaacaaggtgccatcttggaaggagagaccaagcccctcaccagacaccaaatctgttggcacattgatcttaaacttcctagccttcggacctgggagaaataaatttttgttctttacaaattacccagtctgtggtattgtgttatagaagcacaaacagactaggacaggagctcaggaatactggtccaaaagttacctaagactgtcatcctggtgactgtagaaaccctaaagtaccctgaaaaccctgtggtttccctgtggttcacgagtcatactagctgtgctttagcctcttggaaaaatctcattaggaaattttatatataaaattgcatctttaatgatctggatggcttcctcacttgtagggccaaacattccacagatttcatctcattgaagcatccaacaattccatgcaaggctacactgagtcctactttccaggtagaatttccaaggtgccaagagattccatgaagtgcactatttcaccctgaaaattgatgactgagccaggacaagaattcaccctactggcctggtttttatggctttaaatccatcatatgatgaaagttccttgttgtgatggaaaggtgatcagatttacaacgctggattttccacttcctgaatttgtcttcttgggcaagtcactttacttctctcagcctcaaattcttcatgtgtgaaaataaagtgaaacatacctgccgatatggttcttatgaagattaaattttgatagcataaaaagtgcctaatacagttgctggaacatagtaggcaccacaaatataatagctattgttattaaataaagcctttcttaacagacggttgctttcagttcctgtcacttagatagattcttaataaatatgaaccaaatgaatgaaatccttgccacccatggtaatgtcttttcttctctgaggctactgatgctataatcactcccctggatttactacctaccattcagtagtttctcattccaaatgtaatgattgagccccgcttatggccaaagcagaatgataggtgttgtggaggttaaagagagaaatatggcatagtgccactgtctagaaagccctcgtgtatataattactctgatttcaagttgcttcatgcataaatctgtactttttagaggacccagaggaccatgactatgtgccttgtgctagtccctttcccatcctggacctttatttattcacctctgaaataaagaggatagatttcatgggtgactttgaaataatgttctgacgagcccagggaattctaaggagggttttaaagggccactgtgatagagtcaggtggtggttgaatttgaggacagattaatgactctgggggtcccacttccactttaaccataacagttatgatttgttccattttctatattggatctcaatcagttattttatttgaaggaagggatcttatcattcatccacaagaaccagcgcacttctggataaatggtgcttgcttaatacaatttttaagtctgcttgattgatggaagtttgtaaagagggaatttggtattgtgagtacatctaagcagtgactggcatgacactctttgtagattagagagaggaagggccttttatttagatttaatcttagctcaaacttctcaattgctggacagagaatggaaggctgggaattagatgcaaatcctgaagaccatagtaaaggcaatctacctcaaatgcaacaaattatttatttatttatttattattaagccattaagctccttctcatttctcctggctgccttaatcagcaaactttaaaaaaatccattccctctacgtaagccttttgacaagtcatttatttttctgggaaaacatgagcatgcttagaagttatgtttagtgggagttgtaggtttagatttaattctgggtgcagtaagaggtcattacaggataatttgagttatattttatataccataggaaacatccatttcaagtgtacaattcagcatgttttaataaatttaaagagttgtacaatcatcaccataatattttagaaaatttccatcattccaaaattagctctttgttcagtttcagttgatctttgttcttatccacagccccaggaaacctgtaatatattttctgtctaaatagagtggctttttcttgatgctgcatataaatagttatacaaatgtggccttttgggtctgccttcagtcacttagcttattgtttttgagattcattcacattgtaacatgtaacagtatttcattcctttttgttgacaaataatatcccattgcatggatatcgcacattttgggtgttcactcacaagttgaggagcatttcagttatttccactgttttggctcttatgaataatgctgctctgcacatttgtgtacaagtctttttgtggaaaaatgtttccatttctactgcttagattctcaggagtgagatttctgtttcatattgtaagtatatgtataactttttaagatacaagtgtttttgaaagtggatgtcctagtttccatcccaagagggagtgtatgagggtcccagtttctctacatcctcaacaatacttgttagtgtctgcctcaaaaaggcattatagccatcctagtggtgtgatgtgatagctcacagtagttttaacttgcatattcctaatgaccaatcttgttgagtatctcttcatgagtttatttgccacccatatatcctcttctgtgaagtgtttattcaaaccttttgttcattttttaactgggctgtttgtttactgattgtgagttttgagtgttatttacattttctggaaacacatttttaccagacacttgatttgcaaacatgttctcccagtctgggacttatcttttcattgtcttaacagtgtcttttgaattacaatgtctttttttttttttttttttttgcttctttgtttgaaacaggatatcactccgccacccaagctggagttcagcagtgccatcgtggctcactgaagccttgaattcctgggctccagaagttatcccacttcagcttccccaataactggactacaggcttgtgccaccatgcctggctaatttttcttaaatattttgtagagacagggtctcactatgttacccagggtggtcttgaactcctgggctcaagcgatcctcccgccatggcttcccaaagtgttctgattataggtgtgagacaccgcactgagccagaaacttttaatgttgatgaagaaatccaatttatcagtattttttatggattgtgaattcttgtgccatttaggagaaatgtttgcctaagtcgtattcacaaagattttctcctatattttcttccagaaattttatttttaggtttcacgtttaggtctatgatccattttcacttaatttttttgtatgttgcaaggtacgggttaaggattttcttttgcatttggatgttcagctgtttcactatcatttgtttgaaagacttgtccttacatctgtgggtttatttctgacctatctgcttcattgctttatttgtgtatctttatgccaatagtttgctgatttgattactatatctttttaataattacggaaaccaggtcatgtaggttctccaacttcattattcttcctcagaaataattttgactattctaggcgctttgaatttctatgagttttagattccccttgtcagtttctaccaaaaaccatactgggattttaataggattttgttggatctgtagattagtttgttagatttcaccagtgtgtaatgaaataatgtcctatttctgttctaggatctaacccaagataccacattgcatttttatgattccatttaacttattttatgacttattagctataatgctgttttattatttcagtggctgctttagagtttataatatacatccttaacttatcacaacctaccttcaattgagcgcataatactgcacatataatgtaagaaacatacaacactatatttctccctttctggcctctgtgctattgcattttggtactttttggtttaaactgttgattatatttttaagtaacttaattaaggaagaaaataatcatgatatttttctatgtagttaccattttcagtgctctgtattcctttgttttgatacatttccctctgctatcattttccttttgcttgaaggactccctttaacatttgtggtagtgcaagtttgctgatgatatagcattttacctttccttgtgtgaaaagttctcattttacctttgttttcaaagttgttttccctgggtaaataattctatattggcatggatttcgtccgtactttaaaagtgatacaccactgtcatcttgcttccaacattctttgatactctttgtgtaacatatcctttgtttctgactcctttactggttttgagcaatttgattatgatatagcttggtgtgatgttctttatggattttatgcttggagcttgatgaatctattggatcagtgggcgtgtagctttaatcaaatttgaaagatttttggccatttattcttcaaatatttttatcttcctctttcttcttggtcttcagttacctgtatttttaattcaatttaatttaatttgatttaatttaatttaatttaattttactgtggtaaggtcacagaacttgagatctaccctcaacaaattttatatttataatacagtattgttaactagaagcataatgttgtactgcaaatctcttgcagttatcatcctgcacaactgaaactttatacatattgaatagcagctctacgtttccccctccttcagttcctagcaactgccattctactctctgcttctaagaatttgactattttaaatacctcatatgagtggaatcatgcagtatttctccttctgtgattagcttatttcacttaggattatgtccatgttatctcatattgtaggacttccttcttttttaatgcttaataatattccattgcataaatatactacattgttaattcattcatttaggttgttttcatatcttggctattgtaattaatgccatgataaacacgggagtgcagatatctctttgagatcccgatttcaattcttttggacaaatacctagaagtaggagtgctggatttatatatttttatatatttattatacctgttggccatgtttatgttctttggaataatgtttatggaactcctttgcccagtgttcaatcgggttaatagcttttgtactattggtttgtaggatttcttatattttatacaaattaatccattatcagatatatgatttgcaaatatttcatcctttatgcagtttgccattttactctgtttattgtttcctttgctgtgcagaaacattttaatttgatgtgatcctacttggtcatttttgcttttgttgcctgtgcttttggtgtcatatccattaaatcattgccacaagcaaagtcttgaagtttttctcttatggcttcttgtaggagttttgtagtttcagaagttatgttcagtgtttaatacatttgtagttaatttctgtgtatggtataagataagggtccaatgttatacgtttgcatgtggacatagtttttcccatagcatttattgaaaggactatcatttcttgcattgtgtattcttgtaaactttgtcaaagatcaagtgactgtatgtgggtggattcatttctgggctctctgttttttcccatggcctctatgtctgtttttatggcagtaccatactgttttaattactgcagctttgtaatatattataaaatcaggggataagattgttctggctacttggagtttacatgaatgtaaaaaaaaatgccattgggatttttataaggattatattgaatctgtagattgccttgagtagtatggttaagtcttccaatccatgaacatgtatgtcttcccatatgtttgtgtctaccttaatttctttcatcaatacgttatagtttcatttattgctaagtattttgttctttttggtgctatcataagtgggattgtgtctgaatttccttttcagatagtttgttgatagtgtacagaaacacaactgactttgtatgttgattttgcatcttgtaactttactgaattcatttattaattctaacaatctttttggaattttttgggttttgtacaaataagattttgtcaactgaaaacagcaataatcttaccatttccttctcaattttggtgacttttatttcattttcttgtctaattgctctggttaggtctctaggatctatgttgaatagaaatgtcaagagtggacatccttgtctttttgctgatctttcagtgttttaccattaagtatgacttagctgtgggcttttcatatatggcttttattgtgttgaggtaatttccttctatttttagttgttgagagtttctatcaggaaagggtgttgaattttgtcaaaggctttttctgcatttattgagatgatcatgtgactgttatctttcattctgttgatgtgatatagcacattaattgacttttgcatgctgatctctcctcacatcacagggataaattccactggccgtgttgtatgatacttttaatgtgctgttaaatcagtttgctagtcttttgttgaggatttttacctgtatattcatcagagatagtgtcctctagttttcttttcttgtggaatcttcatctagctttattattagggtagtgctaggctcataaaatgagtttggaagtgtcgcctcttcacttttttggaaaagcttgaaaaggattggcattaactcttctttaagtgtctgtcagaagccaccagtgaagccagctggtcctggccttttctttgttgggaagtttttaattactgtttcaatctccttactaactacaggtctattcagattttctatttatacaggactcagtcttgccagattgtatgcttataggaatttatccattttttatgttatccaatttgttgatatgtgattcttcatagtagtcttatgatcctttctacttctttggcatcagttgtagtgtgtcatctttcatctctgatttcaattagttgattcttttctattttctcttagtctagctaaagatttgtcaattttgtttattttttcaaaaaaaaccctcttagttgcattaaaaaaatttgattctttatttggcttatttctgctctctcttcattatttccttcaaaactgaccaataaatcacatggttaatagaattattagctgatgacattaaaagttattataaatccatttcatatgttcaaaaagcttgaggaaaaactgaccaagtagaggcatggcagaaataaaaaagattcaaataaaaagtctatagatgaaaactattatgtctaagatcaaaaaatttcttagtttagaaaaagagggagaaaagattagtgaacttccagaaatagtaatagaaatcatcccaaacaaaatacatagggttaaagatttttaaaaataaacagtatcagcaaattgtgggacaacttcatttggttaaaaatacagataaccgtcatttaaaaacaaagaagaacattatgtaatgataaaacagtcaattcaccagaaatatgcaacaattataaatatatatacacccaatatcagaacactgaactatataaggaaacattgacaaactgatggtagaaatagacagaaagacaataatagtaagagacttcaataccccacttttaataatggatggaacagtcggacagaaaatcaataaaaaacagcaggcttaagaaacactacagaccaaatggaccttacagacatataaaacattaaacccaagagcaacagaatagatactcttcctaactgtacacagaacattctccaggatagaacacattaagacaattagcacatcttaacaaatgtaagaagatcaaaatcctaccaagtatcttttctgaccacagtgaaattcaacagtagaaggaaaactggaaaattcacaaatacccatcttaagggttatatttttcctgcttatttgtacatctggtaatagtaaagtgtgaatggatgccagaaatagtgaatttcatcttgttggttgctgcatgtatttgtattcctatacttagtatcagttttatccctataagtcttgctgttaagcatagttaagtggaaccaaagtagtgctttgtctagaagtcatttccccagtactaatgcaaaaccttctttgtattttaatgctttatgaattgtgaagttcttctaccttggctattggaaataggtccatgtgggctctgatcactgtcccctttgggtggttattttcctggccttatgtagttttcttatacacgtgtgctaatcaatatttaactgaataattggtggagttggatcctctgaaaattgagagagtcccctttttttcattaaaaaaaaattaaaacggtgctattgcaatagagttctctttctacataggtctacactctccaaaactcttttctgaaaaattttgataccttggcttccccagagtcatggctccatttttttcaattgaaggagactagcaggctctgactgagtttcccttccctgcagcctagaatatttatctaggcatgaagatatagccatcttagggctcatctaagcctttccatcttttggagatcactgaccttacttgcctgaagtccagtgacttaagtgctattttttcatataattttgtcagtttttttctgtttttagttatgcctgggagggtaaatcaggtccctgttactctatcttgactagaagtgaaagtcaaggttatttctcaaatatggtttcaaaagatcagattttgtcatttaagacacatattttacattcaaaaatgtaaagtcagggtgtgtcttaaaatccattggtgttttaatcatgcttaaacatgtgactgctgttggccaggatacagttgtggtggtgtcgtcagtatctgagcacatgtgaactttgccatgactattcatattgtcttctcttaaactgaattatgtccatggttgccaacatgtactgtccatagttgccaccatgtatttaggttgtcatttaaaatgtcctcaaaaagatttcaccatgattctccatcaaaatagaaagctattttgtatgaagaagaactcagaccagaaaagtctgataaaaataatctcttaaataagtctacattaggtctttcaatttgtataaaatgtaaattttgaattataagaaaacaatttgttatactgtaattggtagcattttttcttagtagtgtacaaaataatgtgtaccttacattcaaaggcatcctagattcaattaaataaaataactgattagccaggatattaataatgctaatctaagaaagtcctaaaataacagtgtttaaaacaagacagttttaattctccctcacattattgatctgggaacaaggtatttgtggtttgtggtggtgtttgatattggggacctaggctatttttatattgttgcttcactgtatacagggtttcgccctcatctatatgattcaagcccactgttgtgtacacattttatccaataggaaaatagcaatgggaatggttcttccatttatagtcacaatccagaagttgtagacatcatttctgcttccataaaattggccagaaagttgtcatatggtcacaaatagctgcaaaagggatggggtaatatagtccttatttcagacaacttcatgcccagctgaaaatcagagggtctattgctatagaaagaggggagaatgaatttggggagacaggaagtattgtgttgtttaagagagaaatgagatcagctcagggtatattctgctacaggtctccaattgggtgccacccccagtaccttcttaattctccatctttctgaatgcaaacacagatacaagagcccttatgcactgctggtaagagtatgaactgttatagccatcctgctgagcaaattggcactgcttaatcaaagtaagaatgcacattacctgggcccctgaaatccaactcctgggataaatcaccccccaccaccaccaaaaaaaaattactgagacaggtacaaggctattcacttaaatgttattttggaggtggggagattgaggcaaagtgggagtctgtccctggaagagtcaacagataaaatgtggttgatagccatatatagaagcaaggaattctggatattaacttgagattgctgtgtgaaaaccatattttggaaattggccaatataacaatttttatatacacatatatgtacatatatacacacacacaaatacacacacacacacatatacaggcatgtgccatataatgatgtttcagtgaacaatacaccacatataccatagtgtggtccctgaagattacaatggagctgaaaaactcctatcacctagtgacgtacccactgtaacatcatagtgcaatgtattactcacgtttgtgatgatactgcactgccagtcatataaaagtctagcatataaaattatctacagtacatgatacttgaaaatgataacaaatgactatgttactggtgtatgcatttactatactatactttttatcattattttagagtgtactcctcttacttattaaaaaaaaataactgtaaaacaggttcaggctggacttccaggaggtattccagaagaaggcattgttttcatattccttgaagactttccagtgggacaagatgtagagttgggagacagtgatattgacaatcctaaccctgtgtaggcctaggctaatatgtgtgtttctgtctttatttttatttttatttttttttatttttgaaacctggtctcactctctcacccgggctggagtgcaggggcatgatcatggctcattgaagccttgacatcccaggctcaaacaacccttccacctcagcctcccaagtagctaggaccacaggcatgcaccaccacacctggctaatttatatatttttttaatagagatagggtcttcctatgttgcctaggctggtctcaaactcctggcctcaagcgatcctcctgccttggcctcccaaaatgctggggttacagacttgagccactgtgcccagcctgtatctttatgtttaaccaaaaagtccaaaaagtaaaaataaataaataaatacaaacatagaaaaaacgcttatgaaataaggatataaagaaataaaatatttttgtacagctgtacagtatgtttttgtgtcaagctaagtattattgcaaaagagttgttaaaagaaaagcttcagccaaattaaatttaaaggaggttaattgagcaatgaatgattcatgaattgggcagcccttagaattacagcagatgcagagagactccagcacagccatgtagtggaagaagatttatagacaaaagggaagtgacatacagaaatcggaagtgaggtacagaaacaactggattggttacagctcagtgtttgcactatttgaacacagtttgaaccctcagcagtgtatgagtggttgaactatggctgctaggactggccaagactcagctattgttacaggcacatactcctaagttacgttttcaatcttgtctacctaataagttaggttatgctttgtcctcatggactcaaatgtagaagtacagtccttctcaggctatatttagttggctttaacaattcctcccttttggttactttctcaattttgagatgttgaccaaaactttagtcattgatgtcactatcaccattgtaaatgtacttatttggtcttgaaacccactggaaaacagtagaacagtgggttttacaaggtgggaacaaggacagagtagagggtacctccttatgctgtaacatcctgtttgcaggagaaaaacaaaatctggtctgttctaggatctatgtgtttccttaaagtcttagtttgattatgtcatatttagtatgagtgactccatgtttgtttggtttggtctgttagggcctaatgcaagagctcagtccaaaacaatggcctcccataattttgttttaaaactctacttttcgggtcaggttcttacttaggtgagggtgtgaccaaaacttagggccttagtgccactctgttaccatcattttgggtttctggtctcagcgtgtaattcataagttaccatgtgttcatggttgcatatttttttcagctcttgtcatcccagttgaagagagaccatttgatattctatagatggctgcatgcaaacatttaaaacttttgagagaatgcagcgcacaagggagactactattatgactattgggaggataacaccaacagtttgtagtatgctccttacccagggttcccataaatcaaaccacttaaaattaaatagattaaagaatgggctaaagagtctactcacttaactaagcagtctttccattaatcccctacaactgaatttttatattctacattttatgtatttctccataggcgacaagtgccagcagctgcacagatatttttccattgagccaatgctattatttagtataactttcacaagagaatttaaagtctgttgtgtagccatagcctttacagtaaaatctgctatagagcctatcatgagggatacatttttaatcattgcttcttttactccaaaccaaggaagaaagatctaacaaatgatgtcctctagaagagtaaaggcctcctcataatgttcactttaacccatgatgtgggttaagaggagtgaaccaatgttccctttctgactgattatgaggcaacgtgtgtaccgttaaagcttcttgtctacattgagccttcgtcttttatctgtcaaagtataaggttatccatgtataaggctggctgcaaaatccttcacaaataaaagtataccccataagtacacacaacagaccctcttttcacttctattcttcagaggcataagcaaggaaaaaaatagttagacaagaatctcatgatgctagagaagtcttgatctttgatcttgggaaaagctattcacatcagagatgccatcttcttctggggagaaacttcccaggttagctttactttaagggcttcactgggtgtacagttccaagagtgtggagggacccttctcagttgtgagattatgaacttaaaattcaaggtcctgaagttttgctgtagtgtggatggcaaatacagcctttctctgatgttctcagaagatccaatttttgggttctagattgtgaaggggttgattgtcctcagtcagtgatccataaaaactttctttacctggtgaaaataccctgtagcataataatctactgttataacagcaaccctcatacatgggaaaacttttatacaaccagaaaacatgcattgaaaatgacaactgaatgaaattcttatacaaaatgtttaaatggcccatcagctaaccaaatgcacctgaaggtttgattgttttcccaggaatatgggtgtgacaaaccaaatattgttcataaactattttaggaatttagaagacaccacattaatatataattaatttggatcattttgtcttttccatgatgagtcacagaatacagaacctttaataacaaaagctttaacgactcaggaaggacaaagtggctgtcctgcttctccatgagtccatgcttaattaacattagacttatgtcctcttgaataccagttatttctccaaattaggtacatagcactgataactggtgggttatcataggtaatttgacttagaccgtggagtttattcaaactgtatacctaaacaatttcagtattggctgattcagcattcaaatctggcagagtattttcttgttattccataactttctgttctacttgggttagtagttttataaaccagtccaccttttcattaaaatttcaggaattcttatccggtccaaatgatatgattttatagaaacctgtattgaagagtgattttcagggacctttcaatcctttcatgaacctcctaaaagacaccatattctaggattttgcatgcttgtgaaatttttcagaaacagcatcagcattaagcaactaactgtggaaatgacttcaaaggattatagttaaaaacacaattaaaaagaaaacttcattctttctgttgtctacaataacataataaccataataatgattaatagcaagcactcaaacatattagaaattttgaaatccaatacaatttttgagcatatatatatataattataaatatatataattatatatatatatataattatatatatatataattatatatatatatatatataattatactttaagttttagggtacatgtgtacaatgtgcaggtttgctacatatgtatacacgtgccacgtaggtgtgctgcacccattaactcgtcatttacattaggtatatctcctaatgctatatctccccaattcccccaaccccacaacaggccccggtgtatgatgttccccttcctgcgtccatgtgatctcattgttcaattcccacctatgagtgagaacatgcagtgtttggtttttcgtccttgcgatagtttgctgagaatgatggtttccagcttcatccatgtccctacaaaggacatgaactcatcattttttatggctgcatagtattccacggtgtatatatgccacattttcttaatccagtctatcattgttggacatttggcttggttccaagtctttgctattctgaacagtgccacaataaacatacgtgtgcatgtgtctttatagcagcgtgatttatagtcctttgggtatatacccagtaaggggatggctgggtcaagtggtatttctagttctagatccctgaggaatcgccacactgacttctgcaatggttgaactagtttacagtcccaccaacagtgtgaaagtgttcctatttctccacattctctccagcaccctttgttccctgactttttaatgatcgccattctggtgtgagatgctatctcattgtggttttgatttgcatttctctgatggccagtgatgatgagcactttttcatgtgacttatggctgcataaatgtcttcttttgagaagtgtctgttcatatccttcacccacttgttgaaggggttctttgttttttccttgtaaatttgtttcagttctttgcagattctggatattagccctttgtcagatgagtacattgcaaaaattttctcccattctgtaggttgcctgttcaatctgatggtagtttcctttgccgcccagaagctctttagtttacttagatcccatttgtcaatttcggcttttgttgccattgcttttggtgttttagacatgaagtccttgcccatgcctgtgtcctgaatggtattgcctaggttttcttctaaggtttttatggttttaggtctaacatttaggtctttaatccatcttgaattaatttttgtataaggtgtaaggaagggatccagtttcagctttctaatatggctagccagttttcccagcaccatttattaaatagggaatcctttccccattgcttgtttttgtcaggtttctcaaagatcagatagttgtagatatgtggcattatttctgagggttctgttctgttccattggtctatatctctgttttggtaccagtaccatgctgttttggttactgtagccttgtagtatagtttgaagtcaggtagcgtgatgcctccagctttgttcttttggcttagggttgacttggcaatgagggctcttttttggttccatatgaactttacagtagtttttttttccaattctgtgaagaaagtcattggtaacttgatggggatgacattgaatctataaattaccttgggcagtatggccattttcacgatattgattcttgctatccatgtgcatggaatgttcttccatttgtttgtatcctcctttatttcgttgagcagtggtttgtagttctccttgaagaggtccttcacatctcttgtaagttggattcctaggtattttattctctttgaagcaactgtgaaagggagttcactcatgatttggctctctgtttgtctgttattggtgtataagaatgcttgtgatttttgcacattggttttgtatcctaagactttgctgaagttgcttatcagcttgaggagattttgggctgacatgatggggtcaatattgtgaaaatggccatactgcccaaggtaatttatagattcaatgccatccccatcaagctaccaatgactttcttcacagaattggaagaaactacttgaaagttcatatggaaccaaaaaagagcctgcattgccaagtcaatcctaagccaaaagaacaaagctggaggcatcacactacctgacttcaaactatacttcaaggctacagtaaccaaaacagcatggtactggtaccaaaacagagatatagatcaatggaacagaacagagccctcagaaataacgccacatgtctacaactatctgatctttgacaaacctgagaaaaacaagcaatggggaaaggattccctatttaataaatggtgctgggaaaactggctagccatatgtagaaagctgaaactggatcccttccttataccttatacgaaaatcaattcaagatggattaaagacttaaacgttagacctaaaaccataaaaaccctagaagaaaacctaggcattaccattcaggacatacgaattggcaaggacttcatgtctaaaacaccaagagcaatggcaacaaaagccaaaattgacaaatgggatctaattaaactaaagagcttctgcacagcaaaagaaactaccatcagagtgagcaggcaacctacaaaatgggagaaaatttttgcaacctactcatctgacaaagggctaatatccagaatctacaatgaactcaaacaaatttacaagaaaaaacaaacaaccccatcaaaaaatgggcgaaggacatgaacagacacttctcaaaagaagacatttatgcagccaaaaaacgcatgaaaaaatgctcaccatcactggccatgagagaaatgcaaatcaaaaccaaattgagataccatctcacaccagttagaatggcaatcattaaaaagtcaggaaacaacaggtgctggagaggatgtggagaaataggaacacttttacactgttggtgggactgtaaactagttcaaccgttgtggaagtcagtgtggcgattcctcagggatctagaactagaaataccatttgacccagccatcccattactgggtatatacccaaaggagtataagtcatgctgctatacacatgcacacgtatgtttgttgtggcactattcacaatagcagacttggaaccaagccaaatgtccaacaatgacagactggattaagaaaatgtggcacatatataccgtggaatactatgcagccataaaaaatgatgagttcatttcctttgtagggacatggatgaaattggaaatcatcattctcagtaaactatcgcaaggacaaaaaaccaaacaccgcatgttctcactcataggtgggaattgaacaatgagaacacatggacacaggaaggggaacatcacactctggggactgttgtggggtggggagagtggggagctatggcattaggagatatacctaatgctaaatgacgagttaatgggtgcagcacaccagcatggcaaatgtatacatatgtaactaacctgcacattgtggacatgtactctaaaccttaaagtataataataataataatcaaaaataaaaaagaatccagagccatcagtgtgctgtattcaggaaacccatctcacatgtggagacacacataggcttaaaataaagggatggaggaagatctaccaagcaaatggaaaacaaaaaaggtggggattgcaatcctagtctctgataaaacagactttaaaccaaccaagatcaaaagagacaaagaaggtcatttcataatggtaaagggatcaattcaacaagaagagctaactatcctaaatatatatgcacccaatacaggagcacccagattcataaagcaagtccttagagacctagaaagagacttagactcccacacaataataatgggagactttaacatcccactgtcaacatgagacagatcaacgagacagaaagttaaaaaggatatccaggaattgaactcatctctgcaccgagcagacctaatagacatctacagaattctccaccccaagtcaacagaatatacattcttctcagcaccacaccgcacttattccaaaattgaccacatagttggaagtaaagcagtcctacacaaatgtaaaagaacagaaattataacaaactgtctctcagaccacggtgcaatcaaactagaactcaggattaagaaactcactcaaaaccgctcaactacatggaaactgaacaacctgctcctgaatgactgctaagtacataacgaaatgaaggcagaaataaagatgttctttgaaaccaacgtgaacaaagatacaacataccagaacctctgggacacatttaaagcagtgtgtagagggaaatttatatcactaaatgcccacaagagaaagtaggaaagatctaaaattgacaccctaacatcacaattaaaagaactagagaagcaaaagcaaacacattcaaaagctagcagaaggcaagaaataactaagatcagagcagaactgaaggagatagagacacaaaaaacccttcaaaaaatcagtgaatccaggagctggttttttgaaaagtacaacaaaattgatggaccgatagcaagactaataaagaagaaaagagagtagaatcaaatggatgccataaaaaatgataaaggggatatcaccaccaatcccacagaaatacaaactaccatcagagaatactaggaacatatattaatatcattcactaaaatataacctgaggaaagttaatttttttgacagtgcttcccgtgtaacttgctatgtcaaataattctgtttacctttcctctgggtgcttaagggtccctctggagcattccaagttagaggtcgcataatataattttgaagctgcaatttgattttgggaaggccatcaaatatggtaaagttttaaaacagtttgatatgatgaaatggaattctaggtactgtaagtcattcatttagccaaaatgatgactcaaaaaatttaagaaggcaaaaactgttagtcattgataggcagaaaccttagctttccaaacagtctgtctcttgtctttcccttcttttttggtagtttattcaaaaggcaaagaaaaatcttttattgtcctttactattgcatgaaaatcttgttcaagagagaaagcaaaatttcaccctggcattagtgtaccatgaatgttaaccctaattcttaagaaatcttatagacaaattgattcaatcttaatcatttggaccataaggtgagattcccataaaccttttattaccctttacaaatttttgttgaagagcagattagtgctctaagaaaaccctgttgtgcttttatttcaatgttcaagttatggaaaaaataataatacctctttaaatttagtcaatatgtttacagacaaaatttgttttacaatattaatttttacgaaccttttacaacttggtgaaacgtttacctttatcttatgtaatttaaaacaatcatttagccctttaatctaggcaaacatttacattcccatgccttcttataatattttaccaaaaatactttttattgtcttcacacaccttgcatataaaacttttttcagtagtctcaaatacatgttataatggtaactctccagaattttaatttttggtagaaaacctggcaagtaagtaattttaattatgtagtaggtttgtatccaaggaaatcagacagaagtacagataaggtgtgactctttcatcatttctgttagacttcactgcttcccaggttaacatttatgcatgtgttagccagaggaactcagttcttcagaaattaaaaattaaatttgtacctaaaatattggctttgctctcagattcccctgatgaacttagccaatgatttttcctacctaagtgtgcacaaaaaaaaatgtgaaacaaaggggtagaacgtaaaaatcctcatgaatatccagaagccaattttttttcaatttctacaatattgccatttactgccagtttttttctgacccagtcaggtgtaagagccctctaactggatccaagccagttaatcactggaacgaatccaatcctggaccaagtccggtttctatagtgacttataaaccaagtttggatgagaaattcgcccaaagaaactcaaagagctcaaaacacaaatccatgaagctccaaaacccaaaagagaacttaaccaagatctctagctcctctgatagatcaaacgacacaattgggtccttgcagttaccttgcttgttcactcagtgctcctgggggtcgttaaaagttctacttcagatgccacttctgacatcatctgttaaaagaaaaaaatcagccaaattaaatgtaaaggagtttaactgagcaatgaacaattcatgaatcagacagccatcagaatcacagcagattcagggaggccagcacagccacttcatggaagaagatttataaacaaaaaaaaaaaaaagagaagtgacatacacaaattggaagtgaggtacagaaacaactggattggtcacagctcagtgtttgcattattcacagtttgaacactcagcagcgtatcagtggttgaagtatggtttctgggattagccaaggctcagctattgttacagacacatactcctaaattaggttttcagtcttgtctacgtattaaattaggttgtggttcatccacaaggactcaaatatagaagtgcagagtctttctcagccatatttagtttgcttaacagagtaaaaatgtttttaaaaagtttaaagtttataaagtaaaagcattacaataacctaattttaatttattatggaagaaagacatttttaaagataaatttagtttagcctaggtatacagtctaactatagctggagtcttcaacatacctctatcaacatttgataaaacaagccagaaatcatcaaggatatagaaccatcaccatcaaccagcagaatctcattgacatttatagaacacttcacccagcagcaggatacacattctttgcaagtgctcatggaacatataccaaaatagatagaccatttcctgggatataaaataatccccaacaaatttaaaagaacagaaatacagaaatgtgttgtgtgacattaataaaatcaaactaaaaaccagtaaaccagaaaaaattaccagaaaaatctacacacgcttggacactaaacaacatatatctgaatgatgtgtatttcatagagagtctcaagaaaaataaaaatacactaaactgagtgagctgaaaaatatcaaaaattgtgagatgcagtaaaagcagtaatgaaaaaaattaacagcactaaatgcttacattataacagaagagatgccttaaaacaataatctaagctcccacttcaagaaactcgaggaagaagagaaaaataagatgaaggcaagcaaaaaacagaaactaataaaggtaagaacagaaatcaatgaaattgagactagaaaacaacaaagaaatgaatgaaacatttatatatttaaaacaacatatacacatttcatgcacattacctgtgctgtgaaatcccactcctgagatgaatccctggttgttttaagaatctatctatctatttatctatccaaacatatatatttcatatatataaaacaaccagggtttatccccagtgaaatttatatttaaatagacgtgtgtgtgtgtgtgtgtgtgtgtgtgtgtgtgcacgcatttaaaacaaccaaggggtttttccaagatggctgaataggaacagctctgatctgcagttcccagcaagaccaaagcaggaggtgggtgactgctgcatttccaactgaggtacccggttcctctcgttgggactggttagacagcgggtgcagcccacagagggcgagcagaatcagggtggggtgtcaccttacccaggaagtgcaaaggaccagggacctccctgttctagccaagggaagctgtgaggctgtgctatctgccccagatactacgcttttcttatggtttttgcaacctgcagactaggagattccctcatggacctgtaccaccagggccctgggattcaagcacaaaactgggtggctgtttgggtagacactgagctagctggaggaggttttttttgttttgttttgttttggttttggttttttttcccacacgccaggggcacctggaacccaagcgagagagaactgttcactcctctggaaaggcggtggaagccagaaagccaagtgatctcgcttagcaggtcccacccccacagagcccagcaagctaagatccaccagcttgaaattctcactcccagcacagcagtctgaagttgacctgggatgctcgagcttggtggggggaggggcttccaccattactgagacttgagtaggtggttttccccacacagtgtaaacaaagccaccaggaagttctgacttagcggaaaccatcatagcacagcaaagcagctgtggccagactgcctctctagattcctcctccctgggcagggcgtctcgggaaaaaaggcagcagtcccagttaggggctcatagatggaactcccatccctgggacagaacacctgggagaaggggtggctgtgggggcagcttcagcagacttaaatgttcctgcctgccagctctgaagagagcagaggatctcccatcagagtgctagagctatgctaagggatggactgccttgtcaagtgggtccctgacgcctatgcctcctgactgggagacacctcccagcaggagtcaacagacaccgcatacaggagaggtcagggtggcatctggcaggtgcccctctgggatgaagtttccagaggaaggagtaggtggcaatctttgctcttctgcagcctccactggtgatacccaggctaataggatctggagtggaccaccagcaaactccagcagactgcagaagaggggactcactgttagaaggaaaactaacaaacacaaagcaataacatcaacatcgacataaaggatgcccacacaaaaaccccatttaaaggtcattaaagtcaaagatcaaagttaaataaatacacgaagatgaggaaaaaccagtgcaaaaaagatgaaaattccaaaagctacaatgccacctctcctacaaaggatcacaactcctcgccagcaagggcacgaaactggatggagcaagagtttgacgaaatgacagaagtaggcttcagaaggtgggtaataacaaacttctctgagctaaaggagcatgttctaacccaatgcaaggaagctaagaaattttataaaagttgacaagaactgctaactagaataaccagtttagaggaaaacataaattacctgatggagctgaaaacacagcacgagaacttcatgaagcatgcgcaagaatcaatagccaaatcaatgaagcagaagaaaagatattagagattgaagaccaactttaagaaataaagcatgaagacaagattagagaaaaaaaatgaaaaggagcgaacaaagcctccaagaaatatgggactatgtgaaaagactaaatctatgattgactggtgtacctaaaagtgatggggagaatggaaccaagttggaaaacactcttcaggatattatccagaagaacttccccaacttagcaagacaggccaacattcaaattcagaaagtgcagagagcaccactaagatactcctcaagaagagcaaccctaagacacataagcgtcagattcaccaaggttgaaacaaaggaaaaaatgttaaaggcagacagagaaaaaggtcaggttaccaacaaaagaagcccatcagactaacagtggatctctctgcagaaaccctagaagcaagaagagagtgggggtcaatattcaacattcttaaagaaaaaaaattttgagattgagaccatcctggctaacatggtgaaaccccgtctctactaaaaaaatacaaaacaattagccaggcatggtggcaggcacctgtagtcccagctactcgggaggctgaggcaggagaatggcatgaacctgagaggcagcgcttgcagtgagctgagatcacgccactgcactccagcctgggcaacagagcgagactccatctcaaaaaaaaaaaaaaaaagaaaaaagaaaaaaattttaacccagaatttcatatccagctaaaataagcttcacaagcaaaggagaaagaaaatcctttacagacaagcaaatgctgagggattttgtcaccaccaggcctaccattcaagagctcctgaaggaagcaataaatatggaagggaaaaactggtaccagccactgcaaaaacgtaccaaaatacaaaaaccaatgacactaggaagaaactgcatcaactattgtgcaacaaaccagctagcatcatgattacaggatcagattcactcataacaatattaaccttaaatgtaaacaggctaaattccccaattaaaagacagagactggcaaattggataaaaaagactcaagacccatcactgttctgtattaaggagacccatctcatgtgcaaagatacacatgcgctcaaaataaagggatggatgaatatttaccaagcaaatggaaagcaaaaaaaaagcaggggctgcaatcctagtttctgataaaacagaccttaaacaacaaagatcaagaaagacgaaggatattacatgatggaaaagggatcaatgcaacaagaagagctacctatcctaaatatatatgcacccaatacaggagcaccaagattcataaagcaagttcttagagagctacaaagagactaagacttccacacaataatcatgggaaattttaacaccccactctcaatgttagacatatcaatgagatggaaaaaaatacaaggatattcaggacttgaactcagctctagcccaagcggacctaatagacatctacagaactcttcactccagatcaacagaatatacattcttctcagcaccacatagcactttttctaaaatcaaccacataaaggaagtaaaacactcagcaaatacaacagaacagacataataacaaacagtctgtctgaccacagtgtgatcaaattagaactcaggattaagaaactcattcaaaaccatacaacttcaaaagaagacatttatgcagccaacaaacatgaaaaaaagctcatcatcactggtcattagagaaatgcatatcaaaaccacaatgagataccatctcacaccacttagaatggtgatcattaaaaagtcaggaaacaaaagacgcagtagaggatgtggagaaataggaacacttttacactgttggtgggagtgtaaattagttcaacccttgtgaaagacagtgtggtgattattcaaggatctaattagaaataccatctgacccagcaatcccattactgggtatatacccaaaggattctaaatcattgtactataaagacacatgcacatgtttgcttattgcagcagtattcacaagagcaaaaacttggaaccaatgcaaatgcccatcaatgatagactggataatgaaaatgtggcattatacaccatggaatactatgcaaccagaaaaaagaaggagttcatgtcccttgcatagacattgatgaagctgaaaaccatcattctcagcaaactaacacaggaacagaaaaccaaacaccacatattctcactcataagtgggagttgaacaatgagaacatacaggcacaaggagggaaacatcacacaccaggacctgttggggggtgggggggcaaggggagagatagcatttggagaaatatgtaatgtagatgacaggttgatgggtgcagcaaaccaccttggcacaaacctgcacattctgcacatgtatcccagaaattaaagtataataaaaaaatcaatgaatctaggagctggttttgggaaagattaacaaaatagacggctagccagactaataaaaaagaaaagagaagaatcaaatagacacaataagtagtgataaaggggatatcaacactgaccccatggaaataaaaactaccatcagagaatactaaaaacacctttatgcaaataaactagaaaaatctagaagaaatggataaatttctggacacaaacacactcccaagactaaactagagggaagttgaatccctaattacaccaataacaacttctgaaaatgaggcaataattaatagcctaccaaccaaaaaaaagtccagggccaggcggattcacagccaaattctatcaaaggtaaaaagaggagatggtacaatttcttctgaaactattccaaacagtagaaaaagagggactcctccctaactcattttatgaggccagcattattctgataccaaatcctggcagagacacaacagcaacaacaataacaaagaaaatttcaggccaatattgctgattaacatcaatgagaaatactggcaaaccgaatccagcagcacatcaaaaagctcattcaccatgatcaggttggtttcatccctgggatgcaaggctagttcaacatatgcaaatcaataaacgtaatccatcacataaacagaaacaatgacaaaaacctcatgattatttcaatagatgcagaaaagacattcgataaaattcaacacctcttcatgctaaaaacattccataaactaggtattgatggaacatatctcaaaataataagagctatttatgacaaacccatagccaatatcatactgaatgggcaaaagctggaagcattccctttgaaattcagcaaaagacaagaatgacctctctcaccactcctagtcaacatagtattggaagttctggccagggcaatcaggcaagagaaggaaataatggtattcaaataggaagagaggaagtcaaattgtctctgtttgcaaatgacatgatggtatattcagaaaaccccattgtctcagcccaaagctccttaagctcataagcaactttagcaaagtctcaggatagaaaatcaatgtgcaaaaatcacaagcattcctatacaccaataatagacacacagagagccaaatcatgagtgaactcccattcacaattgctattaagagaataaaatacctaggaatacaacttacaaaggatgtgaaggactgcttcaaggagaactacaaaccactgctcaaggaaataaggacacaaacaaatggaaaaacattccatgctcatggataggaagaatcaatatcgtgaaaatgaccatactgcccaaagtaattcatagattcaatgctattcccatcaagctaccattgaatttattcacagaattaggaaaaagtactttaaatttcatgtggaaccaaaaaagagcccgtatagcaaagacagtcctaagcaaaaagaacaaagctggggatatcacgctacctgacttcaaattatactacaaggctatggtaaccaaaacaccatggtactggtaccaaaacagatatatagaccaacggaacagaacagaggcctcagaaataacaccacacatctacaaccatctgatctttcaccagtctgacaaaaacaagcaatggggaaaggattccccatttaatatgtagtgttgggaaaacaggctagccatatgcagaaaactgaaactggaccccttccttacaccttatacaaaaattaactcaggatgaattaaagacttaaatgtaagacctaaaatcataaaaaagaaaacccaggcagtaccattcaggacataggcatgggcaaagacttcatgactggaacaccaaaagcaattgcaatgaaagcaaaattgacaaatgggatctcattaaactaaagagcttctgcacagcaaaagaaactatcatcagagtgaacaggcaacctacagaatgggagaaaatttttacaatctatccatctgacaaaggtctaatatccagatcctacaaggatcttaaacaagtttactagaaaaaaccaaccccattaaaaagtgggtgaaggttatgaacagacaattctcagaagaagacatttatgtggccaacaaacatatgaagaaaagctcgtcatcactggtcattagagaaatgcaaatcaaaaccaaaatgtgatagtatctcatggcagttagaatggtgatcattaaaacgtcaggaaacaacagaagctggagaggatgtggagaaataaggaagcttttataataattgcaaaaattttctcccattctttaggttgcctgttcccactgataatagtttcttttgctgtgcagaagctctttagtttagttagatcccttttgtcaatttttgcttttggtgccattatttttggtgttttggacatgaagtctgtgcccattactatgtcctgaatggtattgcctaggttttcttctaggatttttatgattttaggtgttatgtttaagtctttcatccatcttgagtaaatctttgtataaggtgtaagtaaggggtcgagtttcagttttctgcatctggctagccagttttgccaacaccatttattaaatagggaatcctttccccattgcttgtttgtgtcaggttggtcaaagatcagatggttgtagatgtgtggtgttatttccgaggcctctgttctgttctatgtatctgttttggtaccagtagcatgcagtttcggtttctgtaaccttgtagtatagtttgaagtcaggtatcgtaacacctccagctttgttctttttgcttaggagtgtcttggctatgtgggctcttttttggttccatatgaagttaaaagtagtttttttccaattctgtgaataaagtcaatggtatcttgatggggatagcattgaatctataaattactttgggcagtatggcaatttttacgatactgattcttcctatccataagcatggaatgtttttccatttgtttgtgtcctctcttatttccttgagcagtggtttgaagttctccttgaagataaccttcacatcccttgaaagttgtattcctaggtattttattctcttagtagcaatggtgaatgggagttcactcatgatttggctctctatgtgtctattattggtgtataggaatgcttgtgatttttgcacattgattttgtatcctgagactttgctgaaattgcttatcagcttaaggagattttgagatgagacaatgaggttttctaaatatatgatcatgtcatctgcaaatagagacaatttgacttcctctctttctatttgaataccctttatttctttcatttgcctgattgtcgtggccagaaattccaatactatgtggaatagaagtggtgagagagggcatccatgtcttgtgccagttttcaaagcaaatgcttccagctgttgcccattaagtatgatattcgctgtaggtttgtcataaataggtcttattattttgagatacatttcattgatacctggtttattgagagtttttagcataaaggggtgttgaattatgtcacaggccttttctgcatctagtgagataatcatgtgacttttttgtcattggttatgtttatgtgatggattgcatttattgatttgcatatgttgaactaactttgcatcccaggtatggagccaacttgatcgtagtggataagctttttaatgtgctgctggattcagtttgccagtattttattgaggattttcacatcgatgttcatcagggatattggcctgaaatttcccttttttgttgtgtctctgccaggttttggtacccggatgatggtggcctcataaaacaagttagagagtattccctctttttctgttgtttggaatagtttcagaaggaatggtataagctgctctttgtacctctggtagaattcggctgtgaatccgtctggtcctggactttttttggttggtagtctgttaattactgcctcaatttcagaacttgttattagtctattcagagattcgacttcttcctggtttagacttgagggggtgtatttgtccaggaatttctccatttcttctagattttctagtttatttgcatagaggtgttcatagtattctctgatgatagtttgtatttctgtgggatcagtagtgatatgccctatgtcgttttttactgtgtctatttgattcttctgtcttttcttctttattagtctggctagcagactatctattttgatgacttttttcaaaaaccagctcttgaattcattgatttttttgaaggttttttcatgtctctagctccttcagttctgttctgatcttagttaattcttgtcttctgcgagcttttgaatttgtttgctcttgcttctctagttcttttcattgtgatgttagggtgtcaattttagatcttttctgctttctcttgtggggatttagtggtataaatgcccctctacacactgctttaattgtgtcccagagatcctggtacgttgtatctctgttctcattggtttcgaagaacatctttatttctgccttcatttcattaattacctagttgtcattcaggagcagattgttcagtttgcatgtagttgtgtggttttgagtgaatttcttaattctgagttctaatttaattgcactgtggtctgagagactgttatgattttcattgttttgcatttgctgaggagtgttttacttctaattatgtggtaaattttagaataagtgcaatgagttgctgagaagaatatatattcttttggtttggagtggagagttctgtagatatctattaggtcagcttggtctagagctgagttcaagtcctgaatattcttgttaattctctttttcgttgatctgtctaatattgacagtggggtgttaaagtctcccactattattgtgtgggagtctgtgtttctttgcaggtctctaagaacttgctttatgaatctgggtgttcctgtattgggtgcatatatatttagaatagttagctcctcttgttgcattgatccctctaacattatgtaatgcccttctttgtctcttttgaccaacaaacacaaccaacaggttagtttcaagtctgctttaccagagattaggattgcaaccccagcttttttttttttctttccatttgcttggtaaatattactctgtctctttattttgagcctatgtgtgtctttgcatgtgagatgggtcccctgaatacagcacactgatggatcttgactctttatccattttgccagtctgtgtcttttaactggggcatttagctcgtttacatttaaggttaatattgttatgtgtgaatatgattctgtcaatttgatgctagctggttattttgcccatttgttgcagtttcttcatagtgtcaatggtctttacaatttgttgtttttgcagtgactggtacctgttgtttctttctatgtttagtgcttccttcaggaggtcttgtaaggcaggcctggtggtgacagaatctctcagcatttgcttgtctgtaaaggattttttttctccttcacttatgaagcttagtttgggtggatatgaaattctgggtttaaaattcttttctttaaaaatgttgaatactggcccccactctcttctggcttctagggtttctgcagagagatctgctgttagtctgatgggcttccctttgtgggtaacccgacctttctctctggcttcccttaacattttttcctttgtttcaaccttggtgaatctgatgattatatgtcttggggttgctcttctcaaggagtatctttgaggtgttctctgtatttcccgaatttgaatgttggtctgtgttgctaggctagtgaagttctcctggataatatcctgaagagtgttttccctgttggttccattctacccatcactttcaggtacaccaatgaaacgtaggtttggtcttttcacatagtcccatatttcttggaggctttgtttgttcctctttattcttttttctctaatcttgtcttcacgctttatttcattaatttgatcttcaatctctgatatactttcttctgcttggtcgattccactattgattcttgtgtatgcttcacgaagttcttgtgccatggtttttatccccatcaggtcatttatgttcttctctaaactggttattctagttagcaattcctctaacctttttcaatgttcttagcttccttgcattgtgttagaacatgctcctttagctcagaggagtttgttattacccaccttccgaagcctaattctgtctgttcatcaaactcattctccatctggttttgttcccttgctgatgaggagttgtgatcctttagaggagaagaggcattctggttttcatctttgtagatttatttacctttggtttttatgttagtgaccttagaatggggtctctgagtggatgtgttattcctttatgtttgttagttttccttctaacagtcgggcccctctgctgcaggtctgctggaatttgctggaggtccactccagaccctgtttgcctgggtatcaccagcggaggctgaagaacggcaacgattgctgcctgttctttcctctggaagttttctcccagaggggcacctgccagatgccagccagagctctcctgtatgaggagtctgttggcccctactgagaggtatctcccactcaggaaacatgggggtcagggactcacttgaggaggcaatctgtcccttagcagagcttgaatgctgtgctgggaggtccactgctctcttcagagctgtcacacagtgacctttaagtctgccgaagctgtgtccaccactgccccttcccactggtgctctgtcccagggagataggggttttatctataagtccctgactggggctcctgcctttttttcagagatgccctgcccagagaggagaaatctggcagtctggccacagcaaacttgctgagctgccatgggctctacccattttgaacttccctgaggcttctttacactgtgaggggaaaactgcctactcaagcctcagaaatggcggacgcccctcctcccaccaaactcgagtgtcccagtcggtatcagactgctgctgtgctggcagagagaatttcaagccagtggatcttagtttgctgggatccatggggttggaacccactgagcaagactacttggctccctggcttcagccgctttccaggggagtgaacatttttttctcgctggcccttaaggtatgggggaaaaaaaaaaaaccctgcagctagttcagcgtctgcccaaagggccgcccagttttgtgctggaaacccagggtcctggtggtgtaggcaccgaaggggatctcctggtctgcgggttgtgaagactgtgggaaaagcacagtatttgagttatagtgcacaatgcagtccctaatggcttcccttggctgggagatggagttccccgaccccttgcacttcccagttgaggcgatgccccaccttgctttggctcgtccttcttggtctgcacccactgtccaaccagtcccaatgagatgaactgtgtacctcagttggaaatgcagaaatcacccaccttctgttttgatctcactgtgagctgcagacagagctgttcctatttggccatcttgccagcaatcaagacacaaattttctgatatcaggaatgaaatagaggatattgctgcagaccccacaggcatcaaaagaataataactatgaacaactgtgtacgtgtaaattggacaaattgcatgaaatggaccagtttatccaaacactaccacagttcacccacaatatattagagaatttgaataaccctatgtcactatttaggaaattgaatttgtaatttaacagtttccaaaaattgaatcttcaggcccagatgttacaatggagtaaaaatgttaaaaattttggagaatattccacatgtttaaggagaatcttccagtcactgcaatctgtttctcaggaagccacagtcctagcagaagggaccacaacaaggtaacaccctgtgggacaaaagaatctgaatagcaggtcttctctcccaggtctctctgctgataggatcagaggtgtccatctgacctgaatagccagaacactgggacaaggttgaggctgtgagttggatagctttcctgcttgcctggcaggggaattgaggtagcttccactcttcacccttataaaacctcagcacatctcattgagagctcctccaacacccttatcaagtctggggtcttagcctaccattatgtatgacatctcacctgccttagctacaactggtgcctatacaggaatatgtttcctcttgacctgaagcctgaatcatcaactcagcaagtataaaaatgggggaaaattaaataaacaaataaagtgtacaccatgagagaaggaaataagctttaagagatccctgccattctgaccccataagaaacagtgaacttgcccacacaccaagaacttaactactaaaaccatcatctgggaaagccagttggaaaagattctctataaataaggaactcatacagagttttcatcctaaaatcaccaagaatcaaactaggctaaaataaacattggcgtatgatccttaagaaagaaaaaaagaagttaaaaaaaaccacagtccaataaaaaataaattcaagaacaatttgattagtctacccaaatgagaaggaagcaggaaagtaattctggtaatatgacaagacagggttctaaatcatcctgaaaagatcctactagctccccagcattggatccaaaccaagaagaaatctctgaagtgccagataaagaattcataaggttgattagtaagctactcaagaagacaacagagaaaggtgaaaaccaacttaaattttaaaaaatcaggatataattaaaattttttcagaggaatagatatcataaaggaaaaaacaatgagagctactggaaatgaaagacacacttagggaaatacaaaatacagtggaaaattttaacaataagctagaacaagtagaagaaagaatttcagagcttgaagacaagactttcgaaataacccaaacagacaaatacaaataaaaaagaatgaaataaatgaacaaagtctccaaggaatatgggattatgtaaaatgaccaaacctaagaataagtggtgattctaagaaagaacagaaatctaaaagtttggaaaacttatttgagggaataattgaggaaaacttccctggccttgctagaggtctagacatccaaactgaagaagtcaaaagaactcctgggaaattcattccaaaacaatcatcattaaggcacagggtcaccaggttatctaaagtcaagattaaaaaaaacataattttaagagctgtgagataaaagataacctataaagcaaaacctatcagattaacagcagatttctcagcagaagctttacaagtcagaagggattggagtcttacctttcacctcctgaaacaaaataatgtcaccctaaaattttctatctagcaaaactaagcttcataaatgaaaggaagataaagtcttcttcaaaaacaaatcctgacagaatttgccacccccaaacaagcactacaataaatgctaaaaggagttctaaatgttgaaagaaaaccttgatatacaccaaaatataaccttcttaaagcataaatctcacagggcctataaaacagtaacacaatgaaaaaaatccaaaacatataggcaacaactacatgataagtacaacagtacctcacatttcaatactaacatcgaatgtaaatgggcctcaacgctacacttaaaagatacataatagcagaatgaattaaataaaccaccaaccaagtatgtgttgttttcaagagactcacctaatgcataaggactcatgtaagcttaaggtaaaggggtggtaaaaaatattccacacaaatggaaaccaaaagcaagcaggagtagctattcttatatcagacaaaacagactttaaagcaacaacagtttaaaaaaaaaagacaagcaaggacattgtataatgataaaaggattagtccaacaggaaaatatcaccatcctaaattatatgcacctaacactggagcacctaaatttataaaacaattggtactagacataagaaatgagataaacaacaacacaataatattggaggacttcaatactatacttacagcactagacagatcatcaagacagaaagtcaacaaagaaacagtggacttaaactataccctagaacaaacagaattaacatatatttacaaaacattatttccaacaactacagaatatgcattctttttttcagtgtatggaacattctccaagatagaccatatcataggtcacacaacaagtttctataaatttaagaaaatcaaaattatatcaagcattttctcagaccacaggggaataaaattggaaatcaacttcaaaaagaaccctcaaaactatagaaatacatggaaagtaagtaatctgctcttgaatgagctttgggtcaacaatgaaatcaagatagaaatttaaaaattatttgaaatgaatgataatagttacacagcttacaaaaacctgtgggatacagcaaaagtggtgctaagacaaaagttcatggtgttaaatgcatcaatcaaaaagtctgaaagagcacaaatggacaacccaatgtcacacctcaaggaacaagggaaacaagaacaaactaaactcaaacccagcagaagaaaagaaataacaagatcagagcaaaactcaatgaaactggaacaaacaaaaacaatgcaaaagataaatgaaacaaaaagctgattctctgaaaagataagcaaaattgatagactgttagtgagattaaccaagaaaagatccaaatgaactcaatcagaaatgagactggagatattacaactgataccatggaaatacaaaagataattgaagtgtactatgaacaccttttcacacacaaactagaatgtgtagaggatgtggacaagttcctggaaatatacaagcctcctagattaaatcaggaagaaacagaaaccctgaacagaccaataacaaaaagcaagattgaaactgtaattttaaaattgccaacaaaataagttcagaaccaggtggattcacagctgaattctatcagacattcaaataagaattggtaccaatcctactgaaaccattccaaaagacagtaaaagaagaaatcctcattaaatcattctatgaagccagtgtcaccccaatacccaaaccaagaaagaacacaaccaaaaacgctacagaccaataccctgatgaacatagattcaaaaatcctcagcaaaatactagctacccaaatccaacagcatattaaaaagataatacaccatgatcaagtcagttttatcatagggatgcaggtatagtttaacatacacaagtcaataaatgtgatacatcacataaacagaatcaaaataaaaaatcatatgattagctcaatagatgcagaaaaagcatctgataaaattatcccttttttataaaaacactcacaaaaactggcatagaagagacatacctcaagataataaaagccatctatgacatacccacaggcaacattatactgaatggggaaaaattgaaaacattccccgtgagaactggaacaagacaaggatgcctattgtcaccacttctattgaacatagtactggaagtcatagccagtgtaatcagacaagagaaagaagtaaagagcatccaaattggaaaagtggaagtcaaaatgtcactgtttgccaatgatatgatcatatgcctagaataccctaaagaataatccaaaagctccttggcctgataaacgaattcagtaaagtctcaggatacaacatcaatgtacacaaatcagtagcactgctatataccaacaatgactaagctgagaattaaatcaagaagtcaacccattttacaacagccgcaaaaataataataataagatatttagaaataaccaaggaggtgaaagatatctgcaaggaaaactacaaaacactcctaaaaaagatcatagatgacacaaacaaatggcaacatattccatgctcatggaggggtagaatcaatagtatgaaaatgaccatactgcccaaagtaatccacagattcaatgcaattctaatcaaaataccatcatcattctttacagaacaagaaaaaagcaatctaaaattcatatggaaccaaaagagagcccacatggctaaagcaagactaagaaaaaggaacaaatctggaagcatcacatttcccgacatcaaattatactacaaagctataagctaccaaaacagcatggtaatggtataaaaataggcatgaagaccaatgaaagacaatagaaaacccagaaataaggccaaatacttacggccttctgtaagtattgacaaagcatacaaaaacataaagtggggaaaggacaccctattcaataaatggtgctgggaaaactggcaagccacatgtagaagaatgaaactagatcctcacctctcaccttatacaaaaattaactcaaaatggatcaaatacttaaatctaagaactgaaactataaaaatactagaaggtagcattgggaaacttttctggacattggcttaggcaaagaattcatgactaagactccaaaatcaaacgcaactaaaacaaaaataaataaatgggacctaattaaactaaaaatcttctgtacagtgaaattatcagcagagtaaacagacagcctatagagtgggggaaaatatttgcaaactatgcatctgacaaaggactaatacccagaatctacaaggaactcaaacaaataagcaaaaacaacaaaaaaaatcccatcaaaaagtgggcaaaggggcaggtgcagtgactcacgcctgtagtcccacaactttgggagtccaaggaaggcagatcactggaggccaggagtttgagactagcctggccagtatggcgaaatcctgcctctactaaaaagaaaacacaaaaattagctggcacggtggcttatgcttgtggtcccaggtatttgggaggctgaggcatgagaattgcttgagcctgagaggtggaggttgcagtgagccgagatcatgtcactgtacctcagcctgggtgacagagtgagactgtgcttcaaaaaaaaaaaaaagaaggagaaagagaagaaaagaaggagaagaaggagaaggaggaggaggagaaggaggaggaggaagagaagaagaagaaggagaagaagaaggagaagaaaaagaagaagaagagaagaagaaaagaagaagaaaagaagaagaaggagaaggagaagaagaagaggaggaggagggggaggaggaggagaagaagaagaggaggaggaagaagaagaagaagaagaagaagaagaagaagaagaagaagaagaagaaggagaaagcaggcaaaggacatgaataggaaattctcaaaagaagatatagaaatggctaataatcatatgaaaaacccgcttaacatcactatactatactacaagtctgcagtaaccaaaacagcatggtactagtaccaaaacagatatatagaccaatggaacagaacagagtccttggatttaatgccacaaatctacaaccatctgatctttgacaaacctgacaaaaacaagtgatgtggaaaggattccctatttaataaatggtgttgggaaaactggctagccataagcagaaaaattaaacaggacaccttctttacaccttatacaaaaattaactcaagattgattacagacttaaatgtaagacctaaaaccataaaattcctagaagaaaacctaggcaataccattcaggacataggcatgggcaaagacttcatgactaaaacaccaaaagaaatggcaacaaaagccaaaattgacaaatgggatgtaattaaactaaagagcttctgcatagcgaaaaaaactatcatcagagtgaacaggcaaactacagaaaaaatttttgcaatctatccatctgacaaaagtctaatatccagaatctacaaggaacttaaacaaatttacaagaataaaagaaagaaccccatcaaaaagtgggtgaaggatatgaacagacacttctcaaaagaagacacttaagtggccgtcaaacatatgaaaaaagctcatcatcactggtcattagagaaatccaaatcgaaaccaaaatgagatactatctcacaccagttagaatggtgatcattaaaaagtctgtaaacaacagatgctgattatgtggagaaataggaatgtgtttacactgttggtggaagtgtaaattagttcaaccattgtggaagacagtgtggtgattcctcaaggatctagaaccagaaataccatttgacccagcaattccattactggatatatacccaaaggattataaatcattgtactataaagacacatgcacacatatgtttattgcaacacagttcacaatagcaaagacttggaaccaacccaaatgcccatcagtaatagactggataaagaaaacgtggcacttatacaccttggaatactatgcagccataaaaatggatgagtttatgtcctttgcagggacatggatgaagctggaaaccaccattgtcagcaaactaacacaggaacagaaaactaaacactacatgttctcactcataagtggtagttgaacaaaaagaacacatggacacagggaggggaacatcacacactggggcctgtcggggtggggggctagggtagggatagcattaggagaaatacctaatgtagataacgggttgatcggtgcagcaaaccaccatggcatatgtatacctatgtaacaaacctgcatgttctgcacatgtgtcccagaacttaaagtataataataaaaaaaagaaagaaaaatttgataaattggacttttaaaaaaaatttaaatactcttccaaagaccctttcaaggtgacaaaaaggcaagctactgcgtgggagaaaatattttcagccacatgtctgcggaaatactcaaatctagaatatataaagaaatattaaaactcaacagtgagaaaacaaatatggttgtccctcagtgtatataggggattggtcctaggcctctacctgtaccaaaatttgcacatatccatactcaatcttacagtcagccctgggcatacaaaaagtcagccctccatatatgcaggtattacatcctgtgaatactgtatttttgatccatattttgttgaaaaaaatccatgtacaagtgaatctatgcagttcaaacccatgttcttcaagggtcaatggtaatccagttagaaaatgaaccaaagacatgagcagacatttcatagaaaaggatatatggatggcaaataagtatgtggaaaggtgttcaacatcaatgggcattagggaaatgcaaattaagatcactttgaagtatcactacatatttattatgatagttaaaataaaatagttggccaggtggagggactggatcactcatattttgctggtgggcatgtgaaatgatacactctggaacagttgggcagtttattgaaaagctaaatgtgcaattatcatataacccagcaattgtactcttggatgaaaacttatggttaccataaaacttgtacatggatattcatagtggctttattcataattaccaaaaattagagtgagtctagatgtcctttaatagacattgtttgagattgccattgcatggtggtaataaagagtagaccaactttagttggttttatttttatattttaattttctacacacagcatacccccttattgtcttcaccccagggtagactgttgttactgccctgcacttgatgcaccactattgaaagatattaatggcaccatcaaagcctgcagtgacattgttgtccctccactaaagcaaggaccaggcttccctcagagaaactgactttacaaatagtaaatagaggctctttctgaaacctatcttcgtaaacatatttccctctcctaacaaggagttttggcccttctgccctttagtcagggtcttggtccttggtatttcttgccacagcaggcaatagacaaaggctcccaaagaccttggatggaggcagacattgtggctatgtaccttgtacccaaaggattaagctgccatcttgctggtggcagcccttcaccccagagagaggaaatgccactggtgctttgaggaaggctttgtgcctttgattttccatgtcaagtcagcacttaactgtgaccctggacacatgaggtgaaaaatctttggtttattttggcattaatgtctcttgcccaataacatgggtttctgtaaacagaagtaggcatggagggaggagggaggattacataaaagggactcatccaagcagggctagctgcactatgctgatttctattaaatggcaatgggagataccctcttacccctgatttcagttagtggtagttactttcatcttaatcgaattaattacaaattgggaaggcttgggtcagcttcataaaatgctgttatttatgttgacatttttatgtggctttagctaatatatgttttaattttagattcagggactacatgtgtacatttgttatatgaatatgttgcataatattgaggtttgggcttctagtgtacccatcacccaaatagtgaacattgtacccaataggtaatttttcaacctttattcccttcccattctcccactaatgattattattttaatctcagtaaccagcaatatacctggccactcatgcatgtgcacacacacaaaccctatttgctgtagtggaaaccactctggtgaaggagatatccatggtggaagagttgggcagagtggagaaagaaggaccctatcatttgttgactgcccaccatgtgccacatactctgcttggtgactttacatgtcttagctcatttaatcctcaccacataatgtgtaaagtagatgctattattattcctgtgttactgatgaggaagccaaggctgagggaagtgaagtgagatgatcagataacgtcactcttccggtgcttaaaattataaaattccccttccactgaggataaaagtcccaactcgtcccattctccaagctatgttttagggcctgtcaacctccctagttttatctaggcccctctccctcttgcagtaggtgctccagccacactgctcttcactcagttcctttaatgtgccatattcttcttctgtggggccattactcatgctattctttttgtctggactgttctcctgtgtgcccacctgcactcaccagcgaactcctattgattcttcaggtctcagcttagatttcacatcctcagttctcagggaagcctcctctgactgtcccctttaccctatagtgtccctcagactatgttaggtccctttgttgtatccttctatcacattctgcatctcctccctaccactaatatgattttacatacaaccttgtgttcaggatcgattttcttcattagatgaaacttgctgtctatatactgtcttgttctctgctctatccctagtacctagtacaatgaatgcctggcacatgataagtattcaataaataattattgactgaatatatattgaaaccctctataattaatacatagtaagtgctcaataaatatagttaaaatacagttgttattattgtccaaaagcaaatagttaatcagaggcagaaccaggatttataattgaagtctgagtctaaagcgcatgcttcttttatgatatgactttgtctgcagaaataggttcttggcccagcactgccctaactggttgtatgacacttagggtgagacactatactactctgaatcttagttttcccatcggtaaaatggttacaggagcaggcaaagttcaggtttatcttcacgtaacctagaaaaggaggagaatagaagtctagatagatggggatataagcaaataagtaattaaccaatacaaatcagtatcttccctctgcaagacagttgatgagctataacaagaacccttgatgtttttatgcccttcagcctggtaaccctgttcaaaggcaatatagagtagtggatggtatggatggtatgtaggctttggtgttagagagccctggttcaaatcccaacatccaatttactagctctgtggtactgggcaagttaccaccctgaacctcactcaattcccttctctacaaatgggataacacccaccttttaacccatttctaaggttacaaaaaaaaaaaaaatacaataacatgaaaagatgttttcttagtatagaaagagaaacttctcccaccatcctacccacctaacagttctttctgtagttctgtgccattgaaggctacctcttgaggcaagaggcacaggcaatgtcaagaaaagagagactgaagacaagcaggctgatggcagaagccagagtccagtgtgtggagttggatcacccataggatagactggggcagaggggaagatcagctactgagggagaagaaaggagactacaaatctgagtaaggggataatggctaggcagatcctgagaagcatggtagggagccagtgggaagacaacaacatgccttagagggtacccctttcaaaactttgtagccctttcccagaggcaggcttcaaattatgttattaaaggcccttgaaactgtgtttcttccaaatctttttcttatttagtcacatccatgtatgttttgaaattgtaatcttagtgtgtacactttttcagcgagtatcttatcttcaacattttctatgtcacaagtcttcagtggctgtcaaatatcctaattttgctgaaagcccagaaagtacacctctgtgtattaactttttgcttccttgaattacctccttaaaatatattcccaagtataggattcctgagccacacggtatacaattgggatttaatgaccaaaaccaggtttttctttttctaagaaagaaattacccataatatcctttccccttccttttctggaactgataaacacaccctctagagttgtgctgtctaatatgacagccagtagccacacgtggctgtttaaattttaagtttgattaaataaaattcaaaactcagttcctcagtagcactggccacatcacaagtgctcagtagccatatgtgcatagtggctattatactggacagcacagatacaaaacatttccatcactgtagtaagtttattggacagtgcttacttagagtttctcaagagatcatttttggtttcttgggtgggagttctttgtgttcaggactttcctgggcattgagaggctatttagcatctctggcccatgtccactaaatgccagtaacacatttccttgagtcaatctaacagccaaaacactccatatttgcaaatgccccataagggaacaaaattaaccccattcgagacccactgagcttttagagggaaacatctcctaactttttcttgagacaaggtcttgctctgtcacctaggttggagtgcagtagtgcaatcatagcttaagcaatcctcctgccttatcctcctgagtagttgagactactggcatgtaccaccatgtgtggctaattctttctttctttctttctttttctttttctttttcttttttttttcttttttctttttcttttttttttttgtagatataaggtctcactatgttgcccatgctggtttcaaactcctgggctcaagtgatcctcctgcctctgtcttccaaattgctgagattactggcatgagccattgcacctggccttcttttttgagatggcctcaggttggctctgcctggagagggggaagcttgtaaagatggcttagaaaaaaagtcctggctccatttctattttctcccttcttttgctggcctgtttcctgctttttgcaaattgcaggaacaagaccctgcagatggagaagatcaaggctcgtttgaaggctgagtttgaggcacttgagtcagaggaaaggcacctgaaggaatacaagcaggagatggaccttctgctacaggagaagatggcccatgtggaggaactccgactgatccacgctgacatcaatgtggtacgtggctgcctggagcctatctctaaagcctttgagaaagaggtagtggtgaatgatagggcctttccttgagatgtggcttaggcctagctcggggagcaggcatcagtgcaggctgtggtagagcagaagaattcaggagttctgagatccagccctggctctgtcactaactgactatatatcactggacaagtcccttctctctgggcctcattttccctctctgcactataagggggactcagtaccctctaaatgtactgatttgatgtgctctcattctgggattctgggagttgagagctagccttggggaaaagcagagcaggcagctgcctctggaatgtagtttaaagcactccaagctttcagtcagaccaaacaaatcatttctgcctgctaccaaagtggagcttcctcattgatatatcctttggaaactcttggaacacagaatatgaactgtctgctaaggtggtaagctcccctctttggaattattcaagcagcatcttaatggacacttgtatgagctactgtactgatgattccttcacaaggaaggaggttggcagtgctgaccagtaaggtcttttcaaacccttatcacccataaccatgaagaatatatttttaaaatttactttcaaaggaactaagtttatatttctggaaaactcatttctgtggcaatactcattttctgatgttgtcagacctaggatcataaaggaaatatgaatgaggtttggacagtaagcaattgggattttctgtgttagagatcgcagaattctagatctcataaagtgttgacagtttggctgccagctaaccaatgatacagggccagttaaatgaggaagatatttgccagaagggctaagaatataagccagtggatctcaaacttgagcatgcatcaaagccactttgagagcctaagacacatattgctagactccacccctgattttctgattttgtatgtctgaggtgaacctaagaatatgcatttctgagttcccaggtgatgctgatgctgctgatcccttggccacattttgagaatcactgatctaggagaaaagactgctggcctgggaggcggaagccctaagtctttatgcaggatttgatactaagaagtatttccccaggaaagtccctttttctctttgagcctcagttttctataaaatgggagtaaggtggactaaatgagctctgaaggacattccagctctaagatactatatttgaacaataccatttatttagcagtaaatattaatttagcccatttactgagtgctttatatgaatcctatcattacatcttcaccaagattgcatgagttaagcactagaatatcaccattataccgatgaagaaactgagacttgaccagagttacatggagagggcatgggagatcaaggacttgaatatagactgaacaagttctggagcttgtgctattattcactcagctatagatcctctctgagaaccttaggatcttttctctgtgcctatcccactctatgttccagatggaaaacactatcaaacaatctgagaatgacctaaacaagctgctagagtctacaaggaggctgcatgatgagtataagccactgaaagaacatgtggatgccctgcgcatgactctgggcctgcagaggctccctgacttgtgtgaagaagaggagaagctttccttggagtaagctacctgcccccagtccctacaacataccctccctccgacccacatacatacttacatacctacacacacacgggcaggtatacatacacaaagcctagcctgaaagtcagagtgcctagttttagtcccaggcctttcagtggcttactcactgtgtgatcttgggcaagtctctgtgccagcttgttaaaacagaaggaggattattaaactggatgaattactagatgaattagaacaactactaggtggctttttaaattctttgtgtgatattgacaatacaagactatgtctataactcttaagagatcatttcccaagtcagggtctagaaggcgatatctagaaacctctaaaaacaaaaaagactgagctttcctggtcttcaggaagtggcctgggacttacttcatctcctggctcagagttaagaactaggcttgccttgcagagagacagaatttgacctggtagaggaaatcatttcctaaaggtagagcaaggtgtctgtggagtttgtgagcttcctactcttagagatatgtcaccagaggccttaggacacttaataggaatactcaaaagagcatgagatagcagataggactgaataccctttaaggatcttgctagccctaagatttcttggtcttcttggcctatcagagctaaggacaaagaggattacccttctcatcagacattgggcctagtacccagggacaatagccttgtgcttgggaaggtgtggggaccttctagaatgagccacagctcaacccttggttgtatggcatggagtctttaagaggagcaaggttctcattgctttcagaatgatctagccagtgtctctcatctccaaagttactttgagaagcagaaagcagaatggcagacagaacctcaggagccccccatccctgagtccctggccgctgcagccgctgccgcccaacagctccaagtggctaggaagcaggatactcggcagacggccaccttcaggcagcagcccccacctatgaaggtaagtgagctgggtaatggttgtggaggaagcaaagtatcctcccatggaagggccgtggaaggctagttctgggtctttggctttatttatgctgggccttcttttaatggcctttgcttgtgacacagtggaaggggtgacatgggtgtgctgtgttggacacacacagcacaggttttgttgccccatgttcccagaggtgttagaatgcagggagattttcaggccctgctagagtgcaattctaaaagttagaaatgactcttacacaaagatgtaatgagcatgtatcataaatgagggaaccagcaggattataaagctggttccaggagcatttggaacaaatatctatatagtcaagaaaggagaggaaggctgaaacaaatttgcaaagttagatgcaaaactggtttacatcccacaggacaataaaactgtaactttatagttactttttcttccaaacagaagtaatttgcatctctactgggcaaaagccatttgcagcttatcagtgtaacatcacagagcctgggtcctaatcaattggtaaatagtcaaacaaagagacattcttctagagcaggggtcatcaaattacagcctacaggtcaaatctaatctgttccctgttttcgttaaagttttattggcccacatgcatgtctgtgtttgcaagctattgcaaacaacatgcatgcaagctattgtctatcacttctttcatgcaaaacagaattgagtagttgcagcaagtttatatgatgtaaaaagtctaaagtatttgctgtcctggcctttacagaaaatgtttgttgacccctgttctagaaaattaaatagtccttaagtgggcctgttagacaatgcttcattataatgacgaaaagatgtgtagttctcattttgccttactttctagttttgtatactttttctcaacaccattctctgaactgggttatgtccttccttcccatcttccatggcatccaagaatacttgagtctactcactgattattgctctcttctgatgggaaatcactttgctttctgggcccctggggaatcagaagtctaagttgttgcctggaagaatctgactactaactttctttttcctgtgtccctcaccaggcctgcttgtcatgtcaccagcaaattcaccggaatgcacctatatgccctctttgcaaggccaagagtcggtcccggaaccccaaaaagccgaaacggaagcaggatgaataaagaaagggagagcacatgaagctttgctaattataacccctcaccttgaccagagtcattgatgtcctgatgtgaaacaacccttgcccaaccccacgaagtctcctatttaatgtgatggaagcacaacccctctctcactttgctcctatttctttctgctcttgggatttctggtttaggaagagatgtggttcaggtgctaaacagtgtgtctgatgatcccttctctcccactcacatttcaacccctgcccttgtttggagctaagggaagggcaaaaggctcagatatgattctctatctcttgtgcctgaggcctggagcctaaggagctgtagggtctgaggggcaggggaggcccatatcttgtttcaggtaaaggacccagtatttcccctccttgtacttttgccttaggttctcaagggacaatagtcttcatgttggattctccaacaggctgggtgcatgtatccccctactcctaccctcatctcatccttaaggcccagaggtagcttggacaagccctccttttcataatcatttgggaggcatggctgtaattctttagctttctccacttctgtctcccacatatactaaaattcttaggtactaggctgtgtgtcttgggatcttaagatcaatgaacctttccccaatatctagtctttgcaaattctagtagaagatttccacagtgaaatcagtgagccagaccaactctacatctcctgcctaacctactgcctaagtcattagggctgagggctcggctgtaggggcttccttaggctgagagtgcccccaggctgacatctgtgttggcttttgttcagaaccattactctggcacatgctcaatggtatattgcagggaggagaggagtagatttagatttgagtaaatgccaatcactttacacatgaaggtgggtgggactttccttccattcatcccttgctctcttggatctgaactcttctggagcctcagctcaggatagctgctggccactcctgtcctgtggattgtgcaggtggcctttcctcccaaaagaaaaggcatcaggctccccaagccccacagctctcctttccaccaaagccaggtttcctggtaaggtcactcgaagataagggatggggatgggggctgactgacaaaaaattttagccccaggtctcagtacctggctggggagggggatatttttccttccttaagtagttttacattgccacagtgtgtatgtgttcactatataaaatgttcctctgctcttt

SEQ ID NO: 4652 - DNA, 60078 bp, human
attgtgtctattgtatcccttggctggtgtatttgtacatctctcgggacgtgaaattgacagtgaaaagtatggcagatgagcaagaaatcatgtgcaaattggaaagcattaaagagatcaggtaagtggcacgttgtccccctccccgcccctctccaacccttcgttgcgggagagggctaattatctattgttgggctgtttgtctagaggagctggaaaggggcccattcaccacagacttgccggagaggtgaggatgggaggggcgctgaggagagttgagagagagagagacctcttgccagatgtggctgagaaagcaaagatgaagaaacacgggtttggtaccaagacagttttattcttctcgaggtggaggtcagggctctgcattcatggacacgttttttaaaagtacttgtgtgccccaaggtgtctttggctccttgctctttaggagtcgggatttttttccagtctcttgttcaacttcagaacctggagttcgggaaaggcttttgagagccaagtctagcgcatcggggctggtggctgctgccaggggctgccaactgggggttgcagaggaatctcagcgggcggagctgggagaatggcgcgcgctcgttttcctttcactcactcgccactttcttccttcctatcccgcgcttgggagggggatgggagcaatggggactggggacgcggtcgctgcgctgatggtgggatcgcgacagctgctctgaggagctggaggtgacaggcgggctggcaaagtgggagttgccgaagtggagtccgctacacggttgctcctggagcagcttttggcaaagcgatgatattgtccttgctcagaacacaatagcgccaggcgggctgtgtgggctggcacaaggtctttcttcacctcgccttctcagcgtgagcccctgctttggcttttgctctcactctgagagtggcctgggtcaagctctctccctggagtgttttctgagaacccaaggtggaagatgtcaagtgtgtttctttaagaaataagactttgatcatgagatttaacccttagagtgctggatgagacctacacatggtgattagtggtggtaggtaaagcaccttggtttcttcttcttcttgaggggttgcatctctctttctacaggagaggtaaaggaagggaactatcatttattgagtcccttcccgcccctgtgtgccaggccctttgacctacttttgctcattcagcaagagtcctgtgagcttcctactcctcctttacagctggggaaatagaggcccagagaatttgagtgattttcccacagccacgcagcttgaaattgccacattttgttggtctgcctgcaaaggtattccttttcccactatgtcccaggtaaagtctggaaaggagaagggaatatgttgcaattttttttttttttttttttttttttggcaaaagcatcagaagctagctagaaagtgagacaccttagtacagtagaatgccagctgtcataacgatgcagctagtcagaagcttaggcttgcaaatggagagcctagacttccactctcaccaagcttcaaaggaaccaccaccccatgcccagagaaggaccagttgtgagcaaggactttaatccccagtgaaaatagacctctcccagtgaagaccatatggagaaccatgacttctacccttaccagtggtaactaggagtttctacctcaaccagctaggatggaatcagcataggcccagagagaaggccaaactttcacctctaaacagcagtaacaaacagcccttctccaaactggatgtcaagagacagtggagaaactggacttctactgtccctcttccatccaagagagtggtagaggactgctaaaacaaaagatttaaataagatccagagtatccaacttttaatcaaaaatcactttccatactaagatatccacttgaatgagaagagaaaataaacagatgccaatactgagataacacccatgttagaattatctgataaggatcttaaagcacctgtcctaaaaacatttcagtgagcagttacaatacacttgaaacaaatgataatgtagaaaatctcagaaaatgaatagaaagtctcaacaaagaaatataaaacataaagaagaacaaagtgacatttttagaactgaaaaatacagtaacataaaaaccccaaaaaactcaatggataggttcaacagtaaggtggagaagagagagggaaaaaatagcttacaaatataaaacaatagaaatcactgtggcactataacaaaagctttaacatttatgccaacaaattcccaggagaaagagggcaggattggaaaagtattgggaaaaataatgactaaaatcttcccaaattgtgcaaaagacataaacatttagattcaagaagaggagcaaacaccaacataattgacacaaagaaacacactccaaaacacattgtaatcaaccttctgaaaatgaaagaaaaaggaaacttcttcaaaacagctgaagagaaacaaaagctacaaaggaaaaaaaaaattagaatgacagatttatcatcagaaactgacgatgccctagcattttgtaagtgctgaaggaaaagaagtgacaacccataaatctatgtccaataataatatccttcagtattgaatgggtaatcaagacattctccaatgaagaaatactaaggaatttagatataccctaaaaaaagatgatagtaagctctgaaaacagaaaagaaacaataaacagtaagcaaaagcatggttaatgcagtagactttctctttcctcttgaaatttcttgtattttgataattgaagctaaatttatactgttatctagtgtggtctcagcatatgtagaggaaatatttaacacatttatattgtaaactggggaatgtaaaggggattgtaaatgtaaagagatgtaaaggggaggacatgcttctacacttcattcaagcatgtaaagtggtaatgtcagaagactattaaataaattatgtatacataatatattactgagagaaaacactgaaaatgctatacaaagaaatgtactcaaaacattataaataaatcaatatgaatttttaaaaaatgctccagtcacccacaggcaggcagggcaaagaaaatggagaaactaaaattacggagaatgaacagaaaaaaaaataaaaaggcagacttagccttcatgtatcaataattatgttcacaacaaatagtctaaataccttgcaaacattaatcaaaataaagcaggaatggccatcttaatatcaaataaaacagacttcagagcaaagaaaattcctagagatggatattacataatgaaaaatagtcaatctaccaagaagacataacaattccaaatgtgtgtgttccaaaagtgacttaaattaaactgcttttgacaattttacagtaatatacaaaggttaagccacttggtttaagaatttaaaatggagaaagtactataaatatatacttgatgttcacatatggacagataaacatgtatgagagatagaaataaggaaggagcaaagggtcaaagaaactgaagaaaggaactaacatttgtcaagcaccttttaatttaaaagctcctggctcatttactctttagtcttcccaaaggaaatctgggataggaattattacccccactttacggataaggacattgaggatcagacagattaggcaactttcccatggttacacagctaggaaagaaaaaataatatatcctcctattcacatggcatgcacatttcaatgttattaactgcccttacaaatgctgattatctgattaaccattattcacagttcttcaactgctataatcctaaatctcctgaagtataagcatagcagcatatttctgttaaagaaataatgtttgctggacagaagcaggaatgatgacagcagcatcatctaatgacctattgaagtcaagctaagagccttacacacatcaagacacgagcccagaaatatatgcattcatactcagcactcacaccaatggcagaatttgcagtgggaaaaacatcagaagcagattctcccaccacagaccattttctgcttctaactctgaacacacgcctacccctgtctttcctcccaatcccaatcacactcccacattatgttcccaacctcagcctccaaatcctacactaatctattttgcccatgttttccttggacttttaaatggtgatgaaggagcatgtagataagtggaagaagagagacaagaatggaacaaaagaagggagatagaaaagagggaaagggaggatagcagtaataaaacagagacagtgagtacaggcaccattaaatggaccagagccctacaccagctccccaagtacaaaacaatatttccttaaaatgcacatgccatccattcatgtgtattgcgtacactcacaccccgatgtacacatatccatacacaaagagctttcctcacttgaaaaaaagaaaaaccattttggaaggagatgttgagttaagtaggtactcttaaatgaatgtttctcgactgggtccttcttttctttttttctttctacacactcttttgagtaaattcctgtacttccatggcttcaaatattatcctccaaatctccaacctctataccccacccacattcatgctttagcccatacatatgacagcctactgggcttgtccgcctggaagtttcacagataaatctcagctttatatctacgtctcttcctacagcaatcaagctcctccccttaaacctttggtttaataccaccattctctgcacagttacctcagatggcaatctgaaagtcaatgttgactcccctttctctttaatgactcacctgcaatcacttagttaattctatttctatcctgaatatcttacccaatacctgccccactctccacctcccagttcactgctccatttcaggccttcattatgaattggcatggatatttgtaatgcagtatccatttccatctgaagaattacttccctgtctacagtctctcctctgtctgcaatggcatccacattgccttgagaactaccttcctaaagcatggttgttattttatttctcaaacatcttcactaacttttcattgtgtatgacaatctttttgaaaaatacaggctgcgtcccattattagctcataaaaagaatttagttggtcactagtagcatttttaaaaaaccttttttaaaataaaaaggaaattatcaacatacattgcatatgaagtagtaggtatactttggagaaggttttgtttagttttaaatatgtgtatgtgtgtattgtgtcatgaggtgaaattcatttctcacttacgtcatttcttactgtgtctctgttgaacacacatttacctatcggtgtttccatggcattcatgctgcctccccggaaatctgtcccatacccactattctgaccttatctgctactgctttttattaatcctatcctttagccatatagaagttcttactgttttatatatttccgttccaccagacctttgcctctgcagattcctcgttctagaatgccactctcccattccaagcatctaaatcctactcatttttcaaggaagacccatatgaaatgcctcgtcttctccaaaaccttctcgagttccccagtcaaaatgaattacaataccccaaccacagactccacagggagatttattatagcactcaagttatcccatctaatgatggaattttgaattgatatcctcccttccttcctcccttccttccttccttcccccctccctccctccctcccttcctctcttcctctcttcctcccttcttcctttccttccgccattggtgtggcagtcttggtaagctcctctgttacctggcttggggattgactcagaaccagtgcttactcaagaccaaggcacaggacaactggaacctctgggacttgtggatgggcaaattaagccaaacaatgctggccacaggagagactgaaaaggtgttggcatttggtattgagatgtaagaaagttatcagaatgaactgttataagaaatctactttgctgacagtagctttgtttccagttgagcaaataaatattacatggaagaatgcttagtacttaggcaatattctcaccagactggagtaagcaggaaaaactagctcctttgtgttcattcagtgacatttactgagcataaatctgggccataatcagggctgggctatcctttggtggcccatcacttaggataaataagacccatcagaaggatcttctaatcaaagtcaatagctctgatctctcccttgagttccagactcacatatctaactgcccatttaacttacacccttgcatgtatcactggcatctcaaacaggccctcaactccagccccacccctaaacatttttatttcccagtcttccccatctcagtaaatgcctcactatgctgaaatctggaagccattctttattcctctttttatgtgaccctctccatccacaccattagcatagtggttattatacttgaccatgcaggaggttacacctaaagggcttttaaatcattgattgctgagccccatttccagggtctctgattcagtagatatggagtggggcctgagaatttacatttctaacaagttcccaggcaatgctgctgctggtggtgcagggactacatgtggagaacaactgcattagtaagacctggccagttatacctatacaatataatctggaattgtccacttctcatcatcccctcaacttattaacaaataccagcacttttccatcaatctccagtaaacagtatcttttcacctaattttcccatcttcaaggcctacaggtcccagctgtcctaccctgctttttgagtgtgcattggggctgagtcacctctgaaactgggtgacagatgagcctgccaagtttgtcccagcaatggatgatccatggccctagaacttctccttctttgcacctgtcctcttccatatttgccagaaagaaatcattgaaaagaaggtatccagctgaatgttttatagtcttggctcaggagactgtctggagaacctgtggcctagcagtctgctatgatttgaatgtaccccaaatttcatgtgttgaaacataatcctaccattttgatggtattaagaggagagacctttcgggaagtaattaagtcatgaagcctctgccattatgaatggattagtgccttagaaaatgacttggaatgagtttagacccttttttgtacttctgtgattccaccatatgaagacacaacattcactccctcttgaaaatgcagcaacaaggtgccatcttggaaggagagaccaagcccctcaccagacaccaaatctgttggcacattgatcttaaacttcctagccttcggacctgggagaaataaatttttgttctttacaaattacccagtctgtggtattgtgttatagaagcacaaacagactaggacaggagctcaggaatactggtccaaaagttacctaagactgtcatcctggtgactgtagaaaccctaaagtaccctgaaaaccctgtggtttccctgtggttcacgagtcatactagctgtgctttagcctcttggaaaaatctcattaggaaattttatatataaaattgcatctttaatgatctggatggcttcctcacttgtagggccaaacattccacagatttcatctcattgaagcatccaacaattccatgcaaggctacactgagtcctactttccaggtagaatttccaaggtgccaagagattccatgaagtgcactatttcaccctgaaaattgatgactgagccaggacaagaattcaccctactggcctggtttttatggctttaaatccatcatatgatgaaagttccttgttgtgatggaaaggtgatcagatttacaacgctggattttccacttcctgaatttgtcttcttgggcaagtcactttacttctctcagcctcaaattcttcatgtgtgaaaataaagtgaaacatacctgccgatatggttcttatgaagattaaattttgatagcataaaaagtgcctaatacagttgctggaacatagtaggcaccacaaatataatagctattgttattaaataaagcctttcttaacagacggttgctttcagttcctgtcacttagatagattcttaataaatatgaaccaaatgaatgaaatccttgccacccatggtaatgtcttttcttctctgaggctactgatgctataatcactcccctggatttactacctaccattcagtagtttctcattccaaatgtaatgattgagccccgcttatggccaaagcagaatgataggtgttgtggaggttaaagagagaaatatggcatagtgccactgtctagaaagccctcgtgtatataattactctgatttcaagttgcttcatgcataaatctgtactttttagaggacccagaggaccatgactatgtgccttgtgctagtccctttcccatcctggacctttatttattcacctctgaaataaagaggatagatttcatgggtgactttgaaataatgttctgacgagcccagggaattctaaggagggttttaaagggccactgtgatagagtcaggtggtggttgaatttgaggacagattaatgactctgggggtcccacttccactttaaccataacagttatgatttgttccattttctatattggatctcaatcagttattttatttgaaggaagggatcttatcattcatccacaagaaccagcgcacttctggataaatggtgcttgcttaatacaatttttaagtctgcttgattgatggaagtttgtaaagagggaatttggtattgtgagtacatctaagcagtgactggcatgacactctttgtagattagagagaggaagggccttttatttagatttaatcttagctcaaacttctcaattgctggacagagaatggaaggctgggaattagatgcaaatcctgaagaccatagtaaaggcaatctacctcaaatgcaacaaattatttatttatttatttattattaagccattaagctccttctcatttctcctggctgccttaatcagcaaactttaaaaaaatccattccctctacgtaagccttttgacaagtcatttatttttctgggaaaacatgagcatgcttagaagttatgtttagtgggagttgtaggtttagatttaattctgggtgcagtaagaggtcattacaggataatttgagttatattttatataccataggaaacatccatttcaagtgtacaattcagcatgttttaataaatttaaagagttgtacaatcatcaccataatattttagaaaatttccatcattccaaaattagctctttgttcagtttcagttgatctttgttcttatccacagccccaggaaacctgtaatatattttctgtctaaatagagtggctttttcttgatgctgcatataaatagttatacaaatgtggccttttgggtctgccttcagtcacttagcttattgtttttgagattcattcacattgtaacatgtaacagtatttcattcctttttgttgacaaataatatcccattgcatggatatcgcacattttgggtgttcactcacaagttgaggagcatttcagttatttccactgttttggctcttatgaataatgctgctctgcacatttgtgtacaagtctttttgtggaaaaatgtttccatttctactgcttagattctcaggagtgagatttctgtttcatattgtaagtatatgtataactttttaagatacaagtgtttttgaaagtggatgtcctagtttccatcccaagagggagtgtatgagggtcccagtttctctacatcctcaacaatacttgttagtgtctgcctcaaaaaggcattatagccatcctagtggtgtgatgtgatagctcacagtagttttaacttgcatattcctaatgaccaatcttgttgagtatctcttcatgagtttatttgccacccatatatcctcttctgtgaagtgtttattcaaaccttttgttcattttttaactgggctgtttgtttactgattgtgagttttgagtgttatttacattttctggaaacacatttttaccagacacttgatttgcaaacatgttctcccagtctgggacttatcttttcattgtcttaacagtgtcttttgaattacaatgtctttttttttttttttttttttgcttctttgtttgaaacaggatatcactccgccacccaagctggagttcagcagtgccatcgtggctcactgaagccttgaattcctgggctccagaagttatcccacttcagcttccccaataactggactacaggcttgtgccaccatgcctggctaatttttcttaaatattttgtagagacagggtctcactatgttacccagggtggtcttgaactcctgggctcaagcgatcctcccgccatggcttcccaaagtgttctgattataggtgtgagacaccgcactgagccagaaacttttaatgttgatgaagaaatccaatttatcagtattttttatggattgtgaattcttgtgccatttaggagaaatgtttgcctaagtcgtattcacaaagattttctcctatattttcttccagaaattttatttttaggtttcacgtttaggtctatgatccattttcacttaatttttttgtatgttgcaaggtacgggttaaggattttcttttgcatttggatgttcagctgtttcactatcatttgtttgaaagacttgtccttacatctgtgggtttatttctgacctatctgcttcattgctttatttgtgtatctttatgccaatagtttgctgatttgattactatatctttttaataattacggaaaccaggtcatgtaggttctccaacttcattattcttcctcagaaataattttgactattctaggcgctttgaatttctatgagttttagattccccttgtcagtttctaccaaaaaccatactgggattttaataggattttgttggatctgtagattagtttgttagatttcaccagtgtgtaatgaaataatgtcctatttctgttctaggatctaacccaagataccacattgcatttttatgattccatttaacttattttatgacttattagctataatgctgttttattatttcagtggctgctttagagtttataatatacatccttaacttatcacaacctaccttcaattgagcgcataatactgcacatataatgtaagaaacatacaacactatatttctccctttctggcctctgtgctattgcattttggtactttttggtttaaactgttgattatatttttaagtaacttaattaaggaagaaaataatcatgatatttttctatgtagttaccattttcagtgctctgtattcctttgttttgatacatttccctctgctatcattttccttttgcttgaaggactccctttaacatttgtggtagtgcaagtttgctgatgatatagcattttacctttccttgtgtgaaaagttctcattttacctttgttttcaaagttgttttccctgggtaaataattctatattggcatggatttcgtccgtactttaaaagtgatacaccactgtcatcttgcttccaacattctttgatactctttgtgtaacatatcctttgtttctgactcctttactggttttgagcaatttgattatgatatagcttggtgtgatgttctttatggattttatgcttggagcttgatgaatctattggatcagtgggcgtgtagctttaatcaaatttgaaagatttttggccatttattcttcaaatatttttatcttcctctttcttcttggtcttcagttacctgtatttttaattcaatttaatttaatttgatttaatttaatttaatttaattttactgtggtaaggtcacagaacttgagatctaccctcaacaaattttatatttataatacagtattgttaactagaagcataatgttgtactgcaaatctcttgcagttatcatcctgcacaactgaaactttatacatattgaatagcagctctacgtttccccctccttcagttcctagcaactgccattctactctctgcttctaagaatttgactattttaaatacctcatatgagtggaatcatgcagtatttctccttctgtgattagcttatttcacttaggattatgtccatgttatctcatattgtaggacttccttcttttttaatgcttaataatattccattgcataaatatactacattgttaattcattcatttaggttgttttcatatcttggctattgtaattaatgccatgataaacacgggagtgcagatatctctttgagatcccgatttcaattcttttggacaaatacctagaagtaggagtgctggatttatatatttttatatatttattatacctgttggccatgtttatgttctttggaataatgtttatggaactcctttgcccagtgttcaatcgggttaatagcttttgtactattggtttgtaggatttcttatattttatacaaattaatccattatcagatatatgatttgcaaatatttcatcctttatgcagtttgccattttactctgtttattgtttcctttgctgtgcagaaacattttaatttgatgtgatcctacttggtcatttttgcttttgttgcctgtgcttttggtgtcatatccattaaatcattgccacaagcaaagtcttgaagtttttctcttatggcttcttgtaggagttttgtagtttcagaagttatgttcagtgtttaatacatttgtagttaatttctgtgtatggtataagataagggtccaatgttatacgtttgcatgtggacatagtttttcccatagcatttattgaaaggactatcatttcttgcattgtgtattcttgtaaactttgtcaaagatcaagtgactgtatgtgggtggattcatttctgggctctctgttttttcccatggcctctatgtctgtttttatggcagtaccatactgttttaattactgcagctttgtaatatattataaaatcaggggataagattgttctggctacttggagtttacatgaatgtaaaaaaaaatgccattgggatttttataaggattatattgaatctgtagattgccttgagtagtatggttaagtcttccaatccatgaacatgtatgtcttcccatatgtttgtgtctaccttaatttctttcatcaatacgttatagtttcatttattgctaagtattttgttctttttggtgctatcataagtgggattgtgtctgaatttccttttcagatagtttgttgatagtgtacagaaacacaactgactttgtatgttgattttgcatcttgtaactttactgaattcatttattaattctaacaatctttttggaattttttgggttttgtacaaataagattttgtcaactgaaaacagcaataatcttaccatttccttctcaattttggtgacttttatttcattttcttgtctaattgctctggttaggtctctaggatctatgttgaatagaaatgtcaagagtggacatccttgtctttttgctgatctttcagtgttttaccattaagtatgacttagctgtgggcttttcatatatggcttttattgtgttgaggtaatttccttctatttttagttgttgagagtttctatcaggaaagggtgttgaattttgtcaaaggctttttctgcatttattgagatgatcatgtgactgttatctttcattctgttgatgtgatatagcacattaattgacttttgcatgctgatctctcctcacatcacagggataaattccactggccgtgttgtatgatacttttaatgtgctgttaaatcagtttgctagtcttttgttgaggatttttacctgtatattcatcagagatagtgtcctctagttttcttttcttgtggaatcttcatctagctttattattagggtagtgctaggctcataaaatgagtttggaagtgtcgcctcttcacttttttggaaaagcttgaaaaggattggcattaactcttctttaagtgtctgtcagaagccaccagtgaagccagctggtcctggccttttctttgttgggaagtttttaattactgtttcaatctccttactaactacaggtctattcagattttctatttatacaggactcagtcttgccagattgtatgcttataggaatttatccattttttatgttatccaatttgttgatatgtgattcttcatagtagtcttatgatcctttctacttctttggcatcagttgtagtgtgtcatctttcatctctgatttcaattagttgattcttttctattttctcttagtctagctaaagatttgtcaattttgtttattttttcaaaaaaaaccctcttagttgcattaaaaaaatttgattctttatttggcttatttctgctctctcttcattatttccttcaaaactgaccaataaatcacatggttaatagaattattagctgatgacattaaaagttattataaatccatttcatatgttcaaaaagcttgaggaaaaactgaccaagtagaggcatggcagaaataaaaaagattcaaataaaaagtctatagatgaaaactattatgtctaagatcaaaaaatttcttagtttagaaaaagagggagaaaagattagtgaacttccagaaatagtaatagaaatcatcccaaacaaaatacatagggttaaagatttttaaaaataaacagtatcagcaaattgtgggacaacttcatttggttaaaaatacagataaccgtcatttaaaaacaaagaagaacattatgtaatgataaaacagtcaattcaccagaaatatgcaacaattataaatatatatacacccaatatcagaacactgaactatataaggaaacattgacaaactgatggtagaaatagacagaaagacaataatagtaagagacttcaataccccacttttaataatggatggaacagtcggacagaaaatcaataaaaaacagcaggcttaagaaacactacagaccaaatggaccttacagacatataaaacattaaacccaagagcaacagaatagatactcttcctaactgtacacagaacattctccaggatagaacacattaagacaattagcacatcttaacaaatgtaagaagatcaaaatcctaccaagtatcttttctgaccacagtgaaattcaacagtagaaggaaaactggaaaattcacaaatacccatcttaagggttatatttttcctgcttatttgtacatctggtaatagtaaagtgtgaatggatgccagaaatagtgaatttcatcttgttggttgctgcatgtatttgtattcctatacttagtatcagttttatccctataagtcttgctgttaagcatagttaagtggaaccaaagtagtgctttgtctagaagtcatttccccagtactaatgcaaaaccttctttgtattttaatgctttatgaattgtgaagttcttctaccttggctattggaaataggtccatgtgggctctgatcactgtcccctttgggtggttattttcctggccttatgtagttttcttatacacgtgtgctaatcaatatttaactgaataattggtggagttggatcctctgaaaattgagagagtcccctttttttcattaaaaaaaaattaaaacggtgctattgcaatagagttctctttctacataggtctacactctccaaaactcttttctgaaaaattttgataccttggcttccccagagtcatggctccatttttttcaattgaaggagactagcaggctctgactgagtttcccttccctgcagcctagaatatttatctaggcatgaagatatagccatcttagggctcatctaagcctttccatcttttggagatcactgaccttacttgcctgaagtccagtgacttaagtgctattttttcatataattttgtcagtttttttctgtttttagttatgcctgggagggtaaatcaggtccctgttactctatcttgactagaagtgaaagtcaaggttatttctcaaatatggtttcaaaagatcagattttgtcatttaagacacatattttacattcaaaaatgtaaagtcagggtgtgtcttaaaatccattggtgttttaatcatgcttaaacatgtgactgctgttggccaggatacagttgtggtggtgtcgtcagtatctgagcacatgtgaactttgccatgactattcatattgtcttctcttaaactgaattatgtccatggttgccaacatgtactgtccatagttgccaccatgtatttaggttgtcatttaaaatgtcctcaaaaagatttcaccatgattctccatcaaaatagaaagctattttgtatgaagaagaactcagaccagaaaagtctgataaaaataatctcttaaataagtctacattaggtctttcaatttgtataaaatgtaaattttgaattataagaaaacaatttgttatactgtaattggtagcattttttcttagtagtgtacaaaataatgtgtaccttacattcaaaggcatcctagattcaattaaataaaataactgattagccaggatattaataatgctaatctaagaaagtcctaaaataacagtgtttaaaacaagacagttttaattctccctcacattattgatctgggaacaaggtatttgtggtttgtggtggtgtttgatattggggacctaggctatttttatattgttgcttcactgtatacagggtttcgccctcatctatatgattcaagcccactgttgtgtacacattttatccaataggaaaatagcaatgggaatggttcttccatttatagtcacaatccagaagttgtagacatcatttctgcttccataaaattggccagaaagttgtcatatggtcacaaatagctgcaaaagggatggggtaatatagtccttatttcagacaacttcatgcccagctgaaaatcagagggtctattgctatagaaagaggggagaatgaatttggggagacaggaagtattgtgttgtttaagagagaaatgagatcagctcagggtatattctgctacaggtctccaattgggtgccacccccagtaccttcttaattctccatctttctgaatgcaaacacagatacaagagcccttatgcactgctggtaagagtatgaactgttatagccatcctgctgagcaaattggcactgcttaatcaaagtaagaatgcacattacctgggcccctgaaatccaactcctgggataaatcaccccccaccaccaccaaaaaaaaattactgagacaggtacaaggctattcacttaaatgttattttggaggtggggagattgaggcaaagtgggagtctgtccctggaagagtcaacagataaaatgtggttgatagccatatatagaagcaaggaattctggatattaacttgagattgctgtgtgaaaaccatattttggaaattggccaatataacaatttttatatacacatatatgtacatatatacacacacacaaatacacacacacacacatatacaggcatgtgccatataatgatgtttcagtgaacaatacaccacatataccatagtgtggtccctgaagattacaatggagctgaaaaactcctatcacctagtgacgtacccactgtaacatcatagtgcaatgtattactcacgtttgtgatgatactgcactgccagtcatataaaagtctagcatataaaattatctacagtacatgatacttgaaaatgataacaaatgactatgttactggtgtatgcatttactatactatactttttatcattattttagagtgtactcctcttacttattaaaaaaaaataactgtaaaacaggttcaggctggacttccaggaggtattccagaagaaggcattgttttcatattccttgaagactttccagtgggacaagatgtagagttgggagacagtgatattgacaatcctaaccctgtgtaggcctaggctaatatgtgtgtttctgtctttatttttatttttatttttttttatttttgaaacctggtctcactctctcacccgggctggagtgcaggggcatgatcatggctcattgaagccttgacatcccaggctcaaacaacccttccacctcagcctcccaagtagctaggaccacaggcatgcaccaccacacctggctaatttatatatttttttaatagagatagggtcttcctatgttgcctaggctggtctcaaactcctggcctcaagcgatcctcctgccttggcctcccaaaatgctggggttacagacttgagccactgtgcccagcctgtatctttatgtttaaccaaaaagtccaaaaagtaaaaataaataaataaatacaaacatagaaaaaacgcttatgaaataaggatataaagaaataaaatatttttgtacagctgtacagtatgtttttgtgtcaagctaagtattattgcaaaagagttgttaaaagaaaagcttcagccaaattaaatttaaaggaggttaattgagcaatgaatgattcatgaattgggcagcccttagaattacagcagatgcagagagactccagcacagccatgtagtggaagaagatttatagacaaaagggaagtgacatacagaaatcggaagtgaggtacagaaacaactggattggttacagctcagtgtttgcactatttgaacacagtttgaaccctcagcagtgtatgagtggttgaactatggctgctaggactggccaagactcagctattgttacaggcacatactcctaagttacgttttcaatcttgtctacctaataagttaggttatgctttgtcctcatggactcaaatgtagaagtacagtccttctcaggctatatttagttggctttaacaattcctcccttttggttactttctcaattttgagatgttgaccaaaactttagtcattgatgtcactatcaccattgtaaatgtacttatttggtcttgaaacccactggaaaacagtagaacagtgggttttacaaggtgggaacaaggacagagtagagggtacctccttatgctgtaacatcctgtttgcaggagaaaaacaaaatctggtctgttctaggatctatgtgtttccttaaagtcttagtttgattatgtcatatttagtatgagtgactccatgtttgtttggtttggtctgttagggcctaatgcaagagctcagtccaaaacaatggcctcccataattttgttttaaaactctacttttcgggtcaggttcttacttaggtgagggtgtgaccaaaacttagggccttagtgccactctgttaccatcattttgggtttctggtctcagcgtgtaattcataagttaccatgtgttcatggttgcatatttttttcagctcttgtcatcccagttgaagagagaccatttgatattctatagatggctgcatgcaaacatttaaaacttttgagagaatgcagcgcacaagggagactactattatgactattgggaggataacaccaacagtttgtagtatgctccttacccagggttcccataaatcaaaccacttaaaattaaatagattaaagaatgggctaaagagtctactcacttaactaagcagtctttccattaatcccctacaactgaatttttatattctacattttatgtatttctccataggcgacaagtgccagcagctgcacagatatttttccattgagccaatgctattatttagtataactttcacaagagaatttaaagtctgttgtgtagccatagcctttacagtaaaatctgctatagagcctatcatgagggatacatttttaatcattgcttcttttactccaaaccaaggaagaaagatctaacaaatgatgtcctctagaagagtaaaggcctcctcataatgttcactttaacccatgatgtgggttaagaggagtgaaccaatgttccctttctgactgattatgaggcaacgtgtgtaccgttaaagcttcttgtctacattgagccttcgtcttttatctgtcaaagtataaggttatccatgtataaggctggctgcaaaatccttcacaaataaaagtataccccataagtacacacaacagaccctcttttcacttctattcttcagaggcataagcaaggaaaaaaatagttagacaagaatctcatgatgctagagaagtcttgatctttgatcttgggaaaagctattcacatcagagatgccatcttcttctggggagaaacttcccaggttagctttactttaagggcttcactgggtgtacagttccaagagtgtggagggacccttctcagttgtgagattatgaacttaaaattcaaggtcctgaagttttgctgtagtgtggatggcaaatacagcctttctctgatgttctcagaagatccaatttttgggttctagattgtgaaggggttgattgtcctcagtcagtgatccataaaaactttctttacctggtgaaaataccctgtagcataataatctactgttataacagcaaccctcatacatgggaaaacttttatacaaccagaaaacatgcattgaaaatgacaactgaatgaaattcttatacaaaatgtttaaatggcccatcagctaaccaaatgcacctgaaggtttgattgttttcccaggaatatgggtgtgacaaaccaaatattgttcataaactattttaggaatttagaagacaccacattaatatataattaatttggatcattttgtcttttccatgatgagtcacagaatacagaacctttaataacaaaagctttaacgactcaggaaggacaaagtggctgtcctgcttctccatgagtccatgcttaattaacattagacttatgtcctcttgaataccagttatttctccaaattaggtacatagcactgataactggtgggttatcataggtaatttgacttagaccgtggagtttattcaaactgtatacctaaacaatttcagtattggctgattcagcattcaaatctggcagagtattttcttgttattccataactttctgttctacttgggttagtagttttataaaccagtccaccttttcattaaaatttcaggaattcttatccggtccaaatgatatgattttatagaaacctgtattgaagagtgattttcagggacctttcaatcctttcatgaacctcctaaaagacaccatattctaggattttgcatgcttgtgaaatttttcagaaacagcatcagcattaagcaactaactgtggaaatgacttcaaaggattatagttaaaaacacaattaaaaagaaaacttcattctttctgttgtctacaataacataataaccataataatgattaatagcaagcactcaaacatattagaaattttgaaatccaatacaatttttgagcatatatatatataattataaatatatataattatatatatatatataattatatatatatataattatatatatatatatatataattatactttaagttttagggtacatgtgtacaatgtgcaggtttgctacatatgtatacacgtgccacgtaggtgtgctgcacccattaactcgtcatttacattaggtatatctcctaatgctatatctccccaattcccccaaccccacaacaggccccggtgtatgatgttccccttcctgcgtccatgtgatctcattgttcaattcccacctatgagtgagaacatgcagtgtttggtttttcgtccttgcgatagtttgctgagaatgatggtttccagcttcatccatgtccctacaaaggacatgaactcatcattttttatggctgcatagtattccacggtgtatatatgccacattttcttaatccagtctatcattgttggacatttggcttggttccaagtctttgctattctgaacagtgccacaataaacatacgtgtgcatgtgtctttatagcagcgtgatttatagtcctttgggtatatacccagtaaggggatggctgggtcaagtggtatttctagttctagatccctgaggaatcgccacactgacttctgcaatggttgaactagtttacagtcccaccaacagtgtgaaagtgttcctatttctccacattctctccagcaccctttgttccctgactttttaatgatcgccattctggtgtgagatgctatctcattgtggttttgatttgcatttctctgatggccagtgatgatgagcactttttcatgtgacttatggctgcataaatgtcttcttttgagaagtgtctgttcatatccttcacccacttgttgaaggggttctttgttttttccttgtaaatttgtttcagttctttgcagattctggatattagccctttgtcagatgagtacattgcaaaaattttctcccattctgtaggttgcctgttcaatctgatggtagtttcctttgccgcccagaagctctttagtttacttagatcccatttgtcaatttcggcttttgttgccattgcttttggtgttttagacatgaagtccttgcccatgcctgtgtcctgaatggtattgcctaggttttcttctaaggtttttatggttttaggtctaacatttaggtctttaatccatcttgaattaatttttgtataaggtgtaaggaagggatccagtttcagctttctaatatggctagccagttttcccagcaccatttattaaatagggaatcctttccccattgcttgtttttgtcaggtttctcaaagatcagatagttgtagatatgtggcattatttctgagggttctgttctgttccattggtctatatctctgttttggtaccagtaccatgctgttttggttactgtagccttgtagtatagtttgaagtcaggtagcgtgatgcctccagctttgttcttttggcttagggttgacttggcaatgagggctcttttttggttccatatgaactttacagtagtttttttttccaattctgtgaagaaagtcattggtaacttgatggggatgacattgaatctataaattaccttgggcagtatggccattttcacgatattgattcttgctatccatgtgcatggaatgttcttccatttgtttgtatcctcctttatttcgttgagcagtggtttgtagttctccttgaagaggtccttcacatctcttgtaagttggattcctaggtattttattctctttgaagcaactgtgaaagggagttcactcatgatttggctctctgtttgtctgttattggtgtataagaatgcttgtgatttttgcacattggttttgtatcctaagactttgctgaagttgcttatcagcttgaggagattttgggctgacatgatggggtcaatattgtgaaaatggccatactgcccaaggtaatttatagattcaatgccatccccatcaagctaccaatgactttcttcacagaattggaagaaactacttgaaagttcatatggaaccaaaaaagagcctgcattgccaagtcaatcctaagccaaaagaacaaagctggaggcatcacactacctgacttcaaactatacttcaaggctacagtaaccaaaacagcatggtactggtaccaaaacagagatatagatcaatggaacagaacagagccctcagaaataacgccacatgtctacaactatctgatctttgacaaacctgagaaaaacaagcaatggggaaaggattccctatttaataaatggtgctgggaaaactggctagccatatgtagaaagctgaaactggatcccttccttataccttatacgaaaatcaattcaagatggattaaagacttaaacgttagacctaaaaccataaaaaccctagaagaaaacctaggcattaccattcaggacatacgaattggcaaggacttcatgtctaaaacaccaagagcaatggcaacaaaagccaaaattgacaaatgggatctaattaaactaaagagcttctgcacagcaaaagaaactaccatcagagtgagcaggcaacctacaaaatgggagaaaatttttgcaacctactcatctgacaaagggctaatatccagaatctacaatgaactcaaacaaatttacaagaaaaaacaaacaaccccatcaaaaaatgggcgaaggacatgaacagacacttctcaaaagaagacatttatgcagccaaaaaacgcatgaaaaaatgctcaccatcactggccatgagagaaatgcaaatcaaaaccaaattgagataccatctcacaccagttagaatggcaatcattaaaaagtcaggaaacaacaggtgctggagaggatgtggagaaataggaacacttttacactgttggtgggactgtaaactagttcaaccgttgtggaagtcagtgtggcgattcctcagggatctagaactagaaataccatttgacccagccatcccattactgggtatatacccaaaggagtataagtcatgctgctatacacatgcacacgtatgtttgttgtggcactattcacaatagcagacttggaaccaagccaaatgtccaacaatgacagactggattaagaaaatgtggcacatatataccgtggaatactatgcagccataaaaaatgatgagttcatttcctttgtagggacatggatgaaattggaaatcatcattctcagtaaactatcgcaaggacaaaaaaccaaacaccgcatgttctcactcataggtgggaattgaacaatgagaacacatggacacaggaaggggaacatcacactctggggactgttgtggggtggggagagtggggagctatggcattaggagatatacctaatgctaaatgacgagttaatgggtgcagcacaccagcatggcaaatgtatacatatgtaactaacctgcacattgtggacatgtactctaaaccttaaagtataataataataataatcaaaaataaaaaagaatccagagccatcagtgtgctgtattcaggaaacccatctcacatgtggagacacacataggcttaaaataaagggatggaggaagatctaccaagcaaatggaaaacaaaaaaggtggggattgcaatcctagtctctgataaaacagactttaaaccaaccaagatcaaaagagacaaagaaggtcatttcataatggtaaagggatcaattcaacaagaagagctaactatcctaaatatatatgcacccaatacaggagcacccagattcataaagcaagtccttagagacctagaaagagacttagactcccacacaataataatgggagactttaacatcccactgtcaacatgagacagatcaacgagacagaaagttaaaaaggatatccaggaattgaactcatctctgcaccgagcagacctaatagacatctacagaattctccaccccaagtcaacagaatatacattcttctcagcaccacaccgcacttattccaaaattgaccacatagttggaagtaaagcagtcctacacaaatgtaaaagaacagaaattataacaaactgtctctcagaccacggtgcaatcaaactagaactcaggattaagaaactcactcaaaaccgctcaactacatggaaactgaacaacctgctcctgaatgactgctaagtacataacgaaatgaaggcagaaataaagatgttctttgaaaccaacgtgaacaaagatacaacataccagaacctctgggacacatttaaagcagtgtgtagagggaaatttatatcactaaatgcccacaagagaaagtaggaaagatctaaaattgacaccctaacatcacaattaaaagaactagagaagcaaaagcaaacacattcaaaagctagcagaaggcaagaaataactaagatcagagcagaactgaaggagatagagacacaaaaaacccttcaaaaaatcagtgaatccaggagctggttttttgaaaagtacaacaaaattgatggaccgatagcaagactaataaagaagaaaagagagtagaatcaaatggatgccataaaaaatgataaaggggatatcaccaccaatcccacagaaatacaaactaccatcagagaatactaggaacatatattaatatcattcactaaaatataacctgaggaaagttaatttttttgacagtgcttcccgtgtaacttgctatgtcaaataattctgtttacctttcctctgggtgcttaagggtccctctggagcattccaagttagaggtcgcataatataattttgaagctgcaatttgattttgggaaggccatcaaatatggtaaagttttaaaacagtttgatatgatgaaatggaattctaggtactgtaagtcattcatttagccaaaatgatgactcaaaaaatttaagaaggcaaaaactgttagtcattgataggcagaaaccttagctttccaaacagtctgtctcttgtctttcccttcttttttggtagtttattcaaaaggcaaagaaaaatcttttattgtcctttactattgcatgaaaatcttgttcaagagagaaagcaaaatttcaccctggcattagtgtaccatgaatgttaaccctaattcttaagaaatcttatagacaaattgattcaatcttaatcatttggaccataaggtgagattcccataaaccttttattaccctttacaaatttttgttgaagagcagattagtgctctaagaaaaccctgttgtgcttttatttcaatgttcaagttatggaaaaaataataatacctctttaaatttagtcaatatgtttacagacaaaatttgttttacaatattaatttttacgaaccttttacaacttggtgaaacgtttacctttatcttatgtaatttaaaacaatcatttagccctttaatctaggcaaacatttacattcccatgccttcttataatattttaccaaaaatactttttattgtcttcacacaccttgcatataaaacttttttcagtagtctcaaatacatgttataatggtaactctccagaattttaatttttggtagaaaacctggcaagtaagtaattttaattatgtagtaggtttgtatccaaggaaatcagacagaagtacagataaggtgtgactctttcatcatttctgttagacttcactgcttcccaggttaacatttatgcatgtgttagccagaggaactcagttcttcagaaattaaaaattaaatttgtacctaaaatattggctttgctctcagattcccctgatgaacttagccaatgatttttcctacctaagtgtgcacaaaaaaaaatgtgaaacaaaggggtagaacgtaaaaatcctcatgaatatccagaagccaattttttttcaatttctacaatattgccatttactgccagtttttttctgacccagtcaggtgtaagagccctctaactggatccaagccagttaatcactggaacgaatccaatcctggaccaagtccggtttctatagtgacttataaaccaagtttggatgagaaattcgcccaaagaaactcaaagagctcaaaacacaaatccatgaagctccaaaacccaaaagagaacttaaccaagatctctagctcctctgatagatcaaacgacacaattgggtccttgcagttaccttgcttgttcactcagtgctcctgggggtcgttaaaagttctacttcagatgccacttctgacatcatctgttaaaagaaaaaaatcagccaaattaaatgtaaaggagtttaactgagcaatgaacaattcatgaatcagacagccatcagaatcacagcagattcagggaggccagcacagccacttcatggaagaagatttataaacaaaaaaaaaaaaaagagaagtgacatacacaaattggaagtgaggtacagaaacaactggattggtcacagctcagtgtttgcattattcacagtttgaacactcagcagcgtatcagtggttgaagtatggtttctgggattagccaaggctcagctattgttacagacacatactcctaaattaggttttcagtcttgtctacgtattaaattaggttgtggttcatccacaaggactcaaatatagaagtgcagagtctttctcagccatatttagtttgcttaacagagtaaaaatgtttttaaaaagtttaaagtttataaagtaaaagcattacaataacctaattttaatttattatggaagaaagacatttttaaagataaatttagtttagcctaggtatacagtctaactatagctggagtcttcaacatacctctatcaacatttgataaaacaagccagaaatcatcaaggatatagaaccatcaccatcaaccagcagaatctcattgacatttatagaacacttcacccagcagcaggatacacattctttgcaagtgctcatggaacatataccaaaatagatagaccatttcctgggatataaaataatccccaacaaatttaaaagaacagaaatacagaaatgtgttgtgtgacattaataaaatcaaactaaaaaccagtaaaccagaaaaaattaccagaaaaatctacacacgcttggacactaaacaacatatatctgaatgatgtgtatttcatagagagtctcaagaaaaataaaaatacactaaactgagtgagctgaaaaatatcaaaaattgtgagatgcagtaaaagcagtaatgaaaaaaattaacagcactaaatgcttacattataacagaagagatgccttaaaacaataatctaagctcccacttcaagaaactcgaggaagaagagaaaaataagatgaaggcaagcaaaaaacagaaactaataaaggtaagaacagaaatcaatgaaattgagactagaaaacaacaaagaaatgaatgaaacatttatatatttaaaacaacatatacacatttcatgcacattacctgtgctgtgaaatcccactcctgagatgaatccctggttgttttaagaatctatctatctatttatctatccaaacatatatatttcatatatataaaacaaccagggtttatccccagtgaaatttatatttaaatagacgtgtgtgtgtgtgtgtgtgtgtgtgtgtgtgtgcacgcatttaaaacaaccaaggggtttttccaagatggctgaataggaacagctctgatctgcagttcccagcaagaccaaagcaggaggtgggtgactgctgcatttccaactgaggtacccggttcctctcgttgggactggttagacagcgggtgcagcccacagagggcgagcagaatcagggtggggtgtcaccttacccaggaagtgcaaaggaccagggacctccctgttctagccaagggaagctgtgaggctgtgctatctgccccagatactacgcttttcttatggtttttgcaacctgcagactaggagattccctcatggacctgtaccaccagggccctgggattcaagcacaaaactgggtggctgtttgggtagacactgagctagctggaggaggttttttttgttttgttttgttttggttttggttttttttcccacacgccaggggcacctggaacccaagcgagagagaactgttcactcctctggaaaggcggtggaagccagaaagccaagtgatctcgcttagcaggtcccacccccacagagcccagcaagctaagatccaccagcttgaaattctcactcccagcacagcagtctgaagttgacctgggatgctcgagcttggtggggggaggggcttccaccattactgagacttgagtaggtggttttccccacacagtgtaaacaaagccaccaggaagttctgacttagcggaaaccatcatagcacagcaaagcagctgtggccagactgcctctctagattcctcctccctgggcagggcgtctcgggaaaaaaggcagcagtcccagttaggggctcatagatggaactcccatccctgggacagaacacctgggagaaggggtggctgtgggggcagcttcagcagacttaaatgttcctgcctgccagctctgaagagagcagaggatctcccatcagagtgctagagctatgctaagggatggactgccttgtcaagtgggtccctgacgcctatgcctcctgactgggagacacctcccagcaggagtcaacagacaccgcatacaggagaggtcagggtggcatctggcaggtgcccctctgggatgaagtttccagaggaaggagtaggtggcaatctttgctcttctgcagcctccactggtgatacccaggctaataggatctggagtggaccaccagcaaactccagcagactgcagaagaggggactcactgttagaaggaaaactaacaaacacaaagcaataacatcaacatcgacataaaggatgcccacacaaaaaccccatttaaaggtcattaaagtcaaagatcaaagttaaataaatacacgaagatgaggaaaaaccagtgcaaaaaagatgaaaattccaaaagctacaatgccacctctcctacaaaggatcacaactcctcgccagcaagggcacgaaactggatggagcaagagtttgacgaaatgacagaagtaggcttcagaaggtgggtaataacaaacttctctgagctaaaggagcatgttctaacccaatgcaaggaagctaagaaattttataaaagttgacaagaactgctaactagaataaccagtttagaggaaaacataaattacctgatggagctgaaaacacagcacgagaacttcatgaagcatgcgcaagaatcaatagccaaatcaatgaagcagaagaaaagatattagagattgaagaccaactttaagaaataaagcatgaagacaagattagagaaaaaaaatgaaaaggagcgaacaaagcctccaagaaatatgggactatgtgaaaagactaaatctatgattgactggtgtacctaaaagtgatggggagaatggaaccaagttggaaaacactcttcaggatattatccagaagaacttccccaacttagcaagacaggccaacattcaaattcagaaagtgcagagagcaccactaagatactcctcaagaagagcaaccctaagacacataagcgtcagattcaccaaggttgaaacaaaggaaaaaatgttaaaggcagacagagaaaaaggtcaggttaccaacaaaagaagcccatcagactaacagtggatctctctgcagaaaccctagaagcaagaagagagtgggggtcaatattcaacattcttaaagaaaaaaaattttgagattgagaccatcctggctaacatggtgaaaccccgtctctactaaaaaaatacaaaacaattagccaggcatggtggcaggcacctgtagtcccagctactcgggaggctgaggcaggagaatggcatgaacctgagaggcagcgcttgcagtgagctgagatcacgccactgcactccagcctgggcaacagagcgagactccatctcaaaaaaaaaaaaaaaaagaaaaaagaaaaaaattttaacccagaatttcatatccagctaaaataagcttcacaagcaaaggagaaagaaaatcctttacagacaagcaaatgctgagggattttgtcaccaccaggcctaccattcaagagctcctgaaggaagcaataaatatggaagggaaaaactggtaccagccactgcaaaaacgtaccaaaatacaaaaaccaatgacactaggaagaaactgcatcaactattgtgcaacaaaccagctagcatcatgattacaggatcagattcactcataacaatattaaccttaaatgtaaacaggctaaattccccaattaaaagacagagactggcaaattggataaaaaagactcaagacccatcactgttctgtattaaggagacccatctcatgtgcaaagatacacatgcgctcaaaataaagggatggatgaatatttaccaagcaaatggaaagcaaaaaaaaagcaggggctgcaatcctagtttctgataaaacagaccttaaacaacaaagatcaagaaagacgaaggatattacatgatggaaaagggatcaatgcaacaagaagagctacctatcctaaatatatatgcacccaatacaggagcaccaagattcataaagcaagttcttagagagctacaaagagactaagacttccacacaataatcatgggaaattttaacaccccactctcaatgttagacatatcaatgagatggaaaaaaatacaaggatattcaggacttgaactcagctctagcccaagcggacctaatagacatctacagaactcttcactccagatcaacagaatatacattcttctcagcaccacatagcactttttctaaaatcaaccacataaaggaagtaaaacactcagcaaatacaacagaacagacataataacaaacagtctgtctgaccacagtgtgatcaaattagaactcaggattaagaaactcattcaaaaccatacaacttcaaaagaagacatttatgcagccaacaaacatgaaaaaaagctcatcatcactggtcattagagaaatgcatatcaaaaccacaatgagataccatctcacaccacttagaatggtgatcattaaaaagtcaggaaacaaaagacgcagtagaggatgtggagaaataggaacacttttacactgttggtgggagtgtaaattagttcaacccttgtgaaagacagtgtggtgattattcaaggatctaattagaaataccatctgacccagcaatcccattactgggtatatacccaaaggattctaaatcattgtactataaagacacatgcacatgtttgcttattgcagcagtattcacaagagcaaaaacttggaaccaatgcaaatgcccatcaatgatagactggataatgaaaatgtggcattatacaccatggaatactatgcaaccagaaaaaagaaggagttcatgtcccttgcatagacattgatgaagctgaaaaccatcattctcagcaaactaacacaggaacagaaaaccaaacaccacatattctcactcataagtgggagttgaacaatgagaacatacaggcacaaggagggaaacatcacacaccaggacctgttggggggtgggggggcaaggggagagatagcatttggagaaatatgtaatgtagatgacaggttgatgggtgcagcaaaccaccttggcacaaacctgcacattctgcacatgtatcccagaaattaaagtataataaaaaaatcaatgaatctaggagctggttttgggaaagattaacaaaatagacggctagccagactaataaaaaagaaaagagaagaatcaaatagacacaataagtagtgataaaggggatatcaacactgaccccatggaaataaaaactaccatcagagaatactaaaaacacctttatgcaaataaactagaaaaatctagaagaaatggataaatttctggacacaaacacactcccaagactaaactagagggaagttgaatccctaattacaccaataacaacttctgaaaatgaggcaataattaatagcctaccaaccaaaaaaaagtccagggccaggcggattcacagccaaattctatcaaaggtaaaaagaggagatggtacaatttcttctgaaactattccaaacagtagaaaaagagggactcctccctaactcattttatgaggccagcattattctgataccaaatcctggcagagacacaacagcaacaacaataacaaagaaaatttcaggccaatattgctgattaacatcaatgagaaatactggcaaaccgaatccagcagcacatcaaaaagctcattcaccatgatcaggttggtttcatccctgggatgcaaggctagttcaacatatgcaaatcaataaacgtaatccatcacataaacagaaacaatgacaaaaacctcatgattatttcaatagatgcagaaaagacattcgataaaattcaacacctcttcatgctaaaaacattccataaactaggtattgatggaacatatctcaaaataataagagctatttatgacaaacccatagccaatatcatactgaatgggcaaaagctggaagcattccctttgaaattcagcaaaagacaagaatgacctctctcaccactcctagtcaacatagtattggaagttctggccagggcaatcaggcaagagaaggaaataatggtattcaaataggaagagaggaagtcaaattgtctctgtttgcaaatgacatgatggtatattcagaaaaccccattgtctcagcccaaagctccttaagctcataagcaactttagcaaagtctcaggatagaaaatcaatgtgcaaaaatcacaagcattcctatacaccaataatagacacacagagagccaaatcatgagtgaactcccattcacaattgctattaagagaataaaatacctaggaatacaacttacaaaggatgtgaaggactgcttcaaggagaactacaaaccactgctcaaggaaataaggacacaaacaaatggaaaaacattccatgctcatggataggaagaatcaatatcgtgaaaatgaccatactgcccaaagtaattcatagattcaatgctattcccatcaagctaccattgaatttattcacagaattaggaaaaagtactttaaatttcatgtggaaccaaaaaagagcccgtatagcaaagacagtcctaagcaaaaagaacaaagctggggatatcacgctacctgacttcaaattatactacaaggctatggtaaccaaaacaccatggtactggtaccaaaacagatatatagaccaacggaacagaacagaggcctcagaaataacaccacacatctacaaccatctgatctttcaccagtctgacaaaaacaagcaatggggaaaggattccccatttaatatgtagtgttgggaaaacaggctagccatatgcagaaaactgaaactggaccccttccttacaccttatacaaaaattaactcaggatgaattaaagacttaaatgtaagacctaaaatcataaaaaagaaaacccaggcagtaccattcaggacataggcatgggcaaagacttcatgactggaacaccaaaagcaattgcaatgaaagcaaaattgacaaatgggatctcattaaactaaagagcttctgcacagcaaaagaaactatcatcagagtgaacaggcaacctacagaatgggagaaaatttttacaatctatccatctgacaaaggtctaatatccagatcctacaaggatcttaaacaagtttactagaaaaaaccaaccccattaaaaagtgggtgaaggttatgaacagacaattctcagaagaagacatttatgtggccaacaaacatatgaagaaaagctcgtcatcactggtcattagagaaatgcaaatcaaaaccaaaatgtgatagtatctcatggcagttagaatggtgatcattaaaacgtcaggaaacaacagaagctggagaggatgtggagaaataaggaagcttttataataattgcaaaaattttctcccattctttaggttgcctgttcccactgataatagtttcttttgctgtgcagaagctctttagtttagttagatcccttttgtcaatttttgcttttggtgccattatttttggtgttttggacatgaagtctgtgcccattactatgtcctgaatggtattgcctaggttttcttctaggatttttatgattttaggtgttatgtttaagtctttcatccatcttgagtaaatctttgtataaggtgtaagtaaggggtcgagtttcagttttctgcatctggctagccagttttgccaacaccatttattaaatagggaatcctttccccattgcttgtttgtgtcaggttggtcaaagatcagatggttgtagatgtgtggtgttatttccgaggcctctgttctgttctatgtatctgttttggtaccagtagcatgcagtttcggtttctgtaaccttgtagtatagtttgaagtcaggtatcgtaacacctccagctttgttctttttgcttaggagtgtcttggctatgtgggctcttttttggttccatatgaagttaaaagtagtttttttccaattctgtgaataaagtcaatggtatcttgatggggatagcattgaatctataaattactttgggcagtatggcaatttttacgatactgattcttcctatccataagcatggaatgtttttccatttgtttgtgtcctctcttatttccttgagcagtggtttgaagttctccttgaagataaccttcacatcccttgaaagttgtattcctaggtattttattctcttagtagcaatggtgaatgggagttcactcatgatttggctctctatgtgtctattattggtgtataggaatgcttgtgatttttgcacattgattttgtatcctgagactttgctgaaattgcttatcagcttaaggagattttgagatgagacaatgaggttttctaaatatatgatcatgtcatctgcaaatagagacaatttgacttcctctctttctatttgaataccctttatttctttcatttgcctgattgtcgtggccagaaattccaatactatgtggaatagaagtggtgagagagggcatccatgtcttgtgccagttttcaaagcaaatgcttccagctgttgcccattaagtatgatattcgctgtaggtttgtcataaataggtcttattattttgagatacatttcattgatacctggtttattgagagtttttagcataaaggggtgttgaattatgtcacaggccttttctgcatctagtgagataatcatgtgacttttttgtcattggttatgtttatgtgatggattgcatttattgatttgcatatgttgaactaactttgcatcccaggtatggagccaacttgatcgtagtggataagctttttaatgtgctgctggattcagtttgccagtattttattgaggattttcacatcgatgttcatcagggatattggcctgaaatttcccttttttgttgtgtctctgccaggttttggtacccggatgatggtggcctcataaaacaagttagagagtattccctctttttctgttgtttggaatagtttcagaaggaatggtataagctgctctttgtacctctggtagaattcggctgtgaatccgtctggtcctggactttttttggttggtagtctgttaattactgcctcaatttcagaacttgttattagtctattcagagattcgacttcttcctggtttagacttgagggggtgtatttgtccaggaatttctccatttcttctagattttctagtttatttgcatagaggtgttcatagtattctctgatgatagtttgtatttctgtgggatcagtagtgatatgccctatgtcgttttttactgtgtctatttgattcttctgtcttttcttctttattagtctggctagcagactatctattttgatgacttttttcaaaaaccagctcttgaattcattgatttttttgaaggttttttcatgtctctagctccttcagttctgttctgatcttagttaattcttgtcttctgcgagcttttgaatttgtttgctcttgcttctctagttcttttcattgtgatgttagggtgtcaattttagatcttttctgctttctcttgtggggatttagtggtataaatgcccctctacacactgctttaattgtgtcccagagatcctggtacgttgtatctctgttctcattggtttcgaagaacatctttatttctgccttcatttcattaattacctagttgtcattcaggagcagattgttcagtttgcatgtagttgtgtggttttgagtgaatttcttaattctgagttctaatttaattgcactgtggtctgagagactgttatgattttcattgttttgcatttgctgaggagtgttttacttctaattatgtggtaaattttagaataagtgcaatgagttgctgagaagaatatatattcttttggtttggagtggagagttctgtagatatctattaggtcagcttggtctagagctgagttcaagtcctgaatattcttgttaattctctttttcgttgatctgtctaatattgacagtggggtgttaaagtctcccactattattgtgtgggagtctgtgtttctttgcaggtctctaagaacttgctttatgaatctgggtgttcctgtattgggtgcatatatatttagaatagttagctcctcttgttgcattgatccctctaacattatgtaatgcccttctttgtctcttttgaccaacaaacacaaccaacaggttagtttcaagtctgctttaccagagattaggattgcaaccccagcttttttttttttctttccatttgcttggtaaatattactctgtctctttattttgagcctatgtgtgtctttgcatgtgagatgggtcccctgaatacagcacactgatggatcttgactctttatccattttgccagtctgtgtcttttaactggggcatttagctcgtttacatttaaggttaatattgttatgtgtgaatatgattctgtcaatttgatgctagctggttattttgcccatttgttgcagtttcttcatagtgtcaatggtctttacaatttgttgtttttgcagtgactggtacctgttgtttctttctatgtttagtgcttccttcaggaggtcttgtaaggcaggcctggtggtgacagaatctctcagcatttgcttgtctgtaaaggattttttttctccttcacttatgaagcttagtttgggtggatatgaaattctgggtttaaaattcttttctttaaaaatgttgaatactggcccccactctcttctggcttctagggtttctgcagagagatctgctgttagtctgatgggcttccctttgtgggtaacccgacctttctctctggcttcccttaacattttttcctttgtttcaaccttggtgaatctgatgattatatgtcttggggttgctcttctcaaggagtatctttgaggtgttctctgtatttcccgaatttgaatgttggtctgtgttgctaggctagtgaagttctcctggataatatcctgaagagtgttttccctgttggttccattctacccatcactttcaggtacaccaatgaaacgtaggtttggtcttttcacatagtcccatatttcttggaggctttgtttgttcctctttattcttttttctctaatcttgtcttcacgctttatttcattaatttgatcttcaatctctgatatactttcttctgcttggtcgattccactattgattcttgtgtatgcttcacgaagttcttgtgccatggtttttatccccatcaggtcatttatgttcttctctaaactggttattctagttagcaattcctctaacctttttcaatgttcttagcttccttgcattgtgttagaacatgctcctttagctcagaggagtttgttattacccaccttccgaagcctaattctgtctgttcatcaaactcattctccatctggttttgttcccttgctgatgaggagttgtgatcctttagaggagaagaggcattctggttttcatctttgtagatttatttacctttggtttttatgttagtgaccttagaatggggtctctgagtggatgtgttattcctttatgtttgttagttttccttctaacagtcgggcccctctgctgcaggtctgctggaatttgctggaggtccactccagaccctgtttgcctgggtatcaccagcggaggctgaagaacggcaacgattgctgcctgttctttcctctggaagttttctcccagaggggcacctgccagatgccagccagagctctcctgtatgaggagtctgttggcccctactgagaggtatctcccactcaggaaacatgggggtcagggactcacttgaggaggcaatctgtcccttagcagagcttgaatgctgtgctgggaggtccactgctctcttcagagctgtcacacagtgacctttaagtctgccgaagctgtgtccaccactgccccttcccactggtgctctgtcccagggagataggggttttatctataagtccctgactggggctcctgcctttttttcagagatgccctgcccagagaggagaaatctggcagtctggccacagcaaacttgctgagctgccatgggctctacccattttgaacttccctgaggcttctttacactgtgaggggaaaactgcctactcaagcctcagaaatggcggacgcccctcctcccaccaaactcgagtgtcccagtcggtatcagactgctgctgtgctggcagagagaatttcaagccagtggatcttagtttgctgggatccatggggttggaacccactgagcaagactacttggctccctggcttcagccgctttccaggggagtgaacatttttttctcgctggcccttaaggtatgggggaaaaaaaaaaaaccctgcagctagttcagcgtctgcccaaagggccgcccagttttgtgctggaaacccagggtcctggtggtgtaggcaccgaaggggatctcctggtctgcgggttgtgaagactgtgggaaaagcacagtatttgagttatagtgcacaatgcagtccctaatggcttcccttggctgggagatggagttccccgaccccttgcacttcccagttgaggcgatgccccaccttgctttggctcgtccttcttggtctgcacccactgtccaaccagtcccaatgagatgaactgtgtacctcagttggaaatgcagaaatcacccaccttctgttttgatctcactgtgagctgcagacagagctgttcctatttggccatcttgccagcaatcaagacacaaattttctgatatcaggaatgaaatagaggatattgctgcagaccccacaggcatcaaaagaataataactatgaacaactgtgtacgtgtaaattggacaaattgcatgaaatggaccagtttatccaaacactaccacagttcacccacaatatattagagaatttgaataaccctatgtcactatttaggaaattgaatttgtaatttaacagtttccaaaaattgaatcttcaggcccagatgttacaatggagtaaaaatgttaaaaattttggagaatattccacatgtttaaggagaatcttccagtcactgcaatctgtttctcaggaagccacagtcctagcagaagggaccacaacaaggtaacaccctgtgggacaaaagaatctgaatagcaggtcttctctcccaggtctctctgctgataggatcagaggtgtccatctgacctgaatagccagaacactgggacaaggttgaggctgtgagttggatagctttcctgcttgcctggcaggggaattgaggtagcttccactcttcacccttataaaacctcagcacatctcattgagagctcctccaacacccttatcaagtctggggtcttagcctaccattatgtatgacatctcacctgccttagctacaactggtgcctatacaggaatatgtttcctcttgacctgaagcctgaatcatcaactcagcaagtataaaaatgggggaaaattaaataaacaaataaagtgtacaccatgagagaaggaaataagctttaagagatccctgccattctgaccccataagaaacagtgaacttgcccacacaccaagaacttaactactaaaaccatcatctgggaaagccagttggaaaagattctctataaataaggaactcatacagagttttcatcctaaaatcaccaagaatcaaactaggctaaaataaacattggcgtatgatccttaagaaagaaaaaaagaagttaaaaaaaaccacagtccaataaaaaataaattcaagaacaatttgattagtctacccaaatgagaaggaagcaggaaagtaattctggtaatatgacaagacagggttctaaatcatcctgaaaagatcctactagctccccagcattggatccaaaccaagaagaaatctctgaagtgccagataaagaattcataaggttgattagtaagctactcaagaagacaacagagaaaggtgaaaaccaacttaaattttaaaaaatcaggatataattaaaattttttcagaggaatagatatcataaaggaaaaaacaatgagagctactggaaatgaaagacacacttagggaaatacaaaatacagtggaaaattttaacaataagctagaacaagtagaagaaagaatttcagagcttgaagacaagactttcgaaataacccaaacagacaaatacaaataaaaaagaatgaaataaatgaacaaagtctccaaggaatatgggattatgtaaaatgaccaaacctaagaataagtggtgattctaagaaagaacagaaatctaaaagtttggaaaacttatttgagggaataattgaggaaaacttccctggccttgctagaggtctagacatccaaactgaagaagtcaaaagaactcctgggaaattcattccaaaacaatcatcattaaggcacagggtcaccaggttatctaaagtcaagattaaaaaaaacataattttaagagctgtgagataaaagataacctataaagcaaaacctatcagattaacagcagatttctcagcagaagctttacaagtcagaagggattggagtcttacctttcacctcctgaaacaaaataatgtcaccctaaaattttctatctagcaaaactaagcttcataaatgaaaggaagataaagtcttcttcaaaaacaaatcctgacagaatttgccacccccaaacaagcactacaataaatgctaaaaggagttctaaatgttgaaagaaaaccttgatatacaccaaaatataaccttcttaaagcataaatctcacagggcctataaaacagtaacacaatgaaaaaaatccaaaacatataggcaacaactacatgataagtacaacagtacctcacatttcaatactaacatcgaatgtaaatgggcctcaacgctacacttaaaagatacataatagcagaatgaattaaataaaccaccaaccaagtatgtgttgttttcaagagactcacctaatgcataaggactcatgtaagcttaaggtaaaggggtggtaaaaaatattccacacaaatggaaaccaaaagcaagcaggagtagctattcttatatcagacaaaacagactttaaagcaacaacagtttaaaaaaaaaagacaagcaaggacattgtataatgataaaaggattagtccaacaggaaaatatcaccatcctaaattatatgcacctaacactggagcacctaaatttataaaacaattggtactagacataagaaatgagataaacaacaacacaataatattggaggacttcaatactatacttacagcactagacagatcatcaagacagaaagtcaacaaagaaacagtggacttaaactataccctagaacaaacagaattaacatatatttacaaaacattatttccaacaactacagaatatgcattctttttttcagtgtatggaacattctccaagatagaccatatcataggtcacacaacaagtttctataaatttaagaaaatcaaaattatatcaagcattttctcagaccacaggggaataaaattggaaatcaacttcaaaaagaaccctcaaaactatagaaatacatggaaagtaagtaatctgctcttgaatgagctttgggtcaacaatgaaatcaagatagaaatttaaaaattatttgaaatgaatgataatagttacacagcttacaaaaacctgtgggatacagcaaaagtggtgctaagacaaaagttcatggtgttaaatgcatcaatcaaaaagtctgaaagagcacaaatggacaacccaatgtcacacctcaaggaacaagggaaacaagaacaaactaaactcaaacccagcagaagaaaagaaataacaagatcagagcaaaactcaatgaaactggaacaaacaaaaacaatgcaaaagataaatgaaacaaaaagctgattctctgaaaagataagcaaaattgatagactgttagtgagattaaccaagaaaagatccaaatgaactcaatcagaaatgagactggagatattacaactgataccatggaaatacaaaagataattgaagtgtactatgaacaccttttcacacacaaactagaatgtgtagaggatgtggacaagttcctggaaatatacaagcctcctagattaaatcaggaagaaacagaaaccctgaacagaccaataacaaaaagcaagattgaaactgtaattttaaaattgccaacaaaataagttcagaaccaggtggattcacagctgaattctatcagacattcaaataagaattggtaccaatcctactgaaaccattccaaaagacagtaaaagaagaaatcctcattaaatcattctatgaagccagtgtcaccccaatacccaaaccaagaaagaacacaaccaaaaacgctacagaccaataccctgatgaacatagattcaaaaatcctcagcaaaatactagctacccaaatccaacagcatattaaaaagataatacaccatgatcaagtcagttttatcatagggatgcaggtatagtttaacatacacaagtcaataaatgtgatacatcacataaacagaatcaaaataaaaaatcatatgattagctcaatagatgcagaaaaagcatctgataaaattatcccttttttataaaaacactcacaaaaactggcatagaagagacatacctcaagataataaaagccatctatgacatacccacaggcaacattatactgaatggggaaaaattgaaaacattccccgtgagaactggaacaagacaaggatgcctattgtcaccacttctattgaacatagtactggaagtcatagccagtgtaatcagacaagagaaagaagtaaagagcatccaaattggaaaagtggaagtcaaaatgtcactgtttgccaatgatatgatcatatgcctagaataccctaaagaataatccaaaagctccttggcctgataaacgaattcagtaaagtctcaggatacaacatcaatgtacacaaatcagtagcactgctatataccaacaatgactaagctgagaattaaatcaagaagtcaacccattttacaacagccgcaaaaataataataataagatatttagaaataaccaaggaggtgaaagatatctgcaaggaaaactacaaaacactcctaaaaaagatcatagatgacacaaacaaatggcaacatattccatgctcatggaggggtagaatcaatagtatgaaaatgaccatactgcccaaagtaatccacagattcaatgcaattctaatcaaaataccatcatcattctttacagaacaagaaaaaagcaatctaaaattcatatggaaccaaaagagagcccacatggctaaagcaagactaagaaaaaggaacaaatctggaagcatcacatttcccgacatcaaattatactacaaagctataagctaccaaaacagcatggtaatggtataaaaataggcatgaagaccaatgaaagacaatagaaaacccagaaataaggccaaatacttacggccttctgtaagtattgacaaagcatacaaaaacataaagtggggaaaggacaccctattcaataaatggtgctgggaaaactggcaagccacatgtagaagaatgaaactagatcctcacctctcaccttatacaaaaattaactcaaaatggatcaaatacttaaatctaagaactgaaactataaaaatactagaaggtagcattgggaaacttttctggacattggcttaggcaaagaattcatgactaagactccaaaatcaaacgcaactaaaacaaaaataaataaatgggacctaattaaactaaaaatcttctgtacagtgaaattatcagcagagtaaacagacagcctatagagtgggggaaaatatttgcaaactatgcatctgacaaaggactaatacccagaatctacaaggaactcaaacaaataagcaaaaacaacaaaaaaaatcccatcaaaaagtgggcaaaggggcaggtgcagtgactcacgcctgtagtcccacaactttgggagtccaaggaaggcagatcactggaggccaggagtttgagactagcctggccagtatggcgaaatcctgcctctactaaaaagaaaacacaaaaattagctggcacggtggcttatgcttgtggtcccaggtatttgggaggctgaggcatgagaattgcttgagcctgagaggtggaggttgcagtgagccgagatcatgtcactgtacctcagcctgggtgacagagtgagactgtgcttcaaaaaaaaaaaaaagaaggagaaagagaagaaaagaaggagaagaaggagaaggaggaggaggagaaggaggaggaggaagagaagaagaagaaggagaagaagaaggagaagaaaaagaagaagaagagaagaagaaaagaagaagaaaagaagaagaaggagaaggagaagaagaagaggaggaggagggggaggaggaggagaagaagaagaggaggaggaagaagaagaagaagaagaagaagaagaagaagaagaagaagaagaagaaggagaaagcaggcaaaggacatgaataggaaattctcaaaagaagatatagaaatggctaataatcatatgaaaaacccgcttaacatcactatactatactacaagtctgcagtaaccaaaacagcatggtactagtaccaaaacagatatatagaccaatggaacagaacagagtccttggatttaatgccacaaatctacaaccatctgatctttgacaaacctgacaaaaacaagtgatgtggaaaggattccctatttaataaatggtgttgggaaaactggctagccataagcagaaaaattaaacaggacaccttctttacaccttatacaaaaattaactcaagattgattacagacttaaatgtaagacctaaaaccataaaattcctagaagaaaacctaggcaataccattcaggacataggcatgggcaaagacttcatgactaaaacaccaaaagaaatggcaacaaaagccaaaattgacaaatgggatgtaattaaactaaagagcttctgcatagcgaaaaaaactatcatcagagtgaacaggcaaactacagaaaaaatttttgcaatctatccatctgacaaaagtctaatatccagaatctacaaggaacttaaacaaatttacaagaataaaagaaagaaccccatcaaaaagtgggtgaaggatatgaacagacacttctcaaaagaagacacttaagtggccgtcaaacatatgaaaaaagctcatcatcactggtcattagagaaatccaaatcgaaaccaaaatgagatactatctcacaccagttagaatggtgatcattaaaaagtctgtaaacaacagatgctgattatgtggagaaataggaatgtgtttacactgttggtggaagtgtaaattagttcaaccattgtggaagacagtgtggtgattcctcaaggatctagaaccagaaataccatttgacccagcaattccattactggatatatacccaaaggattataaatcattgtactataaagacacatgcacacatatgtttattgcaacacagttcacaatagcaaagacttggaaccaacccaaatgcccatcagtaatagactggataaagaaaacgtggcacttatacaccttggaatactatgcagccataaaaatggatgagtttatgtcctttgcagggacatggatgaagctggaaaccaccattgtcagcaaactaacacaggaacagaaaactaaacactacatgttctcactcataagtggtagttgaacaaaaagaacacatggacacagggaggggaacatcacacactggggcctgtcggggtggggggctagggtagggatagcattaggagaaatacctaatgtagataacgggttgatcggtgcagcaaaccaccatggcatatgtatacctatgtaacaaacctgcatgttctgcacatgtgtcccagaacttaaagtataataataaaaaaaagaaagaaaaatttgataaattggacttttaaaaaaaatttaaatactcttccaaagaccctttcaaggtgacaaaaaggcaagctactgcgtgggagaaaatattttcagccacatgtctgcggaaatactcaaatctagaatatataaagaaatattaaaactcaacagtgagaaaacaaatatggttgtccctcagtgtatataggggattggtcctaggcctctacctgtaccaaaatttgcacatatccatactcaatcttacagtcagccctgggcatacaaaaagtcagccctccatatatgcaggtattacatcctgtgaatactgtatttttgatccatattttgttgaaaaaaatccatgtacaagtgaatctatgcagttcaaacccatgttcttcaagggtcaatggtaatccagttagaaaatgaaccaaagacatgagcagacatttcatagaaaaggatatatggatggcaaataagtatgtggaaaggtgttcaacatcaatgggcattagggaaatgcaaattaagatcactttgaagtatcactacatatttattatgatagttaaaataaaatagttggccaggtggagggactggatcactcatattttgctggtgggcatgtgaaatgatacactctggaacagttgggcagtttattgaaaagctaaatgtgcaattatcatataacccagcaattgtactcttggatgaaaacttatggttaccataaaacttgtacatggatattcatagtggctttattcataattaccaaaaattagagtgagtctagatgtcctttaatagacattgtttgagattgccattgcatggtggtaataaagagtagaccaactttagttggttttatttttatattttaattttctacacacagcatacccccttattgtcttcaccccagggtagactgttgttactgccctgcacttgatgcaccactattgaaagatattaatggcaccatcaaagcctgcagtgacattgttgtccctccactaaagcaaggaccaggcttccctcagagaaactgactttacaaatagtaaatagaggctctttctgaaacctatcttcgtaaacatatttccctctcctaacaaggagttttggcccttctgccctttagtcagggtcttggtccttggtatttcttgccacagcaggcaatagacaaaggctcccaaagaccttggatggaggcagacattgtggctatgtaccttgtacccaaaggattaagctgccatcttgctggtggcagcccttcaccccagagagaggaaatgccactggtgctttgaggaaggctttgtgcctttgattttccatgtcaagtcagcacttaactgtgaccctggacacatgaggtgaaaaatctttggtttattttggcattaatgtctcttgcccaataacatgggtttctgtaaacagaagtaggcatggagggaggagggaggattacataaaagggactcatccaagcagggctagctgcactatgctgatttctattaaatggcaatgggagataccctcttacccctgatttcagttagtggtagttactttcatcttaatcgaattaattacaaattgggaaggcttgggtcagcttcataaaatgctgttatttatgttgacatttttatgtggctttagctaatatatgttttaattttagattcagggactacatgtgtacatttgttatatgaatatgttgcataatattgaggtttgggcttctagtgtacccatcacccaaatagtgaacattgtacccaataggtaatttttcaacctttattcccttcccattctcccactaatgattattattttaatctcagtaaccagcaatatacctggccactcatgcatgtgcacacacacaaaccctatttgctgtagtggaaaccactctggtgaaggagatatccatggtggaagagttgggcagagtggagaaagaaggaccctatcatttgttgactgcccaccatgtgccacatactctgcttggtgactttacatgtcttagctcatttaatcctcaccacataatgtgtaaagtagatgctattattattcctgtgttactgatgaggaagccaaggctgagggaagtgaagtgagatgatcagataacgtcactcttccggtgcttaaaattataaaattccccttccactgaggataaaagtcccaactcgtcccattctccaagctatgttttagggcctgtcaacctccctagttttatctaggcccctctccctcttgcagtaggtgctccagccacactgctcttcactcagttcctttaatgtgccatattcttcttctgtggggccattactcatgctattctttttgtctggactgttctcctgtgtgcccacctgcactcaccagcgaactcctattgattcttcaggtctcagcttagatttcacatcctcagttctcagggaagcctcctctgactgtcccctttaccctatagtgtccctcagactatgttaggtccctttgttgtatccttctatcacattctgcatctcctccctaccactaatatgattttacatacaaccttgtgttcaggatcgattttcttcattagatgaaacttgctgtctatatactgtcttgttctctgctctatccctagtacctagtacaatgaatgcctggcacatgataagtattcaataaataattattgactgaatatatattgaaaccctctataattaatacatagtaagtgctcaataaatatagttaaaatacagttgttattattgtccaaaagcaaatagttaatcagaggcagaaccaggatttataattgaagtctgagtctaaagcgcatgcttcttttatgatatgactttgtctgcagaaataggttcttggcccagcactgccctaactggttgtatgacacttagggtgagacactatactactctgaatcttagttttcccatcggtaaaatggttacaggagcaggcaaagttcaggtttatcttcacgtaacctagaaaaggaggagaatagaagtctagatagatggggatataagcaaataagtaattaaccaatacaaatcagtatcttccctctgcaagacagttgatgagctataacaagaacccttgatgtttttatgcccttcagcctggtaaccctgttcaaaggcaatatagagtagtggatggtatggatggtatgtaggctttggtgttagagagccctggttcaaatcccaacatccaatttactagctctgtggtactgggcaagttaccaccctgaacctcactcaattcccttctctacaaatgggataacacccaccttttaacccatttctaaggttacaaaaaaaaaaaaaatacaataacatgaaaagatgttttcttagtatagaaagagaaacttctcccaccatcctacccacctaacagttctttctgtagttctgtgccattgaaggctacctcttgaggcaagaggcacaggcaatgtcaagaaaagagagactgaagacaagcaggctgatggcagaagccagagtccagtgtgtggagttggatcacccataggatagactggggcagaggggaagatcagctactgagggagaagaaaggagactacaaatctgagtaaggggataatggctaggcagatcctgagaagcatggtagggagccagtgggaagacaacaacatgccttagagggtacccctttcaaaactttgtagccctttcccagaggcaggcttcaaattatgttattaaaggcccttgaaactgtgtttcttccaaatctttttcttatttagtcacatccatgtatgttttgaaattgtaatcttagtgtgtacactttttcagcgagtatcttatcttcaacattttctatgtcacaagtcttcagtggctgtcaaatatcctaattttgctgaaagcccagaaagtacacctctgtgtattaactttttgcttccttgaattacctccttaaaatatattcccaagtataggattcctgagccacacggtatacaattgggatttaatgaccaaaaccaggtttttctttttctaagaaagaaattacccataatatcctttccccttccttttctggaactgataaacacaccctctagagttgtgctgtctaatatgacagccagtagccacacgtggctgtttaaattttaagtttgattaaataaaattcaaaactcagttcctcagtagcactggccacatcacaagtgctcagtagccatatgtgcatagtggctattatactggacagcacagatacaaaacatttccatcactgtagtaagtttattggacagtgcttacttagagtttctcaagagatcatttttggtttcttgggtgggagttctttgtgttcaggactttcctgggcattgagaggctatttagcatctctggcccatgtccactaaatgccagtaacacatttccttgagtcaatctaacagccaaaacactccatatttgcaaatgccccataagggaacaaaattaaccccattcgagacccactgagcttttagagggaaacatctcctaactttttcttgagacaaggtcttgctctgtcacctaggttggagtgcagtagtgcaatcatagcttaagcaatcctcctgccttatcctcctgagtagttgagactactggcatgtaccaccatgtgtggctaattctttctttctttctttctttttctttttctttttcttttttttttcttttttctttttcttttttttttttgtagatataaggtctcactatgttgcccatgctggtttcaaactcctgggctcaagtgatcctcctgcctctgtcttccaaattgctgagattactggcatgagccattgcacctggccttcttttttgagatggcctcaggttggctctgcctggagagggggaagcttgtaaagatggcttagaaaaaaagtcctggctccatttctattttctcccttcttttgctggcctgtttcctgctttttgcaaattgcaggaacaagaccctgcagatggagaagatcaaggctcgtttgaaggctgagtttgaggcacttgagtcagaggaaaggcacctgaaggaatacaagcaggagatggaccttctgctacaggagaagatggcccatgtggaggaactccgactgatccacgctgacatcaatgtggtacgtggctgcctggagcctatctctaaagcctttgagaaagaggtagtggtgaatgatagggcctttccttgagatgtggcttaggcctagctcggggagcaggcatcagtgcaggctgtggtagagcagaagaattcaggagttctgagatccagccctggctctgtcactaactgactatatatcactggacaagtcccttctctctgggcctcattttccctctctgcactataagggggactcagtaccctctaaatgtactgatttgatgtgctctcattctgggattctgggagttgagagctagccttggggaaaagcagagcaggcagctgcctctggaatgtagtttaaagcactccaagctttcagtcagaccaaacaaatcatttctgcctgctaccaaagtggagcttcctcattgatatatcctttggaaactcttggaacacagaatatgaactgtctgctaaggtggtaagctcccctctttggaattattcaagcagcatcttaatggacacttgtatgagctactgtactgatgattccttcacaaggaaggaggttggcagtgctgaccagtaaggtcttttcaaacccttatcacccataaccatgaagaatatatttttaaaatttactttcaaaggaactaagtttatatttctggaaaactcatttctgtggcaatactcattttctgatgttgtcagacctaggatcataaaggaaatatgaatgaggtttggacagtaagcaattgggattttctgtgttagagatcgcagaattctagatctcataaagtgttgacagtttggctgccagctaaccaatgatacagggccagttaaatgaggaagatatttgccagaagggctaagaatataagccagtggatctcaaacttgagcatgcatcaaagccactttgagagcctaagacacatattgctagactccacccctgattttctgattttgtatgtctgaggtgaacctaagaatatgcatttctgagttcccaggtgatgctgatgctgctgatcccttggccacattttgagaatcactgatctaggagaaaagactgctggcctgggaggcggaagccctaagtctttatgcaggatttgatactaagaagtatttccccaggaaagtccctttttctctttgagcctcagttttctataaaatgggagtaaggtggactaaatgagctctgaaggacattccagctctaagatactatatttgaacaataccatttatttagcagtaaatattaatttagcccatttactgagtgctttatatgaatcctatcattacatcttcaccaagattgcatgagttaagcactagaatatcaccattataccgatgaagaaactgagacttgaccagagttacatggagagggcatgggagatcaaggacttgaatatagactgaacaagttctggagcttgtgctattattcactcagctatagatcctctctgagaaccttaggatcttttctctgtgcctatcccactctatgttccagatggaaaacactatcaaacaatctgagaatgacctaaacaagctgctagagtctacaaggaggctgcatgatgagtataagccactgaaagaacatgtggatgccctgcgcatgactctgggcctgcagaggctccctgacttgtgtgaagaagaggagaagctttccttggagtaagctacctgcccccagtccctacaacataccctccctccgacccacatacatacttacatacctacacacacacgggcaggtatacatacacaaagcctagcctgaaagtcagagtgcctagttttagtcccaggcctttcagtggcttactcactgtgtgatcttgggcaagtctctgtgccagcttgttaaaacagaaggaggattattaaactggatgaattactagatgaattagaacaactactaggtggctttttaaattctttgtgtgatattgacaatacaagactatgtctataactcttaagagatcatttcccaagtcagggtctagaaggcgatatctagaaacctctaaaaacaaaaaagactgagctttcctggtcttcaggaagtggcctgggacttacttcatctcctggctcagagttaagaactaggcttgccttgcagagagacagaatttgacctggtagaggaaatcatttcctaaaggtagagcaaggtgtctgtggagtttgtgagcttcctactcttagagatatgtcaccagaggccttaggacacttaataggaatactcaaaagagcatgagatagcagataggactgaataccctttaaggatcttgctagccctaagatttcttggtcttcttggcctatcagagctaaggacaaagaggattacccttctcatcagacattgggcctagtacccagggacaatagccttgtgcttgggaaggtgtggggaccttctagaatgagccacagctcaacccttggttgtatggcatggagtctttaagaggagcaaggttctcattgctttcagaatgatctagccagtgtctctcatctccaaagttactttgagaagcagaaagcagaatggcagacagaacctcaggagccccccatccctgagtccctggccgctgcagccgctgccgcccaacagctccaagtggctaggaagcaggatactcggcagacggccaccttcaggcagcagcccccacctatgaaggtaagtgagctgggtaatggttgtggaggaagcaaagtatcctcccatggaagggccgtggaaggctagttctgggtctttggctttatttatgctgggccttcttttaatggcctttgcttgtgacacagtggaaggggtgacatgggtgtgctgtgttggacacacacagcacaggttttgttgccccatgttcccagaggtgttagaatgcagggagattttcaggccctgctagagtgcaattctaaaagttagaaatgactcttacacaaagatgtaatgagcatgtatcataaatgagggaaccagcaggattataaagctggttccaggagcatttggaacaaatatctatatagtcaagaaaggagaggaaggctgaaacaaatttgcaaagttagatgcaaaactggtttacatcccacaggacaataaaactgtaactttatagttactttttcttccaaacagaagtaatttgcatctctactgggcaaaagccatttgcagcttatcagtgtaacatcacagagcctgggtcctaatcaattggtaaatagtcaaacaaagagacattcttctagagcaggggtcatcaaattacagcctacaggtcaaatctaatctgttccctgttttcgttaaagttttattggcccacatgcatgtctgtgtttgcaagctattgcaaacaacatgcatgcaagctattgtctatcacttctttcatgcaaaacagaattgagtagttgcagcaagtttatatgatgtaaaaagtctaaagtatttgctgtcctggcctttacagaaaatgtttgttgacccctgttctagaaaattaaatagtccttaagtgggcctgttagacaatgcttcattataatgacgaaaagatgtgtagttctcattttgccttactttctagttttgtatactttttctcaacaccattctctgaactgggttatgtccttccttcccatcttccatggcatccaagaatacttgagtctactcactgattattgctctcttctgatgggaaatcactttgctttctgggcccctggggaatcagaagtctaagttgttgcctggaagaatctgactactaactttctttttcctgtgtccctcaccaggcctgcttgtcatgtcaccagcaaattcaccggaatgcacctatatgccctctttgcaaggccaagagtcggtcccggaaccccaaaaagccgaaacggaagcaggatgaataaagaaagggagagcacatgaagctttgctaattataacccctcaccttgaccagagtcattgatgtcctgatgtgaaacaacccttgcccaaccccacgaagtctcctatttaatgtgatggaagcacaacccctctctcactttgctcctatttctttctgctcttgggatttctggtttaggaagagatgtggttcaggtgctaaacagtgtgtctgatgatcccttctctcccactcacatttcaacccctgcccttgtttggagctaagggaagggcaaaaggctcagatatgattctctatctcttgtgcctgaggcctggagcctaaggagctgtagggtctgaggggcaggggaggcccatatcttgtttcaggtaaaggacccagtatttcccctccttgtacttttgccttaggttctcaagggacaatagtcttcatgttggattctccaacaggctgggtgcatgtatccccctactcctaccctcatctcatccttaaggcccagaggtagcttggacaagccctccttttcataatcatttgggaggcatggctgtaattctttagctttctccacttctgtctcccacatatactaaaattcttaggtactaggctgtgtgtcttgggatcttaagatcaatgaacctttccccaatatctagtctttgcaaattctagtagaagatttccacagtgaaatcagtgagccagaccaactctacatctcctgcctaacctactgcctaagtcattagggctgagggctcggctgtaggggcttccttaggctgagagtgcccccaggctgacatctgtgttggcttttgttcagaaccattactctggcacatgctcaatggtatattgcagggaggagaggagtagatttagatttgagtaaatgccaatcactttacacatgaaggtgggtgggactttccttccattcatcccttgctctcttggatctgaactcttctggagcctcagctcaggatagctgctggccactcctgtcctgtggattgtgcaggtggcctttcctcccaaaagaaaaggcatcaggctccccaagccccacagctctcctttccaccaaagccaggtttcctggtaaggtcactcgaagataagggatggggatgggggctgactgacaaaaaattttagccccaggtctcagtacctggctggggagggggatatttttccttccttaagtagttttacattgccacagtgtgtatgtgttcactatataaaatgttcctctgctctttgaaagtaagagtgttgtgtctgtacaaatccttttaacatgcattcattggagtaaattctgagtatctactgtgtattggataatacaaaagatgtaatgtcatttacctttctggg

SEQ ID NO: 4653 - DNA, 58693 bp, human
ccccaagcccggaggaggtggctacattgtgtctattgtatcccttggctggtgtatttgtacatctctcgggacgtgaaattgacagtgaaaagtatggcagatgagcaagaaatcatgtgcaaattggaaagcattaaagagatcaggtaagtggcacgttgtccccctccccgcccctctccaacccttcgttgcgggagagggctaattatctattgttgggctgtttgtctagaggagctggaaaggggcccattcaccacagacttgccggagaggtgaggatgggaggggcgctgaggagagttgagagagagagagacctcttgccagatgtggctgagaaagcaaagatgaagaaacacgggtttggtaccaagacagttttattcttctcgaggtggaggtcagggctctgcattcatggacacgttttttaaaagtacttgtgtgccccaaggtgtctttggctccttgctctttaggagtcgggatttttttccagtctcttgttcaacttcagaacctggagttcgggaaaggcttttgagagccaagtctagcgcatcggggctggtggctgctgccaggggctgccaactgggggttgcagaggaatctcagcgggcggagctgggagaatggcgcgcgctcgttttcctttcactcactcgccactttcttccttcctatcccgcgcttgggagggggatgggagcaatggggactggggacgcggtcgctgcgctgatggtgggatcgcgacagctgctctgaggagctggaggtgacaggcgggctggcaaagtgggagttgccgaagtggagtccgctacacggttgctcctggagcagcttttggcaaagcgatgatattgtccttgctcagaacacaatagcgccaggcgggctgtgtgggctggcacaaggtctttcttcacctcgccttctcagcgtgagcccctgctttggcttttgctctcactctgagagtggcctgggtcaagctctctccctggagtgttttctgagaacccaaggtggaagatgtcaagtgtgtttctttaagaaataagactttgatcatgagatttaacccttagagtgctggatgagacctacacatggtgattagtggtggtaggtaaagcaccttggtttcttcttcttcttgaggggttgcatctctctttctacaggagaggtaaaggaagggaactatcatttattgagtcccttcccgcccctgtgtgccaggccctttgacctacttttgctcattcagcaagagtcctgtgagcttcctactcctcctttacagctggggaaatagaggcccagagaatttgagtgattttcccacagccacgcagcttgaaattgccacattttgttggtctgcctgcaaaggtattccttttcccactatgtcccaggtaaagtctggaaaggagaagggaatatgttgcaattttttttttttttttttttttttttggcaaaagcatcagaagctagctagaaagtgagacaccttagtacagtagaatgccagctgtcataacgatgcagctagtcagaagcttaggcttgcaaatggagagcctagacttccactctcaccaagcttcaaaggaaccaccaccccatgcccagagaaggaccagttgtgagcaaggactttaatccccagtgaaaatagacctctcccagtgaagaccatatggagaaccatgacttctacccttaccagtggtaactaggagtttctacctcaaccagctaggatggaatcagcataggcccagagagaaggccaaactttcacctctaaacagcagtaacaaacagcccttctccaaactggatgtcaagagacagtggagaaactggacttctactgtccctcttccatccaagagagtggtagaggactgctaaaacaaaagatttaaataagatccagagtatccaacttttaatcaaaaatcactttccatactaagatatccacttgaatgagaagagaaaataaacagatgccaatactgagataacacccatgttagaattatctgataaggatcttaaagcacctgtcctaaaaacatttcagtgagcagttacaatacacttgaaacaaatgataatgtagaaaatctcagaaaatgaatagaaagtctcaacaaagaaatataaaacataaagaagaacaaagtgacatttttagaactgaaaaatacagtaacataaaaaccccaaaaaactcaatggataggttcaacagtaaggtggagaagagagagggaaaaaatagcttacaaatataaaacaatagaaatcactgtggcactataacaaaagctttaacatttatgccaacaaattcccaggagaaagagggcaggattggaaaagtattgggaaaaataatgactaaaatcttcccaaattgtgcaaaagacataaacatttagattcaagaagaggagcaaacaccaacataattgacacaaagaaacacactccaaaacacattgtaatcaaccttctgaaaatgaaagaaaaaggaaacttcttcaaaacagctgaagagaaacaaaagctacaaaggaaaaaaaaaattagaatgacagatttatcatcagaaactgacgatgccctagcattttgtaagtgctgaaggaaaagaagtgacaacccataaatctatgtccaataataatatccttcagtattgaatgggtaatcaagacattctccaatgaagaaatactaaggaatttagatataccctaaaaaaagatgatagtaagctctgaaaacagaaaagaaacaataaacagtaagcaaaagcatggttaatgcagtagactttctctttcctcttgaaatttcttgtattttgataattgaagctaaatttatactgttatctagtgtggtctcagcatatgtagaggaaatatttaacacatttatattgtaaactggggaatgtaaaggggattgtaaatgtaaagagatgtaaaggggaggacatgcttctacacttcattcaagcatgtaaagtggtaatgtcagaagactattaaataaattatgtatacataatatattactgagagaaaacactgaaaatgctatacaaagaaatgtactcaaaacattataaataaatcaatatgaatttttaaaaaatgctccagtcacccacaggcaggcagggcaaagaaaatggagaaactaaaattacggagaatgaacagaaaaaaaaataaaaaggcagacttagccttcatgtatcaataattatgttcacaacaaatagtctaaataccttgcaaacattaatcaaaataaagcaggaatggccatcttaatatcaaataaaacagacttcagagcaaagaaaattcctagagatggatattacataatgaaaaatagtcaatctaccaagaagacataacaattccaaatgtgtgtgttccaaaagtgacttaaattaaactgcttttgacaattttacagtaatatacaaaggttaagccacttggtttaagaatttaaaatggagaaagtactataaatatatacttgatgttcacatatggacagataaacatgtatgagagatagaaataaggaaggagcaaagggtcaaagaaactgaagaaaggaactaacatttgtcaagcaccttttaatttaaaagctcctggctcatttactctttagtcttcccaaaggaaatctgggataggaattattacccccactttacggataaggacattgaggatcagacagattaggcaactttcccatggttacacagctaggaaagaaaaaataatatatcctcctattcacatggcatgcacatttcaatgttattaactgcccttacaaatgctgattatctgattaaccattattcacagttcttcaactgctataatcctaaatctcctgaagtataagcatagcagcatatttctgttaaagaaataatgtttgctggacagaagcaggaatgatgacagcagcatcatctaatgacctattgaagtcaagctaagagccttacacacatcaagacacgagcccagaaatatatgcattcatactcagcactcacaccaatggcagaatttgcagtgggaaaaacatcagaagcagattctcccaccacagaccattttctgcttctaactctgaacacacgcctacccctgtctttcctcccaatcccaatcacactcccacattatgttcccaacctcagcctccaaatcctacactaatctattttgcccatgttttccttggacttttaaatggtgatgaaggagcatgtagataagtggaagaagagagacaagaatggaacaaaagaagggagatagaaaagagggaaagggaggatagcagtaataaaacagagacagtgagtacaggcaccattaaatggaccagagccctacaccagctccccaagtacaaaacaatatttccttaaaatgcacatgccatccattcatgtgtattgcgtacactcacaccccgatgtacacatatccatacacaaagagctttcctcacttgaaaaaaagaaaaaccattttggaaggagatgttgagttaagtaggtactcttaaatgaatgtttctcgactgggtccttcttttctttttttctttctacacactcttttgagtaaattcctgtacttccatggcttcaaatattatcctccaaatctccaacctctataccccacccacattcatgctttagcccatacatatgacagcctactgggcttgtccgcctggaagtttcacagataaatctcagctttatatctacgtctcttcctacagcaatcaagctcctccccttaaacctttggtttaataccaccattctctgcacagttacctcagatggcaatctgaaagtcaatgttgactcccctttctctttaatgactcacctgcaatcacttagttaattctatttctatcctgaatatcttacccaatacctgccccactctccacctcccagttcactgctccatttcaggccttcattatgaattggcatggatatttgtaatgcagtatccatttccatctgaagaattacttccctgtctacagtctctcctctgtctgcaatggcatccacattgccttgagaactaccttcctaaagcatggttgttattttatttctcaaacatcttcactaacttttcattgtgtatgacaatctttttgaaaaatacaggctgcgtcccattattagctcataaaaagaatttagttggtcactagtagcatttttaaaaaaccttttttaaaataaaaaggaaattatcaacatacattgcatatgaagtagtaggtatactttggagaaggttttgtttagttttaaatatgtgtatgtgtgtattgtgtcatgaggtgaaattcatttctcacttacgtcatttcttactgtgtctctgttgaacacacatttacctatcggtgtttccatggcattcatgctgcctccccggaaatctgtcccatacccactattctgaccttatctgctactgctttttattaatcctatcctttagccatatagaagttcttactgttttatatatttccgttccaccagacctttgcctctgcagattcctcgttctagaatgccactctcccattccaagcatctaaatcctactcatttttcaaggaagacccatatgaaatgcctcgtcttctccaaaaccttctcgagttccccagtcaaaatgaattacaataccccaaccacagactccacagggagatttattatagcactcaagttatcccatctaatgatggaattttgaattgatatcctcccttccttcctcccttccttccttccttcccccctccctccctccctcccttcctctcttcctctcttcctcccttcttcctttccttccgccattggtgtggcagtcttggtaagctcctctgttacctggcttggggattgactcagaaccagtgcttactcaagaccaaggcacaggacaactggaacctctgggacttgtggatgggcaaattaagccaaacaatgctggccacaggagagactgaaaaggtgttggcatttggtattgagatgtaagaaagttatcagaatgaactgttataagaaatctactttgctgacagtagctttgtttccagttgagcaaataaatattacatggaagaatgcttagtacttaggcaatattctcaccagactggagtaagcaggaaaaactagctcctttgtgttcattcagtgacatttactgagcataaatctgggccataatcagggctgggctatcctttggtggcccatcacttaggataaataagacccatcagaaggatcttctaatcaaagtcaatagctctgatctctcccttgagttccagactcacatatctaactgcccatttaacttacacccttgcatgtatcactggcatctcaaacaggccctcaactccagccccacccctaaacatttttatttcccagtcttccccatctcagtaaatgcctcactatgctgaaatctggaagccattctttattcctctttttatgtgaccctctccatccacaccattagcatagtggttattatacttgaccatgcaggaggttacacctaaagggcttttaaatcattgattgctgagccccatttccagggtctctgattcagtagatatggagtggggcctgagaatttacatttctaacaagttcccaggcaatgctgctgctggtggtgcagggactacatgtggagaacaactgcattagtaagacctggccagttatacctatacaatataatctggaattgtccacttctcatcatcccctcaacttattaacaaataccagcacttttccatcaatctccagtaaacagtatcttttcacctaattttcccatcttcaaggcctacaggtcccagctgtcctaccctgctttttgagtgtgcattggggctgagtcacctctgaaactgggtgacagatgagcctgccaagtttgtcccagcaatggatgatccatggccctagaacttctccttctttgcacctgtcctcttccatatttgccagaaagaaatcattgaaaagaaggtatccagctgaatgttttatagtcttggctcaggagactgtctggagaacctgtggcctagcagtctgctatgatttgaatgtaccccaaatttcatgtgttgaaacataatcctaccattttgatggtattaagaggagagacctttcgggaagtaattaagtcatgaagcctctgccattatgaatggattagtgccttagaaaatgacttggaatgagtttagacccttttttgtacttctgtgattccaccatatgaagacacaacattcactccctcttgaaaatgcagcaacaaggtgccatcttggaaggagagaccaagcccctcaccagacaccaaatctgttggcacattgatcttaaacttcctagccttcggacctgggagaaataaatttttgttctttacaaattacccagtctgtggtattgtgttatagaagcacaaacagactaggacaggagctcaggaatactggtccaaaagttacctaagactgtcatcctggtgactgtagaaaccctaaagtaccctgaaaaccctgtggtttccctgtggttcacgagtcatactagctgtgctttagcctcttggaaaaatctcattaggaaattttatatataaaattgcatctttaatgatctggatggcttcctcacttgtagggccaaacattccacagatttcatctcattgaagcatccaacaattccatgcaaggctacactgagtcctactttccaggtagaatttccaaggtgccaagagattccatgaagtgcactatttcaccctgaaaattgatgactgagccaggacaagaattcaccctactggcctggtttttatggctttaaatccatcatatgatgaaagttccttgttgtgatggaaaggtgatcagatttacaacgctggattttccacttcctgaatttgtcttcttgggcaagtcactttacttctctcagcctcaaattcttcatgtgtgaaaataaagtgaaacatacctgccgatatggttcttatgaagattaaattttgatagcataaaaagtgcctaatacagttgctggaacatagtaggcaccacaaatataatagctattgttattaaataaagcctttcttaacagacggttgctttcagttcctgtcacttagatagattcttaataaatatgaaccaaatgaatgaaatccttgccacccatggtaatgtcttttcttctctgaggctactgatgctataatcactcccctggatttactacctaccattcagtagtttctcattccaaatgtaatgattgagccccgcttatggccaaagcagaatgataggtgttgtggaggttaaagagagaaatatggcatagtgccactgtctagaaagccctcgtgtatataattactctgatttcaagttgcttcatgcataaatctgtactttttagaggacccagaggaccatgactatgtgccttgtgctagtccctttcccatcctggacctttatttattcacctctgaaataaagaggatagatttcatgggtgactttgaaataatgttctgacgagcccagggaattctaaggagggttttaaagggccactgtgatagagtcaggtggtggttgaatttgaggacagattaatgactctgggggtcccacttccactttaaccataacagttatgatttgttccattttctatattggatctcaatcagttattttatttgaaggaagggatcttatcattcatccacaagaaccagcgcacttctggataaatggtgcttgcttaatacaatttttaagtctgcttgattgatggaagtttgtaaagagggaatttggtattgtgagtacatctaagcagtgactggcatgacactctttgtagattagagagaggaagggccttttatttagatttaatcttagctcaaacttctcaattgctggacagagaatggaaggctgggaattagatgcaaatcctgaagaccatagtaaaggcaatctacctcaaatgcaacaaattatttatttatttatttattattaagccattaagctccttctcatttctcctggctgccttaatcagcaaactttaaaaaaatccattccctctacgtaagccttttgacaagtcatttatttttctgggaaaacatgagcatgcttagaagttatgtttagtgggagttgtaggtttagatttaattctgggtgcagtaagaggtcattacaggataatttgagttatattttatataccataggaaacatccatttcaagtgtacaattcagcatgttttaataaatttaaagagttgtacaatcatcaccataatattttagaaaatttccatcattccaaaattagctctttgttcagtttcagttgatctttgttcttatccacagccccaggaaacctgtaatatattttctgtctaaatagagtggctttttcttgatgctgcatataaatagttatacaaatgtggccttttgggtctgccttcagtcacttagcttattgtttttgagattcattcacattgtaacatgtaacagtatttcattcctttttgttgacaaataatatcccattgcatggatatcgcacattttgggtgttcactcacaagttgaggagcatttcagttatttccactgttttggctcttatgaataatgctgctctgcacatttgtgtacaagtctttttgtggaaaaatgtttccatttctactgcttagattctcaggagtgagatttctgtttcatattgtaagtatatgtataactttttaagatacaagtgtttttgaaagtggatgtcctagtttccatcccaagagggagtgtatgagggtcccagtttctctacatcctcaacaatacttgttagtgtctgcctcaaaaaggcattatagccatcctagtggtgtgatgtgatagctcacagtagttttaacttgcatattcctaatgaccaatcttgttgagtatctcttcatgagtttatttgccacccatatatcctcttctgtgaagtgtttattcaaaccttttgttcattttttaactgggctgtttgtttactgattgtgagttttgagtgttatttacattttctggaaacacatttttaccagacacttgatttgcaaacatgttctcccagtctgggacttatcttttcattgtcttaacagtgtcttttgaattacaatgtctttttttttttttttttttttgcttctttgtttgaaacaggatatcactccgccacccaagctggagttcagcagtgccatcgtggctcactgaagccttgaattcctgggctccagaagttatcccacttcagcttccccaataactggactacaggcttgtgccaccatgcctggctaatttttcttaaatattttgtagagacagggtctcactatgttacccagggtggtcttgaactcctgggctcaagcgatcctcccgccatggcttcccaaagtgttctgattataggtgtgagacaccgcactgagccagaaacttttaatgttgatgaagaaatccaatttatcagtattttttatggattgtgaattcttgtgccatttaggagaaatgtttgcctaagtcgtattcacaaagattttctcctatattttcttccagaaattttatttttaggtttcacgtttaggtctatgatccattttcacttaatttttttgtatgttgcaaggtacgggttaaggattttcttttgcatttggatgttcagctgtttcactatcatttgtttgaaagacttgtccttacatctgtgggtttatttctgacctatctgcttcattgctttatttgtgtatctttatgccaatagtttgctgatttgattactatatctttttaataattacggaaaccaggtcatgtaggttctccaacttcattattcttcctcagaaataattttgactattctaggcgctttgaatttctatgagttttagattccccttgtcagtttctaccaaaaaccatactgggattttaataggattttgttggatctgtagattagtttgttagatttcaccagtgtgtaatgaaataatgtcctatttctgttctaggatctaacccaagataccacattgcatttttatgattccatttaacttattttatgacttattagctataatgctgttttattatttcagtggctgctttagagtttataatatacatccttaacttatcacaacctaccttcaattgagcgcataatactgcacatataatgtaagaaacatacaacactatatttctccctttctggcctctgtgctattgcattttggtactttttggtttaaactgttgattatatttttaagtaacttaattaaggaagaaaataatcatgatatttttctatgtagttaccattttcagtgctctgtattcctttgttttgatacatttccctctgctatcattttccttttgcttgaaggactccctttaacatttgtggtagtgcaagtttgctgatgatatagcattttacctttccttgtgtgaaaagttctcattttacctttgttttcaaagttgttttccctgggtaaataattctatattggcatggatttcgtccgtactttaaaagtgatacaccactgtcatcttgcttccaacattctttgatactctttgtgtaacatatcctttgtttctgactcctttactggttttgagcaatttgattatgatatagcttggtgtgatgttctttatggattttatgcttggagcttgatgaatctattggatcagtgggcgtgtagctttaatcaaatttgaaagatttttggccatttattcttcaaatatttttatcttcctctttcttcttggtcttcagttacctgtatttttaattcaatttaatttaatttgatttaatttaatttaatttaattttactgtggtaaggtcacagaacttgagatctaccctcaacaaattttatatttataatacagtattgttaactagaagcataatgttgtactgcaaatctcttgcagttatcatcctgcacaactgaaactttatacatattgaatagcagctctacgtttccccctccttcagttcctagcaactgccattctactctctgcttctaagaatttgactattttaaatacctcatatgagtggaatcatgcagtatttctccttctgtgattagcttatttcacttaggattatgtccatgttatctcatattgtaggacttccttcttttttaatgcttaataatattccattgcataaatatactacattgttaattcattcatttaggttgttttcatatcttggctattgtaattaatgccatgataaacacgggagtgcagatatctctttgagatcccgatttcaattcttttggacaaatacctagaagtaggagtgctggatttatatatttttatatatttattatacctgttggccatgtttatgttctttggaataatgtttatggaactcctttgcccagtgttcaatcgggttaatagcttttgtactattggtttgtaggatttcttatattttatacaaattaatccattatcagatatatgatttgcaaatatttcatcctttatgcagtttgccattttactctgtttattgtttcctttgctgtgcagaaacattttaatttgatgtgatcctacttggtcatttttgcttttgttgcctgtgcttttggtgtcatatccattaaatcattgccacaagcaaagtcttgaagtttttctcttatggcttcttgtaggagttttgtagtttcagaagttatgttcagtgtttaatacatttgtagttaatttctgtgtatggtataagataagggtccaatgttatacgtttgcatgtggacatagtttttcccatagcatttattgaaaggactatcatttcttgcattgtgtattcttgtaaactttgtcaaagatcaagtgactgtatgtgggtggattcatttctgggctctctgttttttcccatggcctctatgtctgtttttatggcagtaccatactgttttaattactgcagctttgtaatatattataaaatcaggggataagattgttctggctacttggagtttacatgaatgtaaaaaaaaatgccattgggatttttataaggattatattgaatctgtagattgccttgagtagtatggttaagtcttccaatccatgaacatgtatgtcttcccatatgtttgtgtctaccttaatttctttcatcaatacgttatagtttcatttattgctaagtattttgttctttttggtgctatcataagtgggattgtgtctgaatttccttttcagatagtttgttgatagtgtacagaaacacaactgactttgtatgttgattttgcatcttgtaactttactgaattcatttattaattctaacaatctttttggaattttttgggttttgtacaaataagattttgtcaactgaaaacagcaataatcttaccatttccttctcaattttggtgacttttatttcattttcttgtctaattgctctggttaggtctctaggatctatgttgaatagaaatgtcaagagtggacatccttgtctttttgctgatctttcagtgttttaccattaagtatgacttagctgtgggcttttcatatatggcttttattgtgttgaggtaatttccttctatttttagttgttgagagtttctatcaggaaagggtgttgaattttgtcaaaggctttttctgcatttattgagatgatcatgtgactgttatctttcattctgttgatgtgatatagcacattaattgacttttgcatgctgatctctcctcacatcacagggataaattccactggccgtgttgtatgatacttttaatgtgctgttaaatcagtttgctagtcttttgttgaggatttttacctgtatattcatcagagatagtgtcctctagttttcttttcttgtggaatcttcatctagctttattattagggtagtgctaggctcataaaatgagtttggaagtgtcgcctcttcacttttttggaaaagcttgaaaaggattggcattaactcttctttaagtgtctgtcagaagccaccagtgaagccagctggtcctggccttttctttgttgggaagtttttaattactgtttcaatctccttactaactacaggtctattcagattttctatttatacaggactcagtcttgccagattgtatgcttataggaatttatccattttttatgttatccaatttgttgatatgtgattcttcatagtagtcttatgatcctttctacttctttggcatcagttgtagtgtgtcatctttcatctctgatttcaattagttgattcttttctattttctcttagtctagctaaagatttgtcaattttgtttattttttcaaaaaaaaccctcttagttgcattaaaaaaatttgattctttatttggcttatttctgctctctcttcattatttccttcaaaactgaccaataaatcacatggttaatagaattattagctgatgacattaaaagttattataaatccatttcatatgttcaaaaagcttgaggaaaaactgaccaagtagaggcatggcagaaataaaaaagattcaaataaaaagtctatagatgaaaactattatgtctaagatcaaaaaatttcttagtttagaaaaagagggagaaaagattagtgaacttccagaaatagtaatagaaatcatcccaaacaaaatacatagggttaaagatttttaaaaataaacagtatcagcaaattgtgggacaacttcatttggttaaaaatacagataaccgtcatttaaaaacaaagaagaacattatgtaatgataaaacagtcaattcaccagaaatatgcaacaattataaatatatatacacccaatatcagaacactgaactatataaggaaacattgacaaactgatggtagaaatagacagaaagacaataatagtaagagacttcaataccccacttttaataatggatggaacagtcggacagaaaatcaataaaaaacagcaggcttaagaaacactacagaccaaatggaccttacagacatataaaacattaaacccaagagcaacagaatagatactcttcctaactgtacacagaacattctccaggatagaacacattaagacaattagcacatcttaacaaatgtaagaagatcaaaatcctaccaagtatcttttctgaccacagtgaaattcaacagtagaaggaaaactggaaaattcacaaatacccatcttaagggttatatttttcctgcttatttgtacatctggtaatagtaaagtgtgaatggatgccagaaatagtgaatttcatcttgttggttgctgcatgtatttgtattcctatacttagtatcagttttatccctataagtcttgctgttaagcatagttaagtggaaccaaagtagtgctttgtctagaagtcatttccccagtactaatgcaaaaccttctttgtattttaatgctttatgaattgtgaagttcttctaccttggctattggaaataggtccatgtgggctctgatcactgtcccctttgggtggttattttcctggccttatgtagttttcttatacacgtgtgctaatcaatatttaactgaataattggtggagttggatcctctgaaaattgagagagtcccctttttttcattaaaaaaaaattaaaacggtgctattgcaatagagttctctttctacataggtctacactctccaaaactcttttctgaaaaattttgataccttggcttccccagagtcatggctccatttttttcaattgaaggagactagcaggctctgactgagtttcccttccctgcagcctagaatatttatctaggcatgaagatatagccatcttagggctcatctaagcctttccatcttttggagatcactgaccttacttgcctgaagtccagtgacttaagtgctattttttcatataattttgtcagtttttttctgtttttagttatgcctgggagggtaaatcaggtccctgttactctatcttgactagaagtgaaagtcaaggttatttctcaaatatggtttcaaaagatcagattttgtcatttaagacacatattttacattcaaaaatgtaaagtcagggtgtgtcttaaaatccattggtgttttaatcatgcttaaacatgtgactgctgttggccaggatacagttgtggtggtgtcgtcagtatctgagcacatgtgaactttgccatgactattcatattgtcttctcttaaactgaattatgtccatggttgccaacatgtactgtccatagttgccaccatgtatttaggttgtcatttaaaatgtcctcaaaaagatttcaccatgattctccatcaaaatagaaagctattttgtatgaagaagaactcagaccagaaaagtctgataaaaataatctcttaaataagtctacattaggtctttcaatttgtataaaatgtaaattttgaattataagaaaacaatttgttatactgtaattggtagcattttttcttagtagtgtacaaaataatgtgtaccttacattcaaaggcatcctagattcaattaaataaaataactgattagccaggatattaataatgctaatctaagaaagtcctaaaataacagtgtttaaaacaagacagttttaattctccctcacattattgatctgggaacaaggtatttgtggtttgtggtggtgtttgatattggggacctaggctatttttatattgttgcttcactgtatacagggtttcgccctcatctatatgattcaagcccactgttgtgtacacattttatccaataggaaaatagcaatgggaatggttcttccatttatagtcacaatccagaagttgtagacatcatttctgcttccataaaattggccagaaagttgtcatatggtcacaaatagctgcaaaagggatggggtaatatagtccttatttcagacaacttcatgcccagctgaaaatcagagggtctattgctatagaaagaggggagaatgaatttggggagacaggaagtattgtgttgtttaagagagaaatgagatcagctcagggtatattctgctacaggtctccaattgggtgccacccccagtaccttcttaattctccatctttctgaatgcaaacacagatacaagagcccttatgcactgctggtaagagtatgaactgttatagccatcctgctgagcaaattggcactgcttaatcaaagtaagaatgcacattacctgggcccctgaaatccaactcctgggataaatcaccccccaccaccaccaaaaaaaaattactgagacaggtacaaggctattcacttaaatgttattttggaggtggggagattgaggcaaagtgggagtctgtccctggaagagtcaacagataaaatgtggttgatagccatatatagaagcaaggaattctggatattaacttgagattgctgtgtgaaaaccatattttggaaattggccaatataacaatttttatatacacatatatgtacatatatacacacacacaaatacacacacacacacatatacaggcatgtgccatataatgatgtttcagtgaacaatacaccacatataccatagtgtggtccctgaagattacaatggagctgaaaaactcctatcacctagtgacgtacccactgtaacatcatagtgcaatgtattactcacgtttgtgatgatactgcactgccagtcatataaaagtctagcatataaaattatctacagtacatgatacttgaaaatgataacaaatgactatgttactggtgtatgcatttactatactatactttttatcattattttagagtgtactcctcttacttattaaaaaaaaataactgtaaaacaggttcaggctggacttccaggaggtattccagaagaaggcattgttttcatattccttgaagactttccagtgggacaagatgtagagttgggagacagtgatattgacaatcctaaccctgtgtaggcctaggctaatatgtgtgtttctgtctttatttttatttttatttttttttatttttgaaacctggtctcactctctcacccgggctggagtgcaggggcatgatcatggctcattgaagccttgacatcccaggctcaaacaacccttccacctcagcctcccaagtagctaggaccacaggcatgcaccaccacacctggctaatttatatatttttttaatagagatagggtcttcctatgttgcctaggctggtctcaaactcctggcctcaagcgatcctcctgccttggcctcccaaaatgctggggttacagacttgagccactgtgcccagcctgtatctttatgtttaaccaaaaagtccaaaaagtaaaaataaataaataaatacaaacatagaaaaaacgcttatgaaataaggatataaagaaataaaatatttttgtacagctgtacagtatgtttttgtgtcaagctaagtattattgcaaaagagttgttaaaagaaaagcttcagccaaattaaatttaaaggaggttaattgagcaatgaatgattcatgaattgggcagcccttagaattacagcagatgcagagagactccagcacagccatgtagtggaagaagatttatagacaaaagggaagtgacatacagaaatcggaagtgaggtacagaaacaactggattggttacagctcagtgtttgcactatttgaacacagtttgaaccctcagcagtgtatgagtggttgaactatggctgctaggactggccaagactcagctattgttacaggcacatactcctaagttacgttttcaatcttgtctacctaataagttaggttatgctttgtcctcatggactcaaatgtagaagtacagtccttctcaggctatatttagttggctttaacaattcctcccttttggttactttctcaattttgagatgttgaccaaaactttagtcattgatgtcactatcaccattgtaaatgtacttatttggtcttgaaacccactggaaaacagtagaacagtgggttttacaaggtgggaacaaggacagagtagagggtacctccttatgctgtaacatcctgtttgcaggagaaaaacaaaatctggtctgttctaggatctatgtgtttccttaaagtcttagtttgattatgtcatatttagtatgagtgactccatgtttgtttggtttggtctgttagggcctaatgcaagagctcagtccaaaacaatggcctcccataattttgttttaaaactctacttttcgggtcaggttcttacttaggtgagggtgtgaccaaaacttagggccttagtgccactctgttaccatcattttgggtttctggtctcagcgtgtaattcataagttaccatgtgttcatggttgcatatttttttcagctcttgtcatcccagttgaagagagaccatttgatattctatagatggctgcatgcaaacatttaaaacttttgagagaatgcagcgcacaagggagactactattatgactattgggaggataacaccaacagtttgtagtatgctccttacccagggttcccataaatcaaaccacttaaaattaaatagattaaagaatgggctaaagagtctactcacttaactaagcagtctttccattaatcccctacaactgaatttttatattctacattttatgtatttctccataggcgacaagtgccagcagctgcacagatatttttccattgagccaatgctattatttagtataactttcacaagagaatttaaagtctgttgtgtagccatagcctttacagtaaaatctgctatagagcctatcatgagggatacatttttaatcattgcttcttttactccaaaccaaggaagaaagatctaacaaatgatgtcctctagaagagtaaaggcctcctcataatgttcactttaacccatgatgtgggttaagaggagtgaaccaatgttccctttctgactgattatgaggcaacgtgtgtaccgttaaagcttcttgtctacattgagccttcgtcttttatctgtcaaagtataaggttatccatgtataaggctggctgcaaaatccttcacaaataaaagtataccccataagtacacacaacagaccctcttttcacttctattcttcagaggcataagcaaggaaaaaaatagttagacaagaatctcatgatgctagagaagtcttgatctttgatcttgggaaaagctattcacatcagagatgccatcttcttctggggagaaacttcccaggttagctttactttaagggcttcactgggtgtacagttccaagagtgtggagggacccttctcagttgtgagattatgaacttaaaattcaaggtcctgaagttttgctgtagtgtggatggcaaatacagcctttctctgatgttctcagaagatccaatttttgggttctagattgtgaaggggttgattgtcctcagtcagtgatccataaaaactttctttacctggtgaaaataccctgtagcataataatctactgttataacagcaaccctcatacatgggaaaacttttatacaaccagaaaacatgcattgaaaatgacaactgaatgaaattcttatacaaaatgtttaaatggcccatcagctaaccaaatgcacctgaaggtttgattgttttcccaggaatatgggtgtgacaaaccaaatattgttcataaactattttaggaatttagaagacaccacattaatatataattaatttggatcattttgtcttttccatgatgagtcacagaatacagaacctttaataacaaaagctttaacgactcaggaaggacaaagtggctgtcctgcttctccatgagtccatgcttaattaacattagacttatgtcctcttgaataccagttatttctccaaattaggtacatagcactgataactggtgggttatcataggtaatttgacttagaccgtggagtttattcaaactgtatacctaaacaatttcagtattggctgattcagcattcaaatctggcagagtattttcttgttattccataactttctgttctacttgggttagtagttttataaaccagtccaccttttcattaaaatttcaggaattcttatccggtccaaatgatatgattttatagaaacctgtattgaagagtgattttcagggacctttcaatcctttcatgaacctcctaaaagacaccatattctaggattttgcatgcttgtgaaatttttcagaaacagcatcagcattaagcaactaactgtggaaatgacttcaaaggattatagttaaaaacacaattaaaaagaaaacttcattctttctgttgtctacaataacataataaccataataatgattaatagcaagcactcaaacatattagaaattttgaaatccaatacaatttttgagcatatatatatataattataaatatatataattatatatatatatataattatatatatatataattatatatatatatatatataattatactttaagttttagggtacatgtgtacaatgtgcaggtttgctacatatgtatacacgtgccacgtaggtgtgctgcacccattaactcgtcatttacattaggtatatctcctaatgctatatctccccaattcccccaaccccacaacaggccccggtgtatgatgttccccttcctgcgtccatgtgatctcattgttcaattcccacctatgagtgagaacatgcagtgtttggtttttcgtccttgcgatagtttgctgagaatgatggtttccagcttcatccatgtccctacaaaggacatgaactcatcattttttatggctgcatagtattccacggtgtatatatgccacattttcttaatccagtctatcattgttggacatttggcttggttccaagtctttgctattctgaacagtgccacaataaacatacgtgtgcatgtgtctttatagcagcgtgatttatagtcctttgggtatatacccagtaaggggatggctgggtcaagtggtatttctagttctagatccctgaggaatcgccacactgacttctgcaatggttgaactagtttacagtcccaccaacagtgtgaaagtgttcctatttctccacattctctccagcaccctttgttccctgactttttaatgatcgccattctggtgtgagatgctatctcattgtggttttgatttgcatttctctgatggccagtgatgatgagcactttttcatgtgacttatggctgcataaatgtcttcttttgagaagtgtctgttcatatccttcacccacttgttgaaggggttctttgttttttccttgtaaatttgtttcagttctttgcagattctggatattagccctttgtcagatgagtacattgcaaaaattttctcccattctgtaggttgcctgttcaatctgatggtagtttcctttgccgcccagaagctctttagtttacttagatcccatttgtcaatttcggcttttgttgccattgcttttggtgttttagacatgaagtccttgcccatgcctgtgtcctgaatggtattgcctaggttttcttctaaggtttttatggttttaggtctaacatttaggtctttaatccatcttgaattaatttttgtataaggtgtaaggaagggatccagtttcagctttctaatatggctagccagttttcccagcaccatttattaaatagggaatcctttccccattgcttgtttttgtcaggtttctcaaagatcagatagttgtagatatgtggcattatttctgagggttctgttctgttccattggtctatatctctgttttggtaccagtaccatgctgttttggttactgtagccttgtagtatagtttgaagtcaggtagcgtgatgcctccagctttgttcttttggcttagggttgacttggcaatgagggctcttttttggttccatatgaactttacagtagtttttttttccaattctgtgaagaaagtcattggtaacttgatggggatgacattgaatctataaattaccttgggcagtatggccattttcacgatattgattcttgctatccatgtgcatggaatgttcttccatttgtttgtatcctcctttatttcgttgagcagtggtttgtagttctccttgaagaggtccttcacatctcttgtaagttggattcctaggtattttattctctttgaagcaactgtgaaagggagttcactcatgatttggctctctgtttgtctgttattggtgtataagaatgcttgtgatttttgcacattggttttgtatcctaagactttgctgaagttgcttatcagcttgaggagattttgggctgacatgatggggtcaatattgtgaaaatggccatactgcccaaggtaatttatagattcaatgccatccccatcaagctaccaatgactttcttcacagaattggaagaaactacttgaaagttcatatggaaccaaaaaagagcctgcattgccaagtcaatcctaagccaaaagaacaaagctggaggcatcacactacctgacttcaaactatacttcaaggctacagtaaccaaaacagcatggtactggtaccaaaacagagatatagatcaatggaacagaacagagccctcagaaataacgccacatgtctacaactatctgatctttgacaaacctgagaaaaacaagcaatggggaaaggattccctatttaataaatggtgctgggaaaactggctagccatatgtagaaagctgaaactggatcccttccttataccttatacgaaaatcaattcaagatggattaaagacttaaacgttagacctaaaaccataaaaaccctagaagaaaacctaggcattaccattcaggacatacgaattggcaaggacttcatgtctaaaacaccaagagcaatggcaacaaaagccaaaattgacaaatgggatctaattaaactaaagagcttctgcacagcaaaagaaactaccatcagagtgagcaggcaacctacaaaatgggagaaaatttttgcaacctactcatctgacaaagggctaatatccagaatctacaatgaactcaaacaaatttacaagaaaaaacaaacaaccccatcaaaaaatgggcgaaggacatgaacagacacttctcaaaagaagacatttatgcagccaaaaaacgcatgaaaaaatgctcaccatcactggccatgagagaaatgcaaatcaaaaccaaattgagataccatctcacaccagttagaatggcaatcattaaaaagtcaggaaacaacaggtgctggagaggatgtggagaaataggaacacttttacactgttggtgggactgtaaactagttcaaccgttgtggaagtcagtgtggcgattcctcagggatctagaactagaaataccatttgacccagccatcccattactgggtatatacccaaaggagtataagtcatgctgctatacacatgcacacgtatgtttgttgtggcactattcacaatagcagacttggaaccaagccaaatgtccaacaatgacagactggattaagaaaatgtggcacatatataccgtggaatactatgcagccataaaaaatgatgagttcatttcctttgtagggacatggatgaaattggaaatcatcattctcagtaaactatcgcaaggacaaaaaaccaaacaccgcatgttctcactcataggtgggaattgaacaatgagaacacatggacacaggaaggggaacatcacactctggggactgttgtggggtggggagagtggggagctatggcattaggagatatacctaatgctaaatgacgagttaatgggtgcagcacaccagcatggcaaatgtatacatatgtaactaacctgcacattgtggacatgtactctaaaccttaaagtataataataataataatcaaaaataaaaaagaatccagagccatcagtgtgctgtattcaggaaacccatctcacatgtggagacacacataggcttaaaataaagggatggaggaagatctaccaagcaaatggaaaacaaaaaaggtggggattgcaatcctagtctctgataaaacagactttaaaccaaccaagatcaaaagagacaaagaaggtcatttcataatggtaaagggatcaattcaacaagaagagctaactatcctaaatatatatgcacccaatacaggagcacccagattcataaagcaagtccttagagacctagaaagagacttagactcccacacaataataatgggagactttaacatcccactgtcaacatgagacagatcaacgagacagaaagttaaaaaggatatccaggaattgaactcatctctgcaccgagcagacctaatagacatctacagaattctccaccccaagtcaacagaatatacattcttctcagcaccacaccgcacttattccaaaattgaccacatagttggaagtaaagcagtcctacacaaatgtaaaagaacagaaattataacaaactgtctctcagaccacggtgcaatcaaactagaactcaggattaagaaactcactcaaaaccgctcaactacatggaaactgaacaacctgctcctgaatgactgctaagtacataacgaaatgaaggcagaaataaagatgttctttgaaaccaacgtgaacaaagatacaacataccagaacctctgggacacatttaaagcagtgtgtagagggaaatttatatcactaaatgcccacaagagaaagtaggaaagatctaaaattgacaccctaacatcacaattaaaagaactagagaagcaaaagcaaacacattcaaaagctagcagaaggcaagaaataactaagatcagagcagaactgaaggagatagagacacaaaaaacccttcaaaaaatcagtgaatccaggagctggttttttgaaaagtacaacaaaattgatggaccgatagcaagactaataaagaagaaaagagagtagaatcaaatggatgccataaaaaatgataaaggggatatcaccaccaatcccacagaaatacaaactaccatcagagaatactaggaacatatattaatatcattcactaaaatataacctgaggaaagttaatttttttgacagtgcttcccgtgtaacttgctatgtcaaataattctgtttacctttcctctgggtgcttaagggtccctctggagcattccaagttagaggtcgcataatataattttgaagctgcaatttgattttgggaaggccatcaaatatggtaaagttttaaaacagtttgatatgatgaaatggaattctaggtactgtaagtcattcatttagccaaaatgatgactcaaaaaatttaagaaggcaaaaactgttagtcattgataggcagaaaccttagctttccaaacagtctgtctcttgtctttcccttcttttttggtagtttattcaaaaggcaaagaaaaatcttttattgtcctttactattgcatgaaaatcttgttcaagagagaaagcaaaatttcaccctggcattagtgtaccatgaatgttaaccctaattcttaagaaatcttatagacaaattgattcaatcttaatcatttggaccataaggtgagattcccataaaccttttattaccctttacaaatttttgttgaagagcagattagtgctctaagaaaaccctgttgtgcttttatttcaatgttcaagttatggaaaaaataataatacctctttaaatttagtcaatatgtttacagacaaaatttgttttacaatattaatttttacgaaccttttacaacttggtgaaacgtttacctttatcttatgtaatttaaaacaatcatttagccctttaatctaggcaaacatttacattcccatgccttcttataatattttaccaaaaatactttttattgtcttcacacaccttgcatataaaacttttttcagtagtctcaaatacatgttataatggtaactctccagaattttaatttttggtagaaaacctggcaagtaagtaattttaattatgtagtaggtttgtatccaaggaaatcagacagaagtacagataaggtgtgactctttcatcatttctgttagacttcactgcttcccaggttaacatttatgcatgtgttagccagaggaactcagttcttcagaaattaaaaattaaatttgtacctaaaatattggctttgctctcagattcccctgatgaacttagccaatgatttttcctacctaagtgtgcacaaaaaaaaatgtgaaacaaaggggtagaacgtaaaaatcctcatgaatatccagaagccaattttttttcaatttctacaatattgccatttactgccagtttttttctgacccagtcaggtgtaagagccctctaactggatccaagccagttaatcactggaacgaatccaatcctggaccaagtccggtttctatagtgacttataaaccaagtttggatgagaaattcgcccaaagaaactcaaagagctcaaaacacaaatccatgaagctccaaaacccaaaagagaacttaaccaagatctctagctcctctgatagatcaaacgacacaattgggtccttgcagttaccttgcttgttcactcagtgctcctgggggtcgttaaaagttctacttcagatgccacttctgacatcatctgttaaaagaaaaaaatcagccaaattaaatgtaaaggagtttaactgagcaatgaacaattcatgaatcagacagccatcagaatcacagcagattcagggaggccagcacagccacttcatggaagaagatttataaacaaaaaaaaaaaaaagagaagtgacatacacaaattggaagtgaggtacagaaacaactggattggtcacagctcagtgtttgcattattcacagtttgaacactcagcagcgtatcagtggttgaagtatggtttctgggattagccaaggctcagctattgttacagacacatactcctaaattaggttttcagtcttgtctacgtattaaattaggttgtggttcatccacaaggactcaaatatagaagtgcagagtctttctcagccatatttagtttgcttaacagagtaaaaatgtttttaaaaagtttaaagtttataaagtaaaagcattacaataacctaattttaatttattatggaagaaagacatttttaaagataaatttagtttagcctaggtatacagtctaactatagctggagtcttcaacatacctctatcaacatttgataaaacaagccagaaatcatcaaggatatagaaccatcaccatcaaccagcagaatctcattgacatttatagaacacttcacccagcagcaggatacacattctttgcaagtgctcatggaacatataccaaaatagatagaccatttcctgggatataaaataatccccaacaaatttaaaagaacagaaatacagaaatgtgttgtgtgacattaataaaatcaaactaaaaaccagtaaaccagaaaaaattaccagaaaaatctacacacgcttggacactaaacaacatatatctgaatgatgtgtatttcatagagagtctcaagaaaaataaaaatacactaaactgagtgagctgaaaaatatcaaaaattgtgagatgcagtaaaagcagtaatgaaaaaaattaacagcactaaatgcttacattataacagaagagatgccttaaaacaataatctaagctcccacttcaagaaactcgaggaagaagagaaaaataagatgaaggcaagcaaaaaacagaaactaataaaggtaagaacagaaatcaatgaaattgagactagaaaacaacaaagaaatgaatgaaacatttatatatttaaaacaacatatacacatttcatgcacattacctgtgctgtgaaatcccactcctgagatgaatccctggttgttttaagaatctatctatctatttatctatccaaacatatatatttcatatatataaaacaaccagggtttatccccagtgaaatttatatttaaatagacgtgtgtgtgtgtgtgtgtgtgtgtgtgtgtgtgcacgcatttaaaacaaccaaggggtttttccaagatggctgaataggaacagctctgatctgcagttcccagcaagaccaaagcaggaggtgggtgactgctgcatttccaactgaggtacccggttcctctcgttgggactggttagacagcgggtgcagcccacagagggcgagcagaatcagggtggggtgtcaccttacccaggaagtgcaaaggaccagggacctccctgttctagccaagggaagctgtgaggctgtgctatctgccccagatactacgcttttcttatggtttttgcaacctgcagactaggagattccctcatggacctgtaccaccagggccctgggattcaagcacaaaactgggtggctgtttgggtagacactgagctagctggaggaggttttttttgttttgttttgttttggttttggttttttttcccacacgccaggggcacctggaacccaagcgagagagaactgttcactcctctggaaaggcggtggaagccagaaagccaagtgatctcgcttagcaggtcccacccccacagagcccagcaagctaagatccaccagcttgaaattctcactcccagcacagcagtctgaagttgacctgggatgctcgagcttggtggggggaggggcttccaccattactgagacttgagtaggtggttttccccacacagtgtaaacaaagccaccaggaagttctgacttagcggaaaccatcatagcacagcaaagcagctgtggccagactgcctctctagattcctcctccctgggcagggcgtctcgggaaaaaaggcagcagtcccagttaggggctcatagatggaactcccatccctgggacagaacacctgggagaaggggtggctgtgggggcagcttcagcagacttaaatgttcctgcctgccagctctgaagagagcagaggatctcccatcagagtgctagagctatgctaagggatggactgccttgtcaagtgggtccctgacgcctatgcctcctgactgggagacacctcccagcaggagtcaacagacaccgcatacaggagaggtcagggtggcatctggcaggtgcccctctgggatgaagtttccagaggaaggagtaggtggcaatctttgctcttctgcagcctccactggtgatacccaggctaataggatctggagtggaccaccagcaaactccagcagactgcagaagaggggactcactgttagaaggaaaactaacaaacacaaagcaataacatcaacatcgacataaaggatgcccacacaaaaaccccatttaaaggtcattaaagtcaaagatcaaagttaaataaatacacgaagatgaggaaaaaccagtgcaaaaaagatgaaaattccaaaagctacaatgccacctctcctacaaaggatcacaactcctcgccagcaagggcacgaaactggatggagcaagagtttgacgaaatgacagaagtaggcttcagaaggtgggtaataacaaacttctctgagctaaaggagcatgttctaacccaatgcaaggaagctaagaaattttataaaagttgacaagaactgctaactagaataaccagtttagaggaaaacataaattacctgatggagctgaaaacacagcacgagaacttcatgaagcatgcgcaagaatcaatagccaaatcaatgaagcagaagaaaagatattagagattgaagaccaactttaagaaataaagcatgaagacaagattagagaaaaaaaatgaaaaggagcgaacaaagcctccaagaaatatgggactatgtgaaaagactaaatctatgattgactggtgtacctaaaagtgatggggagaatggaaccaagttggaaaacactcttcaggatattatccagaagaacttccccaacttagcaagacaggccaacattcaaattcagaaagtgcagagagcaccactaagatactcctcaagaagagcaaccctaagacacataagcgtcagattcaccaaggttgaaacaaaggaaaaaatgttaaaggcagacagagaaaaaggtcaggttaccaacaaaagaagcccatcagactaacagtggatctctctgcagaaaccctagaagcaagaagagagtgggggtcaatattcaacattcttaaagaaaaaaaattttgagattgagaccatcctggctaacatggtgaaaccccgtctctactaaaaaaatacaaaacaattagccaggcatggtggcaggcacctgtagtcccagctactcgggaggctgaggcaggagaatggcatgaacctgagaggcagcgcttgcagtgagctgagatcacgccactgcactccagcctgggcaacagagcgagactccatctcaaaaaaaaaaaaaaaaagaaaaaagaaaaaaattttaacccagaatttcatatccagctaaaataagcttcacaagcaaaggagaaagaaaatcctttacagacaagcaaatgctgagggattttgtcaccaccaggcctaccattcaagagctcctgaaggaagcaataaatatggaagggaaaaactggtaccagccactgcaaaaacgtaccaaaatacaaaaaccaatgacactaggaagaaactgcatcaactattgtgcaacaaaccagctagcatcatgattacaggatcagattcactcataacaatattaaccttaaatgtaaacaggctaaattccccaattaaaagacagagactggcaaattggataaaaaagactcaagacccatcactgttctgtattaaggagacccatctcatgtgcaaagatacacatgcgctcaaaataaagggatggatgaatatttaccaagcaaatggaaagcaaaaaaaaagcaggggctgcaatcctagtttctgataaaacagaccttaaacaacaaagatcaagaaagacgaaggatattacatgatggaaaagggatcaatgcaacaagaagagctacctatcctaaatatatatgcacccaatacaggagcaccaagattcataaagcaagttcttagagagctacaaagagactaagacttccacacaataatcatgggaaattttaacaccccactctcaatgttagacatatcaatgagatggaaaaaaatacaaggatattcaggacttgaactcagctctagcccaagcggacctaatagacatctacagaactcttcactccagatcaacagaatatacattcttctcagcaccacatagcactttttctaaaatcaaccacataaaggaagtaaaacactcagcaaatacaacagaacagacataataacaaacagtctgtctgaccacagtgtgatcaaattagaactcaggattaagaaactcattcaaaaccatacaacttcaaaagaagacatttatgcagccaacaaacatgaaaaaaagctcatcatcactggtcattagagaaatgcatatcaaaaccacaatgagataccatctcacaccacttagaatggtgatcattaaaaagtcaggaaacaaaagacgcagtagaggatgtggagaaataggaacacttttacactgttggtgggagtgtaaattagttcaacccttgtgaaagacagtgtggtgattattcaaggatctaattagaaataccatctgacccagcaatcccattactgggtatatacccaaaggattctaaatcattgtactataaagacacatgcacatgtttgcttattgcagcagtattcacaagagcaaaaacttggaaccaatgcaaatgcccatcaatgatagactggataatgaaaatgtggcattatacaccatggaatactatgcaaccagaaaaaagaaggagttcatgtcccttgcatagacattgatgaagctgaaaaccatcattctcagcaaactaacacaggaacagaaaaccaaacaccacatattctcactcataagtgggagttgaacaatgagaacatacaggcacaaggagggaaacatcacacaccaggacctgttggggggtgggggggcaaggggagagatagcatttggagaaatatgtaatgtagatgacaggttgatgggtgcagcaaaccaccttggcacaaacctgcacattctgcacatgtatcccagaaattaaagtataataaaaaaatcaatgaatctaggagctggttttgggaaagattaacaaaatagacggctagccagactaataaaaaagaaaagagaagaatcaaatagacacaataagtagtgataaaggggatatcaacactgaccccatggaaataaaaactaccatcagagaatactaaaaacacctttatgcaaataaactagaaaaatctagaagaaatggataaatttctggacacaaacacactcccaagactaaactagagggaagttgaatccctaattacaccaataacaacttctgaaaatgaggcaataattaatagcctaccaaccaaaaaaaagtccagggccaggcggattcacagccaaattctatcaaaggtaaaaagaggagatggtacaatttcttctgaaactattccaaacagtagaaaaagagggactcctccctaactcattttatgaggccagcattattctgataccaaatcctggcagagacacaacagcaacaacaataacaaagaaaatttcaggccaatattgctgattaacatcaatgagaaatactggcaaaccgaatccagcagcacatcaaaaagctcattcaccatgatcaggttggtttcatccctgggatgcaaggctagttcaacatatgcaaatcaataaacgtaatccatcacataaacagaaacaatgacaaaaacctcatgattatttcaatagatgcagaaaagacattcgataaaattcaacacctcttcatgctaaaaacattccataaactaggtattgatggaacatatctcaaaataataagagctatttatgacaaacccatagccaatatcatactgaatgggcaaaagctggaagcattccctttgaaattcagcaaaagacaagaatgacctctctcaccactcctagtcaacatagtattggaagttctggccagggcaatcaggcaagagaaggaaataatggtattcaaataggaagagaggaagtcaaattgtctctgtttgcaaatgacatgatggtatattcagaaaaccccattgtctcagcccaaagctccttaagctcataagcaactttagcaaagtctcaggatagaaaatcaatgtgcaaaaatcacaagcattcctatacaccaataatagacacacagagagccaaatcatgagtgaactcccattcacaattgctattaagagaataaaatacctaggaatacaacttacaaaggatgtgaaggactgcttcaaggagaactacaaaccactgctcaaggaaataaggacacaaacaaatggaaaaacattccatgctcatggataggaagaatcaatatcgtgaaaatgaccatactgcccaaagtaattcatagattcaatgctattcccatcaagctaccattgaatttattcacagaattaggaaaaagtactttaaatttcatgtggaaccaaaaaagagcccgtatagcaaagacagtcctaagcaaaaagaacaaagctggggatatcacgctacctgacttcaaattatactacaaggctatggtaaccaaaacaccatggtactggtaccaaaacagatatatagaccaacggaacagaacagaggcctcagaaataacaccacacatctacaaccatctgatctttcaccagtctgacaaaaacaagcaatggggaaaggattccccatttaatatgtagtgttgggaaaacaggctagccatatgcagaaaactgaaactggaccccttccttacaccttatacaaaaattaactcaggatgaattaaagacttaaatgtaagacctaaaatcataaaaaagaaaacccaggcagtaccattcaggacataggcatgggcaaagacttcatgactggaacaccaaaagcaattgcaatgaaagcaaaattgacaaatgggatctcattaaactaaagagcttctgcacagcaaaagaaactatcatcagagtgaacaggcaacctacagaatgggagaaaatttttacaatctatccatctgacaaaggtctaatatccagatcctacaaggatcttaaacaagtttactagaaaaaaccaaccccattaaaaagtgggtgaaggttatgaacagacaattctcagaagaagacatttatgtggccaacaaacatatgaagaaaagctcgtcatcactggtcattagagaaatgcaaatcaaaaccaaaatgtgatagtatctcatggcagttagaatggtgatcattaaaacgtcaggaaacaacagaagctggagaggatgtggagaaataaggaagcttttataataattgcaaaaattttctcccattctttaggttgcctgttcccactgataatagtttcttttgctgtgcagaagctctttagtttagttagatcccttttgtcaatttttgcttttggtgccattatttttggtgttttggacatgaagtctgtgcccattactatgtcctgaatggtattgcctaggttttcttctaggatttttatgattttaggtgttatgtttaagtctttcatccatcttgagtaaatctttgtataaggtgtaagtaaggggtcgagtttcagttttctgcatctggctagccagttttgccaacaccatttattaaatagggaatcctttccccattgcttgtttgtgtcaggttggtcaaagatcagatggttgtagatgtgtggtgttatttccgaggcctctgttctgttctatgtatctgttttggtaccagtagcatgcagtttcggtttctgtaaccttgtagtatagtttgaagtcaggtatcgtaacacctccagctttgttctttttgcttaggagtgtcttggctatgtgggctcttttttggttccatatgaagttaaaagtagtttttttccaattctgtgaataaagtcaatggtatcttgatggggatagcattgaatctataaattactttgggcagtatggcaatttttacgatactgattcttcctatccataagcatggaatgtttttccatttgtttgtgtcctctcttatttccttgagcagtggtttgaagttctccttgaagataaccttcacatcccttgaaagttgtattcctaggtattttattctcttagtagcaatggtgaatgggagttcactcatgatttggctctctatgtgtctattattggtgtataggaatgcttgtgatttttgcacattgattttgtatcctgagactttgctgaaattgcttatcagcttaaggagattttgagatgagacaatgaggttttctaaatatatgatcatgtcatctgcaaatagagacaatttgacttcctctctttctatttgaataccctttatttctttcatttgcctgattgtcgtggccagaaattccaatactatgtggaatagaagtggtgagagagggcatccatgtcttgtgccagttttcaaagcaaatgcttccagctgttgcccattaagtatgatattcgctgtaggtttgtcataaataggtcttattattttgagatacatttcattgatacctggtttattgagagtttttagcataaaggggtgttgaattatgtcacaggccttttctgcatctagtgagataatcatgtgacttttttgtcattggttatgtttatgtgatggattgcatttattgatttgcatatgttgaactaactttgcatcccaggtatggagccaacttgatcgtagtggataagctttttaatgtgctgctggattcagtttgccagtattttattgaggattttcacatcgatgttcatcagggatattggcctgaaatttcccttttttgttgtgtctctgccaggttttggtacccggatgatggtggcctcataaaacaagttagagagtattccctctttttctgttgtttggaatagtttcagaaggaatggtataagctgctctttgtacctctggtagaattcggctgtgaatccgtctggtcctggactttttttggttggtagtctgttaattactgcctcaatttcagaacttgttattagtctattcagagattcgacttcttcctggtttagacttgagggggtgtatttgtccaggaatttctccatttcttctagattttctagtttatttgcatagaggtgttcatagtattctctgatgatagtttgtatttctgtgggatcagtagtgatatgccctatgtcgttttttactgtgtctatttgattcttctgtcttttcttctttattagtctggctagcagactatctattttgatgacttttttcaaaaaccagctcttgaattcattgatttttttgaaggttttttcatgtctctagctccttcagttctgttctgatcttagttaattcttgtcttctgcgagcttttgaatttgtttgctcttgcttctctagttcttttcattgtgatgttagggtgtcaattttagatcttttctgctttctcttgtggggatttagtggtataaatgcccctctacacactgctttaattgtgtcccagagatcctggtacgttgtatctctgttctcattggtttcgaagaacatctttatttctgccttcatttcattaattacctagttgtcattcaggagcagattgttcagtttgcatgtagttgtgtggttttgagtgaatttcttaattctgagttctaatttaattgcactgtggtctgagagactgttatgattttcattgttttgcatttgctgaggagtgttttacttctaattatgtggtaaattttagaataagtgcaatgagttgctgagaagaatatatattcttttggtttggagtggagagttctgtagatatctattaggtcagcttggtctagagctgagttcaagtcctgaatattcttgttaattctctttttcgttgatctgtctaatattgacagtggggtgttaaagtctcccactattattgtgtgggagtctgtgtttctttgcaggtctctaagaacttgctttatgaatctgggtgttcctgtattgggtgcatatatatttagaatagttagctcctcttgttgcattgatccctctaacattatgtaatgcccttctttgtctcttttgaccaacaaacacaaccaacaggttagtttcaagtctgctttaccagagattaggattgcaaccccagcttttttttttttctttccatttgcttggtaaatattactctgtctctttattttgagcctatgtgtgtctttgcatgtgagatgggtcccctgaatacagcacactgatggatcttgactctttatccattttgccagtctgtgtcttttaactggggcatttagctcgtttacatttaaggttaatattgttatgtgtgaatatgattctgtcaatttgatgctagctggttattttgcccatttgttgcagtttcttcatagtgtcaatggtctttacaatttgttgtttttgcagtgactggtacctgttgtttctttctatgtttagtgcttccttcaggaggtcttgtaaggcaggcctggtggtgacagaatctctcagcatttgcttgtctgtaaaggattttttttctccttcacttatgaagcttagtttgggtggatatgaaattctgggtttaaaattcttttctttaaaaatgttgaatactggcccccactctcttctggcttctagggtttctgcagagagatctgctgttagtctgatgggcttccctttgtgggtaacccgacctttctctctggcttcccttaacattttttcctttgtttcaaccttggtgaatctgatgattatatgtcttggggttgctcttctcaaggagtatctttgaggtgttctctgtatttcccgaatttgaatgttggtctgtgttgctaggctagtgaagttctcctggataatatcctgaagagtgttttccctgttggttccattctacccatcactttcaggtacaccaatgaaacgtaggtttggtcttttcacatagtcccatatttcttggaggctttgtttgttcctctttattcttttttctctaatcttgtcttcacgctttatttcattaatttgatcttcaatctctgatatactttcttctgcttggtcgattccactattgattcttgtgtatgcttcacgaagttcttgtgccatggtttttatccccatcaggtcatttatgttcttctctaaactggttattctagttagcaattcctctaacctttttcaatgttcttagcttccttgcattgtgttagaacatgctcctttagctcagaggagtttgttattacccaccttccgaagcctaattctgtctgttcatcaaactcattctccatctggttttgttcccttgctgatgaggagttgtgatcctttagaggagaagaggcattctggttttcatctttgtagatttatttacctttggtttttatgttagtgaccttagaatggggtctctgagtggatgtgttattcctttatgtttgttagttttccttctaacagtcgggcccctctgctgcaggtctgctggaatttgctggaggtccactccagaccctgtttgcctgggtatcaccagcggaggctgaagaacggcaacgattgctgcctgttctttcctctggaagttttctcccagaggggcacctgccagatgccagccagagctctcctgtatgaggagtctgttggcccctactgagaggtatctcccactcaggaaacatgggggtcagggactcacttgaggaggcaatctgtcccttagcagagcttgaatgctgtgctgggaggtccactgctctcttcagagctgtcacacagtgacctttaagtctgccgaagctgtgtccaccactgccccttcccactggtgctctgtcccagggagataggggttttatctataagtccctgactggggctcctgcctttttttcagagatgccctgcccagagaggagaaatctggcagtctggccacagcaaacttgctgagctgccatgggctctacccattttgaacttccctgaggcttctttacactgtgaggggaaaactgcctactcaagcctcagaaatggcggacgcccctcctcccaccaaactcgagtgtcccagtcggtatcagactgctgctgtgctggcagagagaatttcaagccagtggatcttagtttgctgggatccatggggttggaacccactgagcaagactacttggctccctggcttcagccgctttccaggggagtgaacatttttttctcgctggcccttaaggtatgggggaaaaaaaaaaaaccctgcagctagttcagcgtctgcccaaagggccgcccagttttgtgctggaaacccagggtcctggtggtgtaggcaccgaaggggatctcctggtctgcgggttgtgaagactgtgggaaaagcacagtatttgagttatagtgcacaatgcagtccctaatggcttcccttggctgggagatggagttccccgaccccttgcacttcccagttgaggcgatgccccaccttgctttggctcgtccttcttggtctgcacccactgtccaaccagtcccaatgagatgaactgtgtacctcagttggaaatgcagaaatcacccaccttctgttttgatctcactgtgagctgcagacagagctgttcctatttggccatcttgccagcaatcaagacacaaattttctgatatcaggaatgaaatagaggatattgctgcagaccccacaggcatcaaaagaataataactatgaacaactgtgtacgtgtaaattggacaaattgcatgaaatggaccagtttatccaaacactaccacagttcacccacaatatattagagaatttgaataaccctatgtcactatttaggaaattgaatttgtaatttaacagtttccaaaaattgaatcttcaggcccagatgttacaatggagtaaaaatgttaaaaattttggagaatattccacatgtttaaggagaatcttccagtcactgcaatctgtttctcaggaagccacagtcctagcagaagggaccacaacaaggtaacaccctgtgggacaaaagaatctgaatagcaggtcttctctcccaggtctctctgctgataggatcagaggtgtccatctgacctgaatagccagaacactgggacaaggttgaggctgtgagttggatagctttcctgcttgcctggcaggggaattgaggtagcttccactcttcacccttataaaacctcagcacatctcattgagagctcctccaacacccttatcaagtctggggtcttagcctaccattatgtatgacatctcacctgccttagctacaactggtgcctatacaggaatatgtttcctcttgacctgaagcctgaatcatcaactcagcaagtataaaaatgggggaaaattaaataaacaaataaagtgtacaccatgagagaaggaaataagctttaagagatccctgccattctgaccccataagaaacagtgaacttgcccacacaccaagaacttaactactaaaaccatcatctgggaaagccagttggaaaagattctctataaataaggaactcatacagagttttcatcctaaaatcaccaagaatcaaactaggctaaaataaacattggcgtatgatccttaagaaagaaaaaaagaagttaaaaaaaaccacagtccaataaaaaataaattcaagaacaatttgattagtctacccaaatgagaaggaagcaggaaagtaattctggtaatatgacaagacagggttctaaatcatcctgaaaagatcctactagctccccagcattggatccaaaccaagaagaaatctctgaagtgccagataaagaattcataaggttgattagtaagctactcaagaagacaacagagaaaggtgaaaaccaacttaaattttaaaaaatcaggatataattaaaattttttcagaggaatagatatcataaaggaaaaaacaatgagagctactggaaatgaaagacacacttagggaaatacaaaatacagtggaaaattttaacaataagctagaacaagtagaagaaagaatttcagagcttgaagacaagactttcgaaataacccaaacagacaaatacaaataaaaaagaatgaaataaatgaacaaagtctccaaggaatatgggattatgtaaaatgaccaaacctaagaataagtggtgattctaagaaagaacagaaatctaaaagtttggaaaacttatttgagggaataattgaggaaaacttccctggccttgctagaggtctagacatccaaactgaagaagtcaaaagaactcctgggaaattcattccaaaacaatcatcattaaggcacagggtcaccaggttatctaaagtcaagattaaaaaaaacataattttaagagctgtgagataaaagataacctataaagcaaaacctatcagattaacagcagatttctcagcagaagctttacaagtcagaagggattggagtcttacctttcacctcctgaaacaaaataatgtcaccctaaaattttctatctagcaaaactaagcttcataaatgaaaggaagataaagtcttcttcaaaaacaaatcctgacagaatttgccacccccaaacaagcactacaataaatgctaaaaggagttctaaatgttgaaagaaaaccttgatatacaccaaaatataaccttcttaaagcataaatctcacagggcctataaaacagtaacacaatgaaaaaaatccaaaacatataggcaacaactacatgataagtacaacagtacctcacatttcaatactaacatcgaatgtaaatgggcctcaacgctacacttaaaagatacataatagcagaatgaattaaataaaccaccaaccaagtatgtgttgttttcaagagactcacctaatgcataaggactcatgtaagcttaaggtaaaggggtggtaaaaaatattccacacaaatggaaaccaaaagcaagcaggagtagctattcttatatcagacaaaacagactttaaagcaacaacagtttaaaaaaaaaagacaagcaaggacattgtataatgataaaaggattagtccaacaggaaaatatcaccatcctaaattatatgcacctaacactggagcacctaaatttataaaacaattggtactagacataagaaatgagataaacaacaacacaataatattggaggacttcaatactatacttacagcactagacagatcatcaagacagaaagtcaacaaagaaacagtggacttaaactataccctagaacaaacagaattaacatatatttacaaaacattatttccaacaactacagaatatgcattctttttttcagtgtatggaacattctccaagatagaccatatcataggtcacacaacaagtttctataaatttaagaaaatcaaaattatatcaagcattttctcagaccacaggggaataaaattggaaatcaacttcaaaaagaaccctcaaaactatagaaatacatggaaagtaagtaatctgctcttgaatgagctttgggtcaacaatgaaatcaagatagaaatttaaaaattatttgaaatgaatgataatagttacacagcttacaaaaacctgtgggatacagcaaaagtggtgctaagacaaaagttcatggtgttaaatgcatcaatcaaaaagtctgaaagagcacaaatggacaacccaatgtcacacctcaaggaacaagggaaacaagaacaaactaaactcaaacccagcagaagaaaagaaataacaagatcagagcaaaactcaatgaaactggaacaaacaaaaacaatgcaaaagataaatgaaacaaaaagctgattctctgaaaagataagcaaaattgatagactgttagtgagattaaccaagaaaagatccaaatgaactcaatcagaaatgagactggagatattacaactgataccatggaaatacaaaagataattgaagtgtactatgaacaccttttcacacacaaactagaatgtgtagaggatgtggacaagttcctggaaatatacaagcctcctagattaaatcaggaagaaacagaaaccctgaacagaccaataacaaaaagcaagattgaaactgtaattttaaaattgccaacaaaataagttcagaaccaggtggattcacagctgaattctatcagacattcaaataagaattggtaccaatcctactgaaaccattccaaaagacagtaaaagaagaaatcctcattaaatcattctatgaagccagtgtcaccccaatacccaaaccaagaaagaacacaaccaaaaacgctacagaccaataccctgatgaacatagattcaaaaatcctcagcaaaatactagctacccaaatccaacagcatattaaaaagataatacaccatgatcaagtcagttttatcatagggatgcaggtatagtttaacatacacaagtcaataaatgtgatacatcacataaacagaatcaaaataaaaaatcatatgattagctcaatagatgcagaaaaagcatctgataaaattatcccttttttataaaaacactcacaaaaactggcatagaagagacatacctcaagataataaaagccatctatgacatacccacaggcaacattatactgaatggggaaaaattgaaaacattccccgtgagaactggaacaagacaaggatgcctattgtcaccacttctattgaacatagtactggaagtcatagccagtgtaatcagacaagagaaagaagtaaagagcatccaaattggaaaagtggaagtcaaaatgtcactgtttgccaatgatatgatcatatgcctagaataccctaaagaataatccaaaagctccttggcctgataaacgaattcagtaaagtctcaggatacaacatcaatgtacacaaatcagtagcactgctatataccaacaatgactaagctgagaattaaatcaagaagtcaacccattttacaacagccgcaaaaataataataataagatatttagaaataaccaaggaggtgaaagatatctgcaaggaaaactacaaaacactcctaaaaaagatcatagatgacacaaacaaatggcaacatattccatgctcatggaggggtagaatcaatagtatgaaaatgaccatactgcccaaagtaatccacagattcaatgcaattctaatcaaaataccatcatcattctttacagaacaagaaaaaagcaatctaaaattcatatggaaccaaaagagagcccacatggctaaagcaagactaagaaaaaggaacaaatctggaagcatcacatttcccgacatcaaattatactacaaagctataagctaccaaaacagcatggtaatggtataaaaataggcatgaagaccaatgaaagacaatagaaaacccagaaataaggccaaatacttacggccttctgtaagtattgacaaagcatacaaaaacataaagtggggaaaggacaccctattcaataaatggtgctgggaaaactggcaagccacatgtagaagaatgaaactagatcctcacctctcaccttatacaaaaattaactcaaaatggatcaaatacttaaatctaagaactgaaactataaaaatactagaaggtagcattgggaaacttttctggacattggcttaggcaaagaattcatgactaagactccaaaatcaaacgcaactaaaacaaaaataaataaatgggacctaattaaactaaaaatcttctgtacagtgaaattatcagcagagtaaacagacagcctatagagtgggggaaaatatttgcaaactatgcatctgacaaaggactaatacccagaatctacaaggaactcaaacaaataagcaaaaacaacaaaaaaaatcccatcaaaaagtgggcaaaggggcaggtgcagtgactcacgcctgtagtcccacaactttgggagtccaaggaaggcagatcactggaggccaggagtttgagactagcctggccagtatggcgaaatcctgcctctactaaaaagaaaacacaaaaattagctggcacggtggcttatgcttgtggtcccaggtatttgggaggctgaggcatgagaattgcttgagcctgagaggtggaggttgcagtgagccgagatcatgtcactgtacctcagcctgggtgacagagtgagactgtgcttcaaaaaaaaaaaaaagaaggagaaagagaagaaaagaaggagaagaaggagaaggaggaggaggagaaggaggaggaggaagagaagaagaagaaggagaagaagaaggagaagaaaaagaagaagaagagaagaagaaaagaagaagaaaagaagaagaaggagaaggagaagaagaagaggaggaggagggggaggaggaggagaagaagaagaggaggaggaagaagaagaagaagaagaagaagaagaagaagaagaagaagaagaagaaggagaaagcaggcaaaggacatgaataggaaattctcaaaagaagatatagaaatggctaataatcatatgaaaaacccgcttaacatcactatactatactacaagtctgcagtaaccaaaacagcatggtactagtaccaaaacagatatatagaccaatggaacagaacagagtccttggatttaatgccacaaatctacaaccatctgatctttgacaaacctgacaaaaacaagtgatgtggaaaggattccctatttaataaatggtgttgggaaaactggctagccataagcagaaaaattaaacaggacaccttctttacaccttatacaaaaattaactcaagattgattacagacttaaatgtaagacctaaaaccataaaattcctagaagaaaacctaggcaataccattcaggacataggcatgggcaaagacttcatgactaaaacaccaaaagaaatggcaacaaaagccaaaattgacaaatgggatgtaattaaactaaagagcttctgcatagcgaaaaaaactatcatcagagtgaacaggcaaactacagaaaaaatttttgcaatctatccatctgacaaaagtctaatatccagaatctacaaggaacttaaacaaatttacaagaataaaagaaagaaccccatcaaaaagtgggtgaaggatatgaacagacacttctcaaaagaagacacttaagtggccgtcaaacatatgaaaaaagctcatcatcactggtcattagagaaatccaaatcgaaaccaaaatgagatactatctcacaccagttagaatggtgatcattaaaaagtctgtaaacaacagatgctgattatgtggagaaataggaatgtgtttacactgttggtggaagtgtaaattagttcaaccattgtggaagacagtgtggtgattcctcaaggatctagaaccagaaataccatttgacccagcaattccattactggatatatacccaaaggattataaatcattgtactataaagacacatgcacacatatgtttattgcaacacagttcacaatagcaaagacttggaaccaacccaaatgcccatcagtaatagactggataaagaaaacgtggcacttatacaccttggaatactatgcagccataaaaatggatgagtttatgtcctttgcagggacatggatgaagctggaaaccaccattgtcagcaaactaacacaggaacagaaaactaaacactacatgttctcactcataagtggtagttgaacaaaaagaacacatggacacagggaggggaacatcacacactggggcctgtcggggtggggggctagggtagggatagcattaggagaaatacctaatgtagataacgggttgatcggtgcagcaaaccaccatggcatatgtatacctatgtaacaaacctgcatgttctgcacatgtgtcccagaacttaaagtataataataaaaaaaagaaagaaaaatttgataaattggacttttaaaaaaaatttaaatactcttccaaagaccctttcaaggtgacaaaaaggcaagctactgcgtgggagaaaatattttcagccacatgtctgcggaaatactcaaatctagaatatataaagaaatattaaaactcaacagtgagaaaacaaatatggttgtccctcagtgtatataggggattggtcctaggcctctacctgtaccaaaatttgcacatatccatactcaatcttacagtcagccctgggcatacaaaaagtcagccctccatatatgcaggtattacatcctgtgaatactgtatttttgatccatattttgttgaaaaaaatccatgtacaagtgaatctatgcagttcaaacccatgttcttcaagggtcaatggtaatccagttagaaaatgaaccaaagacatgagcagacatttcatagaaaaggatatatggatggcaaataagtatgtggaaaggtgttcaacatcaatgggcattagggaaatgcaaattaagatcactttgaagtatcactacatatttattatgatagttaaaataaaatagttggccaggtggagggactggatcactcatattttgctggtgggcatgtgaaatgatacactctggaacagttgggcagtttattgaaaagctaaatgtgcaattatcatataacccagcaattgtactcttggatgaaaacttatggttaccataaaacttgtacatggatattcatagtggctttattcataattaccaaaaattagagtgagtctagatgtcctttaatagacattgtttgagattgccattgcatggtggtaataaagagtagaccaactttagttggttttatttttatattttaattttctacacacagcatacccccttattgtcttcaccccagggtagactgttgttactgccctgcacttgatgcaccactattgaaagatattaatggcaccatcaaagcctgcagtgacattgttgtccctccactaaagcaaggaccaggcttccctcagagaaactgactttacaaatagtaaatagaggctctttctgaaacctatcttcgtaaacatatttccctctcctaacaaggagttttggcccttctgccctttagtcagggtcttggtccttggtatttcttgccacagcaggcaatagacaaaggctcccaaagaccttggatggaggcagacattgtggctatgtaccttgtacccaaaggattaagctgccatcttgctggtggcagcccttcaccccagagagaggaaatgccactggtgctttgaggaaggctttgtgcctttgattttccatgtcaagtcagcacttaactgtgaccctggacacatgaggtgaaaaatctttggtttattttggcattaatgtctcttgcccaataacatgggtttctgtaaacagaagtaggcatggagggaggagggaggattacataaaagggactcatccaagcagggctagctgcactatgctgatttctattaaatggcaatgggagataccctcttacccctgatttcagttagtggtagttactttcatcttaatcgaattaattacaaattgggaaggcttgggtcagcttcataaaatgctgttatttatgttgacatttttatgtggctttagctaatatatgttttaattttagattcagggactacatgtgtacatttgttatatgaatatgttgcataatattgaggtttgggcttctagtgtacccatcacccaaatagtgaacattgtacccaataggtaatttttcaacctttattcccttcccattctcccactaatgattattattttaatctcagtaaccagcaatatacctggccactcatgcatgtgcacacacacaaaccctatttgctgtagtggaaaccactctggtgaaggagatatccatggtggaagagttgggcagagtggagaaagaaggaccctatcatttgttgactgcccaccatgtgccacatactctgcttggtgactttacatgtcttagctcatttaatcctcaccacataatgtgtaaagtagatgctattattattcctgtgttactgatgaggaagccaaggctgagggaagtgaagtgagatgatcagataacgtcactcttccggtgcttaaaattataaaattccccttccactgaggataaaagtcccaactcgtcccattctccaagctatgttttagggcctgtcaacctccctagttttatctaggcccctctccctcttgcagtaggtgctccagccacactgctcttcactcagttcctttaatgtgccatattcttcttctgtggggccattactcatgctattctttttgtctggactgttctcctgtgtgcccacctgcactcaccagcgaactcctattgattcttcaggtctcagcttagatttcacatcctcagttctcagggaagcctcctctgactgtcccctttaccctatagtgtccctcagactatgttaggtccctttgttgtatccttctatcacattctgcatctcctccctaccactaatatgattttacatacaaccttgtgttcaggatcgattttcttcattagatgaaacttgctgtctatatactgtcttgttctctgctctatccctagtacctagtacaatgaatgcctggcacatgataagtattcaataaataattattgactgaatatatattgaaaccctctataattaatacatagtaagtgctcaataaatatagttaaaatacagttgttattattgtccaaaagcaaatagttaatcagaggcagaaccaggatttataattgaagtctgagtctaaagcgcatgcttcttttatgatatgactttgtctgcagaaataggttcttggcccagcactgccctaactggttgtatgacacttagggtgagacactatactactctgaatcttagttttcccatcggtaaaatggttacaggagcaggcaaagttcaggtttatcttcacgtaacctagaaaaggaggagaatagaagtctagatagatggggatataagcaaataagtaattaaccaatacaaatcagtatcttccctctgcaagacagttgatgagctataacaagaacccttgatgtttttatgcccttcagcctggtaaccctgttcaaaggcaatatagagtagtggatggtatggatggtatgtaggctttggtgttagagagccctggttcaaatcccaacatccaatttactagctctgtggtactgggcaagttaccaccctgaacctcactcaattcccttctctacaaatgggataacacccaccttttaacccatttctaaggttacaaaaaaaaaaaaaatacaataacatgaaaagatgttttcttagtatagaaagagaaacttctcccaccatcctacccacctaacagttctttctgtagttctgtgccattgaaggctacctcttgaggcaagaggcacaggcaatgtcaagaaaagagagactgaagacaagcaggctgatggcagaagccagagtccagtgtgtggagttggatcacccataggatagactggggcagaggggaagatcagctactgagggagaagaaaggagactacaaatctgagtaaggggataatggctaggcagatcctgagaagcatggtagggagccagtgggaagacaacaacatgccttagagggtacccctttcaaaactttgtagccctttcccagaggcaggcttcaaattatgttattaaaggcccttgaaactgtgtttcttccaaatctttttcttatttagtcacatccatgtatgttttgaaattgtaatcttagtgtgtacactttttcagcgagtatcttatcttcaacattttctatgtcacaagtcttcagtggctgtcaaatatcctaattttgctgaaagcccagaaagtacacctctgtgtattaactttttgcttccttgaattacctccttaaaatatattcccaagtataggattcctgagccacacggtatacaattgggatttaatgaccaaaaccaggtttttctttttctaagaaagaaattacccataatatcctttccccttccttttctggaactgataaacacaccctctagagttgtgctgtctaatatgacagccagtagccacacgtggctgtttaaattttaagtttgattaaataaaattcaaaactcagttcctcagtagcactggccacatcacaagtgctcagtagccatatgtgcatagtggctattatactggacagcacagatacaaaacatttccatcactgtagtaagtttattggacagtgcttacttagagtttctcaagagatcatttttggtttcttgggtgggagttctttgtgttcaggactttcctgggcattgagaggctatttagcatctctggcccatgtccactaaatgccagtaacacatttccttgagtcaatctaacagccaaaacactccatatttgcaaatgccccataagggaacaaaattaaccccattcgagacccactgagcttttagagggaaacatctcctaactttttcttgagacaaggtcttgctctgtcacctaggttggagtgcagtagtgcaatcatagcttaagcaatcctcctgccttatcctcctgagtagttgagactactggcatgtaccaccatgtgtggctaattctttctttctttctttctttttctttttctttttcttttttttttcttttttctttttcttttttttttttgtagatataaggtctcactatgttgcccatgctggtttcaaactcctgggctcaagtgatcctcctgcctctgtcttccaaattgctgagattactggcatgagccattgcacctggccttcttttttgagatggcctcaggttggctctgcctggagagggggaagcttgtaaagatggcttagaaaaaaagtcctggctccatttctattttctcccttcttttgctggcctgtttcctgctttttgcaaattgcaggaacaagaccctgcagatggagaagatcaaggctcgtttgaaggctgagtttgaggcacttgagtcagaggaaaggcacctgaaggaatacaagcaggagatggaccttctgctacaggagaagatggcccatgtggaggaactccgactgatccacgctgacatcaatgtggtacgtggctgcctggagcctatctctaaagcctttgagaaagaggtagtggtgaatgatagggcctttccttgagatgtggcttaggcctagctcggggagcaggcatcagtgcaggctgtggtagagcagaagaattcaggagttctgagatccagccctggctctgtcactaactgactatatatcactggacaagtcccttctctctgggcctcattttccctctctgcactataagggggactcagtaccctctaaatgtactgatttgatgtgctctcattctgggattctgggagttgagagctagccttggggaaaagcagagcaggcagctgcctctggaatgtagtttaaagcactccaagctttcagtcagaccaaacaaatcatttctgcctgctaccaaagtggagcttcctcattgatatatcctttggaaactcttggaacacagaatatgaactgtctgctaaggtggtaagctcccctctttggaattattcaagcagcatcttaatggacacttgtatgagctactgtactgatgattccttcacaaggaaggaggttggcagtgctgaccagtaaggtcttttcaaacccttatcacccataaccatgaagaatatatttttaaaatttactttcaaaggaactaagtttatatttctggaaaactcatttctgtggcaatactcattttctgatgttgtcagacctaggatcataaaggaaatatgaatgaggtttggacagtaagcaattgggattttctgtgttagagatcgcagaattctagatctcataaagtgttgacagtttggctgccagctaaccaatgatacagggccagttaaatgaggaagatatttgccagaagggctaagaatataagccagtggatctcaaacttgagcatgcatcaaagccactttgagagcctaagacacatattgctagactccacccctgattttctgattttgtatgtctgaggtgaacctaagaatatgcatttctgagttcccaggtgatgctgatgctgctgatcccttggccacattttgagaatcactgatctaggagaaaagactgctggcctgggaggcggaagccctaagtctttatgcaggatttgatactaagaagtatttccccaggaaagtccctttttctctttgagcctcagttttctataaaatgggagtaaggtggactaaatgagctctgaaggacattccagctctaagatactatatttgaacaataccatttatttagcagtaaatattaatttagcccatttactgagtgctttatatgaatcctatcattacatcttcaccaagattgcatgagttaagcactagaatatcaccattataccgatgaagaaactgagacttgaccagagttacatggagagggcatgggagatcaaggacttgaatatagactgaacaagttctggagcttgtgctattattcactcagctatagatcctctctgagaaccttaggatcttttctctgtgcctatcccactctatgttccagatggaaaacactatcaaacaatctgagaatgacctaaacaagctgctagagtctacaaggaggctgcatgatgagtataagccactgaaagaacatgtggatgccctgcgcatgactctgggcctgcagaggctccctgacttgtgtgaagaagaggagaagctttccttggagtaagctacctgcccccagtccctacaacataccctccctccgacccacatacatacttacatacctacacacacacgggcaggtatacatacacaaagcctagcctgaaagtcagagtgcctagttttagtcccaggcctttcagtggcttactcactgtgtgatcttgggcaagtctctgtgccagcttgttaaaacagaaggaggattattaaactggatgaattactagatgaattagaacaactactaggtggctttttaaattctttgtgtgatattgacaatacaagactatgtctataactcttaagagatcatttcccaagtcagggtctagaaggcgatatctagaaacctctaaaaacaaaaaagactgagctttcctggtcttcaggaagtggcctgggacttacttcatctcctggctcagagttaagaactaggcttgccttgcagagagacagaatttgacctggtagaggaaatcatttcctaaaggtagagcaaggtgtctgtggagtttgtgagcttcctactcttagagatatgtcaccagaggccttaggacacttaataggaatactcaaaagagcatgagatagcagataggactgaataccctttaaggatcttgctagccctaagatttcttggtcttcttggcctatcagagctaaggacaaagaggattacccttctcatcagacattgggcctagtacccagggacaatagccttgtgcttgggaaggtgtggggaccttctagaatgagccacagctcaacccttggttgtatggcatggagtctttaagaggagcaaggttctcattgctttcagaatgatctagccagtgtctctcatctccaaagttactttgagaagcagaaagcagaatggcagacagaacctcaggagccccccatccctgagtccctggccgctgcagccgctgccgcccaacagctccaagtggctaggaagcaggatactcggcagacggccaccttcaggcagcagcccccacctatgaaggtaagtgagctgggtaatggttgtggaggaagcaaagtatcctcccatggaagggccgtggaaggctagttctgggtctttggctttatttatgctgggccttcttttaatggcctttgcttgtgacacagtggaaggggtgacatgggtgtgctgtgttggacacacacagcacaggttttgttgccccatgttcccagaggtgttagaatgcagggagattttcaggccctgctagagtgcaattctaaaagttagaaatgactcttacacaaagatgtaatgagcatgtatcataaatgagggaaccagcaggattataaagctggttccaggagcatttggaacaaatatctatatagtcaagaaaggagaggaaggctgaaacaaatttgcaaagttagatgcaaaactggtttacatcccacaggacaataaaactgtaactttatagttactttttcttccaaacagaagtaatttgcatctctactgggcaaaagccatttgcagcttatcagtgtaacatcacagagcctgggtcctaatcaattggtaaatagtcaaacaaagagacattcttctagagcaggggtcatcaaattacagcctacaggtcaaatctaatctgttccctgttttcgttaaagttttattggcccacatgcatgtctgtgtttgcaagctattgcaaacaacatgcatgcaagctattgtctatcacttctttcatgcaaaacagaattgagtagttgcagcaagtttatatgatgtaaaaagtctaaagtatttgctgtcctggcctttacagaaaatgtttgttgacccctgttctagaaaattaaatagtccttaagtgggcctgttagacaatgcttcattataatgacgaaaagatgtgtagttctcattttgccttactttctagttttgtatactttttctcaacaccattctctgaactgggttatgtccttccttcccatcttccatggcatccaagaatacttgagtctactcactgattattgctctcttctgatgggaaatcactttgctttctgggcccctggggaatcagaagtctaagttgttgcctggaagaatctgactactaactttctttttcctgtgtccctcaccaggcctgcttgtcatgtcaccagcaaattcaccggaatgcacctatatgccctctttgcaaggccaagagtcggtcccggaaccccaaaaagccgaaacggaagcaggatgaataaag

SEQ ID NO: 4654 - DNA, 118331 bp, human
gctgtcggagctcagaccagcaggcctacgacctagaaagtgctcaaaaccccacttcctaaggcctagaaggagcgacgtgaaggtaagcgtgggtgaggagaggtccaggatgctctgcaattcgataggcccgaggacttgggatacgaccgtctcccagcccctcgacaggcacctctgcggttaagagtgacagtcccaacaacctcactacttgtctcactgccttttatttgtcttttatttgtttttattttatttgcctacgtatttgtcttggctcctccaattcatccttcacaagggctgccagggtaattttctaaataacttctctgactatgtcactcgtctgcataactcaggtggttaagggtcacctcccttaatagggcctaacaattcttgactactgcaacagcatactctctggtttctttgcctttagacttgtctttctgcaatttgttctcatacttctaccagtgatcaaatgaaaatctaatctcacttccttctggcttagagaatgggctttgaaattacagccaagtttgaatttctgctccaccaccaagtagctctgtttccttgaactaggaatttttttttttttttttttttgacaaagtcttactctgtcgcccaggctggagtgcagtggcgccatctcagctaactgcaatctcttacttctgggttcaagaaattctcctgcttcagcctcccaagtagctgggactacaggtgcaagccaccatgcctggctaatttttgtatttttagtagagacggggtttcaccatgttggccaggctggtcttgaactcctgacctcaagtgatccgcccgcctccgcctcccgaagagctgggattacaggcgtaagccaccgtgcccggcctgagctaagattcttaacctgtctaaatctgtttccttatcagtaaaatggggataattataatacctatagagtagttatgaggattaaatggaaaagtgaatgtaaagcacttaacatacataacttactgtggctcagagtaagcgcttagtaaaaattggagttatttttcaatagattcattatctataataaaggagaaaatacagattccctagcttaacattcaaagtcctctaagatcttgcctctatttttctagccctagctccttccacacccccttaggcacccagccacagaccagtttttaccttttctgagacacatctagatctataaagtgcttagacatatttcccaaaggttcacctgggtaagaaatctgcataaaccctccagttaattaacatgtaaatatccagtgattcttctaaaactacactttttaattttaaaatattgacactgagaattgacatgtaggcaatggctacgtacaaacttgtgtgatattctaggggcttatttacttgatctttttgaaattaggtttagaggttctgtattaaacttaatacaatgtataaacatatttacaaaatgtgccctgctggatgtttatttaataaaatatttaaacattttagaaagtgtaaaaatagctatgccatgtgtaagaactttaagaagccctataataagtgccagtgaaacattagtggagggccaggcatggtggctcacccctgtaatcccaacactttgggaggccgaggtgggcagatcacctgacgtcaggagttcaagaccagcctggccaacatggcaaaatccctcctctactaaaaatacaaaaattagccaggcgtggtggcacttgcctgtaatcccagctacttgggaggcgggggcagtagaatcacttgaacctaggaggtggaggttgcagtgagccgagatggcaccattgcactccatctaggcgacacaacaagactccgtcccccaaaaaaaagaaagaaggaaggaaggaaggaaggaaggaaggaaggaaggaaggaaggaaagaaagaagaaacattagaggagagctcaaatggactgtcaaactaaaatgaaactttatacagaccagccaaaaagtactgaagaaagagaagaacaattggaaaggcgaaaaagagtgaatcactctagaactaattaagtagaagtatcagattggagatcatcaacaagctggaaccaatgtggaagaccataacatagggaatatatattacaattatgaatgtggaaatgagcttggatagagttctcacacagctcatacctttccttccgtatggaacagacatgcctttcaggttctaaggaaaacaattccctagtgttcagccttttctaatgaccatcagtaactcacagggacagactttttacaaaatttgcttatatcttctaaaacctgtattttaccacataaaacctatattctctgttcacttattgaactaatcacattctatcacacatttttttatcagtgtatagagaaatacatatataaaatgctgctagtcatctttaattcttctgtgttcctttctatataaagaactgtgccactgctgtacttaaactccttcaatatctttcctggggtttcaagataaaatctgagctcctttgcccacatcagtgcatctgcctttactacgatagaaaggtaaaaactcctacaacaaacagacctctctatatcaatatggaaaaaaaagaaagctgatttattattgagtaagcacaacagagtacatgcatataagtagccttcaagagactgcaaattcaaaataaaattctatacaacttatatattgcaacagtccacttgagaattgaggcagctatttgtttagttaattgaattcttccaacagaataataaaacttttcttacctccctaaagatacctctagtcttcctgaaagacaaatggttacaccttgagatgggctcctacattaactttgaagacatgtctttacatttcaaagagaaatgtgaccttgaccttggaaatatgtgtgcattataaaactggagactgagactctgtagtctctggagagatttatctacattccaaaagttagagaaaggataaaggttcactctgtcccccaaggagatacattaagaagctaaggaggagaaaataatatatttctctttattcaccttcttttcatttcttttttttttccttattcaccttcatttacctttacaattacaaatcagtgagttcttcaaaaacagaactctgtgctggcacagtagatgcacctagtaaatcaagagtaggtcttccttgaataaataaagtcatagaagaagatgtcaacagatgagtgggaatttgccaaaaggggataaaaatatcccatgcaaaggaaaaagtatattcaaaagcccagaaaatttgaaagtgcatgatgtgttcagcaaaagtagaaaagtgtgacttatgcatattttatctgtatttatgggctgggaagtgtaaagttgtaatggagttgaatatagagaagtaggttgagcaaaagattatgaaatgccttgtatgccatgccaaagtttggaaaaggtctatatctcatggctaaatacggtgttaaagaaaatttttcatgatacttgttaaagatggtaagaaagatttaatttaaggaggattattattatggagttttacagtaggggagagagatgaggctcaactctgagtccaacaagggagggagtaacatttataagtgggaatttataaacaaggagcacagtggaggcatcaattattggaaaattactaagaggaaacattaagtctaggggaattcttgctaaaccaacatgatggaaatcttgctaaaggcagaccagggtaataagatatcaggggtgggagatgagatatctaatcagatatccagaatgatcagataccaagggtaggggacttccactaaactgactcagcaggattcttgctaaaactgaactaagcaagccaagcttagttgagaagaaggctcacaaggacctgactcaaatttggtcaagcagagagtctttgtcaaaggcaaggtactattacttgtttaggagtctagtacaaatattagacagtgctccagccccaaagagcttataatctaatgatgcaagaagacaagttaataaataatttacataaatgaaatcataaattgacagatgtatttgtggaggaggatataggattggaaatagactttgagtaaagtttctgagaaagctccttgaatgagtttgtcttgacatataatataaagggtcagctagacacagtggttcactcctgtaatcccagcactttgggaggtcaaggcaggtggattgcttgagctcgagaccagcctgggcaatgtagcaaaacccggtctgtacaaaaaaaaatacaaaaattagctgggtgtggtggcatgtggctgtagtcccagctactcgggaggctgaggtgggaggatgacttaagcccaggagacagaggttgcagtgaactgcaattgctccactgcactccatcctgggcaagagagccagaccctgtctcaaaaaataaaaaagaaaaataaaaaaataaagagtctccagaattgaagtaattcctagaatttcaaacacttgaaccctttgtgtctgtatgctatagatcttcatcttttgttcactgtttccatttaagctcctctgaagaacatcactatgaccttttaacgcaaattgatgttgccacagatttagtttctcatctacgaactacttggcaatcctttttttttttggtcagtccttctccagttcccctcagctatttctccaaactttaaccattctccactatggcagatgacctcatccttcacacagcaaatctgccacccaactggtgactttattaccttatgttccttaaaaaaattgcaggttacaggaatttttctcacctacaatctgcatctgctcccatattatacccttattcctccagtctcacatagactaaatctcctattagagctcctgatctttgtctcatctagcacctcagaggtcttacccactttttctttctatctcacgtaccttacaactgtccgtctcaactatattattctcctcagcctgtaaacatactcaagactcttccattcttaaaagacatactctcctgtgatcctggagcctccttcagtttcctagaagtgtctcctgttaccctatcatgtttccttctcacccagaggtctcaaaagtggttatcttacattcactgcctctatttcttcacttcccattcaccctccaaccactgtaatagggatttaacctctacctctccactaaaacctattttgttaagaacaccagttactgacaaatttccctatgcaatggacacttttcagtatgtttgttattggacctcactgctacatatgatagtattgatcatttgggtctgcttgaaagtttctgctccacttgattccagacatacattctctgttcttttccttcctctttatattttttatttatgtaactttcatggacacttctccttcaacctacccctaaaacgttagttttccccctcccatagttccactcttggcctatttcttttgttctactctccatgctctattacctgcacatggatgactttaaaatatatattactagctcagaccaccgtcctgagatctagataaataggtccaactgtccactcaacatcctgacttggatgccacccaagcagttcaaattcaacctgtccatgcttgaatgtattttcccatgctaatgggttatttgtctttgttggggtagattccccaaaaaaatttccccaaagagaggcccggcacagtggctcatgcctgtaatctcagcactttgggaggccaaggcaggtggatcaggagtttgagaccagcctggccaacatggtgaaaccctgtctctactaaaaatacaaaaattagccaggcatagtggctcacgtctgtggtcccaactattcaggaggctgaggcctgagaatcacttgaacccaggaggcagaggttgcagtgacccaggatggcactactgcactccagcccgggctacagagcaagactctgtctcaaaaaaaaaaaaatccccaaagggagaccctggtattgtcacataatgatttcaccttctcacagaaacagatgaaatgactgcattatgatcattttatgtgactcaagccaagacttctgtacttttcctgaaaaataagctgcatatatgcaccaaggaagaataagttgaatcactagaattgaaacttcatgaagacagggattcttgcctactttgttcactgctgtatctctaatgcttagaatagtacctgccacatagtaggctctcaataaatctttgttgaataaatgaatggatgaatttgtatatcctcttcttaaaagccctctgggaattctactagattatagcagctagctagctagctagctagatagctggctagacagatatagatagatatcaatatatatacatagattagggaggtatatatctttttgtgtctgaaataggacaaaaggaaattataactgcacttcactcagatttcttcctattgaaagtaaagaaaaaggaggcagagagggataaaaaccactttatctgcctcttggaatagccatttggtagttcttcagctcttccaggtgctcagatctctgctttaggaaaatctcctttgtagtatgccttcaattcccgcatgacgaatgtcatcttctggaatcaagacaattcagacaactgaagatgcccacttcaaacagaaggttgatctggacctcatttggcattatattcaatagcgaataaaggacacatgaaaccctttgcctgatctctgtctcttggtgtgctgaaatttctgtctcactgagaccaaacaaagcaaagtatgatctaatcccaagagtggatgcacttctaagtttggtaggcccccaacggtcctattgtccctctctgggtaggtgtattttaccttgtctcccaaaccaaaaacataaaggtcacctcagactctctcttctaacctcctacatctaactaagttaataagccttgctgattctatctcctaaatatctctcatattcattcatcattcttttacacctgcaccaccaccaattttgccttaatttatttatttcctcctaatttttttcaggagtatttcagcaacttcctaatcaggctccttaccttcattcttacctctcttccaaaccatcttctgcactgcctcttgaataagttatctaaaaatgcaaaccttaccaaattctctccctgctaaaaacgtttcagatctattccccattccttattgattacacttcaagctccacattacttttcataatctgtctcttttccagccatatcccctaccattctctacattctacttcatgctcaggaatctaatactacttgcaattctgtgctgagcatcacccttcttggagcttctctttccatcacttccatcctaatgttactgtagaagtttttaatgttatgtgacccgttggccacagttaaccaatctggaactattatagtccttccttgggagtctggaatctagattaagatatttcatcgtggtctggttgctttcttatgctgagcagtataaacttcatagctgttggcagcagcaacttttctaccatatggtctggggaaaaagaaaatgctggtctgctataaaagatgaggcagaaacacagagagatgcagcagtgaaagagggagagtgtccagatagcagctgagttcctagctgcagcttattccttgaagcccacctgccttcctgtttttgggttccataagacacttctctatccttgtgctaaattcctttttttttttttcctgagacggagtctcgctctgttgcccaggctggagtgcagtggtgcgatctcggctcactgcaagctttgccacccgggttcacgccattctcctgcctcagcctcccgagtagctgggactacaggcgtccaccaccacgcctggctaattttttgtatttttattagagacagggtttcaccgtgttagccagggtggtctcgatctcctgcctcgtgatccacctgtctcggcctcccaaagtgctgggattacatacgtgagccaccgcacccggccgctaaattcctttcgttgctcaagctagtttgaattgaatagctgtacaaacattctgctctcccatattaaactgcttagctcttctgcatctttgcttattcttttccctttgcctgaaaaacagtagttctttccacaaccattttgcctgaataatttatatttgtaatggcccttttcctgtatctggaaggtacctatatttctactctgcccttcattccttcctccccaaagggaaatatttctattataggtcagatggcatgacactgattaggtcagatttaataaagggtggggttgatatttgcaaataggtctcatgcccattcgtggtccttccattcctattcctcctctgtccctgtgggtggatactgtaagagggccagggcctaccttgaggcagtttcagcaatgctctctctctctgtacctaagcagactggcatcaattcagatttatgtgttatgtggctgggtcagaggaccgtaacatttggatttgagcttggggacaggaatgccattagggaacctcattaaggcttcaagtgagccactttttaatcacattttcccatagctttacacagaaaatattttgtgcagcatcctatgtttagtaatcagagttgcagctggtatttagaggggaagagattctctcctgaagtaagagatccctgggggatgtagactgaagaggagagctgcacttaagctagattacaaggcagagttccacatggagaaagcaaaattctccttatggactctatggataaaaaatgattttggtttgcatattttggggcattggttggagggatggcatcttgctttccctaatcccactctctcactcggagctgaggagtggtatatttctccagacagatcacatcttgttgtggcaggaatttaaatggtaggagaaatgtttatattaccatttagataaccaaagtctggagaattcaaaatctgaaggaaagcaatacgattatggatgtttgataagtgccaatagtagcagcacagaactagtaaagatttgcagcctgggcaccatactgagacctagtctctaccaaatatttaaaaaaactagccagacatggtgatcacctgtggtcccagctacttgggaggctgtggtgggaggatggcttgtgcctaggaggtggaggctgctgtgagctgtaattgtgctactgcactacagcttggttgacagagcgagaccgtgactcaaaaaaaaaaaaaaaaaaaaagcaaaaaacaaaccaacaaaaaaaccatggatttggaatttcatgaagcttttagaaaataaatatgacagctcaactgctctctccacaggcaatttctttcagttgaattttattttattttgttttcagcttttattttaaatacggggagtacatgtgtaggattgttatgtggatatattagaccaagtaatgagcataatactcaataggtggttcttcaacccaagcccctctcgttttctcccctttctagcaggtcaccgtgtatattattctcatggttacattcatgtctactcaatgtttagcggcaacttacaagtgagaatatgtggtatttggttttctgtttctgcattaattcacttaggattatggcctccagctccattcatgttgcgaaaaagacatggtgtcattttttatagctgtgtagtattccatggtgtatatataccacatttaattgatcccatctaccattaatgagcacctggattgattccatgtcttcggtattgtgaatagtgtggcgattaacatacaagtgcatgtgtttgtttgtttgtttgtttttttcatataatgatctatattcttttaggtatatacccaggaatgtgattgctgtgtcaaatggtagctctgccttaacttctttgagacatctttaagctgttttccacaggggctgaactattaataatttacaaatttacattccaaccaacagtgtataagtgttcccttttctctgcagcctcaacagcatctgttgttttttgactttaataatagccattctgactggtgtgagatggtatctcatggtggttttgacttgcatttctctgatgactagtgatggtaaacttttttttattatactttaagttctggggtacatgtgcagaacatgcaggtttgttacataggtatacacatgccctggtggtttgctgcccccatcaacccatcatctacattaggtatttctcctaatgctatccctcccctagtgcccccccacccgccgataggccccggtgtgtactgtttccctcactgtgtccatgtgttctcattgttcaactcccacttatgaataagaacaagtggtgtttggtttcctgttcttatgttagtttgctgagaatgatggtttacaaattcatccgtgtccctgcaaaggacaggaactcatccttttttatggctgcatagtattccatggtgtatatgtgccgcattttctttatccagtctatcattgatgggcatttgggttggttccaggtctttgctattgtgaacagtgccacaataaatgtatgtatgcacgtgtctttatagtagaatgatttataatcctttgggtatatacccagtaatgggattactgggtcaaatggtatttctagttctagatccttgaggaatcaccatactgtcttccacaatagttgaatcaatttacactcccaccaacagtgtaaagcattcctatttctccagatcctcaccagcatctcttgtttcctgactttttaatcatcaccattctaactggcatgagatggtatctcattgtggttttgatttgcatttctctgaagaccagtgatgatgagcttttttttatatgtttgttggctgcataaatgtcttcttttgagaaaaactgaaagcattccctttgaaaactggcacaagacaaggatgcccttgctcaccactcctatttaacatagtattggaagttctggccaggacaatcaggcaatagaaagaaataaagtgtattcagttaggaaaagaggaagtcaaattgtctctctttgcagatgccatgattgtatatttagaaaactccatcatctcagcccaaaatcttcttaaggtgataagcaatttcagcaaagtctcaggactaccattgactttcttcacagaattggaaaaaactactttaaatttcatatggaaccaaaaaagagccctcatagccaagacagtcctaagcacaaataacaaaactggaggcattatgctacctgacttcaaactatactacaaggctacagtaaccaaaacaggatggtactggtaccaaaacagatatatagaccaatggaacagaacagaagcctcagaaatagcaccacacatctacaaccatctgatctttgacaaacctgataaaaagaagcaatgaagaaagtcattggtagtttgatggggatggcattgaatctatagattaccttgcgcagtttggccattttcatggtattgattcttcctatccatgagcatagaatgtttttccatttgtttgtgtcctctcttatttccttgagcagtggtttgtagttctccttgaagacgtccttcacatcccttttaagttgtattcctaggtattttaattctttgtagcaattgtgaatgggagttcactcatgatttggctttctgtttgtctgttattggtgtataggaaggcttgtgatttttgcacaatgattttgtatcctaagactttgctttcagtttttacccattcagtatgatattggctgtgggtttgtcataaataattcttattattttgagatgcattgcatcaatacctagtttattgagagttcttagcatgaaggggtgttgaattttgtcaaagaccttttctgcatctactgagataatcgtgtggtttttgtcattggttctgtttatatgatgggttacatttattgatttgcatatggtcaaccagccttgcatcccagtgatgaagccaatttgatcatggtggataagctttttgatgtgctcctggatttggtttgccagtatcttattgaggattttcgcattgatgttcatcagggatattggcctgaaattttctttttttgtgtgtctctgccaggttttggtatcaggatgatgctggcctcacaaaatgaattagggaggattctctctttttctattgtttggaatagtttcagaaggaatggtatcagctgctttttgtacctctggtagaattcggctgtgaatccgtctggacctggactttttttggttgctaggctattatttcctgcctcaatttcaggacttgttactgatatattcagggattcgacttctccctggtttagtcttgggagggtgtatgtgtccaggaatttctccatttcttctagatgttctagtttatttgcatagagttgtttatagtattctctgatggtagttagtatttctgtgggatcggtggtgatatcccctttatcattttatattgcagctatttgattcttctcttttttcttctttattagtctggcttgtggtctatctattttgttaatcttttcaaaaaaccaactcctggattcattgattttttgaagggtttttcatgtctctgtctccttcagttctgctctgatcttagttatttcttgtcttctgctagcttttgaatttgtttgcacttgcttctcaagttcttttcattgcgatgctagggtgtcaattttagatctttcctgctttcccttgtgggcatttaattagtgctataaatttccctctacacactgctttaaatgtgtcccagagattctggtatgttgtgtctttgttctcattgttttcaaagaacatctttatttctgccttaatttagttatttacccaatagtcattcaggagcaggtcgttcagtttccatatagttgtgaggttttgagtgagtttcttaatcctgagttctaatttgattgtactgtggattgggaaactgttattatttccattcttttgcattttctgaggaatgttttacttccatttaagtggtcagttttagaataagtgcgatatggtgctaagaaaaatgtatattctgtcgattttgggtggagagttctgtagatgtctattaggtccacttggtccagagctgagttcaatcctggatatccttgttaattttctgtctcattgatctgtctaatattgacagtggggtgttaaaatctcccactattattgtgtgggaatctaagtctctttgtaggtctctaagaacttgctttatgaatctgggtgctcctgtatggggtgtatatatattaggatagttagctcttcttgttgcattgattccttaccattatgtaatgcctttcttttctcttttgagctttgttggtttaaagtctcttagagtctaggactgcaacccctgctttatttttgctttccatttgcttggtaaatattcctccattcctttattttgagcctatctatgtctttgcacataagatggggctcctgagtacagcacttcgatgggacttgactctttatccagtttgccagtctgtgtgttttaattgggcatttagctcgtttacttttaaggttaatattgttatctttgaatttgatcctgtcattatggtagctgcttatttttcccattagttgatgcagtttcttcagagtgtcaatggtctttacaatttggtgtgtttttgcagtggctggttttggttgttcctttccatgtttattgctttcttcaggagcccttgttaggcaggcctagtggtgacaaagtgtcttagcatttgcttgtctgtaaagtattttatttctccttcacttatgaagcttagtttgactggatatgaaattctgggttgaaaattcttttctttaataatgctgaatattggcccccacactattctggcttctagggtttccactgagagatctgctgtagtctgatgggcttccctttgtaggtaacccgacctttctttctggctgcccttaacattttttctttcatttcaaccttagtgaatctgatgattatgtgtcttggggttgctcttctcaaggagtatctttgtgatgttctctgtattttccgaatttgaatgttggcctgccttgctaggttggggaagttctcctggataatatcctgcagagtgttttccaactttgttccattctccctgtaactttcaggtacaccaatcagacgtagatttggtcttttcacatagtcccatatttcttggaggctttgttcatttcttttcactcttttttctctaatcttgtcttcatgctttatttcattgagttggtcctcaatctctgatatcctttcttctgcttaatcgattcagctgttgatacttgtgtatgcttcatgaagttcttgtgctgtgtttttcatctccatcggatcatttatgttcttctctaaactggttattttagttagccattcatctaaccttttttcaaggatcttagcttccttgcattgggttagaacatgctcctttagctcagaggagactgttattacccaacctctgaagcctgcttctgtcaatttgtcaaattcattgtctgtccaattttgttcccttgctggcgaggagttgtgttcctttggaggagaagaggcgttctgatttttggaatttttagcctttttgcactggtctccccatcttcgtggatttatctgcctttggtctttgatgttgttgacctttggattgggtctctgagtggacgtcctttttgttgatgttgatgctattccttttggtttgttagttttccttctaacagtcaggcccctctgctgcaggtctgctggagtttgctggaggtccactccagaccctgttttcctgggtatcaccagcagaggctgcagaatagcaaagattgctgcctgttccttcctctcgaagctttgtcccagaggggcacctgacagacgccagccagagctctcctgtatgaggtgtctttcggcccctgctgggaggtgtctcccagtcaggatacatgggggtcagggacccacttgaggaggcagtctgtcccttatcagaccttgaatgctgtcctgggtgatctgcttctctcttcagagctgtcaggcaggggcatttaagtctgctgcagctgcgcccacagctgtccctcacctgggtcctctgtcccagtgagatgggggttttatctataagcccctgactggggctgctgcctttttttcagagatgccctgcgcagagaggaggaatctagagaggccttctggccgcagtggccttgctgagctgaggtgggctccatccagttcaaacttcctggcagctttgtttatactctgaggggaaaactgcctactcaagcctcagcaatggcagacgcccctccccccaccaagcttgagtgtcccagatcgaccttagactgctgtactggcagtgagaatttcaagccagtggatcttagcttgctcagcttcatggggatgggacctcccgagccagactacttggctccctagcttcagccccctttccaggggagtgaacggttctgtctcgctggcattccaggtgccactgggatatgaaaaaaaaaagctcctgcaaccagcccagtgtctgcccaaatggccgcccagttttgtgcttgaaacccagggccttggtggcgtaagcaccggagggaatctcttggtctgctggttgtgaagactgtgggaaaagcacagtatctgggcaagagtgcaccattcctcaaggtacagtctctcacggtttctcttggctaggggaaggaaatccaccaaccctttgtgcttcccaggtgaggcaacaccccactctgcttcgtcctgccctccatgggctgcacccactgtccaaccagtcacaatgagatgaaccaggtgcctcagttggaaatgcagaaatcacccaccttctgtgtcaatcttgctgggagctgcagaccagagctgttcctatttagccatcttgctggcaaccaatgaacattttttcatgtttgttggcagcttgtatgtcgtcttttgagaagtgtctgttcatgtattttgcccactttttaatggagttatttagtttttgcttgttgatttaagttccttccttatggattctggatattagacccttgtcagatgcatagtttgtgaatattttatcccgttctgtgagttgtgtttattggtgttttcttttgctatgcagaagctctttagatactggcattggtggttcagtggtagaattctcagttgaattttatttaatgggttatagacactacacagttagcacaaattgacaggcatacagatgaagttaaaaccccaatttttttctgtttcaccctctatccttgttatctgaacaataggcttggtaacagcaatatgataatgttatttttgcttaagattgtcgtaagcatttgatcctacattttatgagtgtggaactgaaacttgagaaaagtggtatccaagggagacttgaatttgtatcactgcagcttcagaagtgctggaggagttacaaccctagtgaaatatagccaagcatgcagctgctgaaggaaaacagactccacctaggaatctggtgaaacctcctctggctgagatacagcaaaataataaattggggagaaagttatttttggctttaatttctttgggaattcaatttctacatagtacatagatttcagcatgaaattttaactttcctgaaacttaatacttagagtggtttcatattgttcaaatgtagacattctgatattgctgttctgatgttgcattatttggactatgctaccatgcagtactcattgaaccaggttggaaaattgtagctatgcataatttcgtgtgtgaaataaaatagcaagtaaatgtttgaactgttgtgcagctttggtcctaggaggataaacaaaataattgatgagtgtcagggagatggtgttagaaaaggaggggtagaactcatgggtcttccctcacaagggggatggttatggctgaccatcatcttgactattaagcccaaagaggtgagagaaaaaatgcagaataatctaaggggagaggagtcccgatggctcttttcacatcagaaataactctagcagatggtttccacatgttttcctactattttcttccctctttctaaacggaagggaacatcaaaccaacagatcagaatgtgagacatgcctggatcacatttacttgtaggccaaagaatgggaacactagactacagaccaggcagctgggcaaagccttggtctcagctgctcctccttccattttgctgggatcatcaaagttctttctttttagctatatgcagctgatagaaaggtaatatttttattcatccttagttagggaaatactagactctcttagaactctagccaagtacttcaaatcaggtttcccagaactctgtattagacatattgggccctggtccaactaataataacatgatgctctgttcccagttttttaattgttctgttctcagggaacaattgagaattaagagtaaggcagaatctgagcattcttggttattctagccaaaaccaacaaaatctcttcacattcccaatacgattcatcttctaactttattctagcaggtacttatgggattatctactccaaaactctctctaaaaagtctgctctcatcttttttgtgcatcctacaacctacatggttgcaacaagagttgttatattattacaacatgatcatactccctaaacatagttgattggaccaggggataagtacattatttcaggcgggccaatcaatactttccctagggtaaagaagcagcatcagctgcatctgtctcttttatcagaaaagcaagagcttttccataagcttccccaggtgattcccacttaagatcattggtcaaaactgggtgcatggccaccctgacttgaaggaagctgggaaagttagtatctcacctgaagctggccacaatgatgcccagaaccaatttaagtctctttttggcaaaaaagaaaaggggaatgggtattaggaaggcaattaacagggtcggccacattaatatatttatttatagatataatgcaaaaataaatttgctaaatataaacctagctgccttgcaaggagagtaattcattttaaaaatgaacttttttggctatatatctttatggattggggtaagcaagctagtaggaaggaattggggaggataaaagtgttctgcataatagaggggaatgtgtttgaaactatgggagcaatcttggagggagaagactaagagaagagatgggaagaggaggaagaagatgatgaagacacgtggttcctgctctgagctttctctttacctccaaatctttaacaaagtctagaactcatgaaagtattattgtgaatagatttcttgtataaactagtgaagggttgaggtccatatgtatactgtattaaaatgaaatatgtataggaagtgcagatgcaggaggcagagaaaagaacctgagaaaagagtgtataagcccctgggattatcatagaatcatgaggaaagtcaggagttcacatatcatggaatgagagaggcctaaaccaattattccaagatctttgaggagtaaggctaacccagccaacatttggattttatgtgtttcttgtccttaccaagtggtgatccccttgaggagtgaggtgccatcatacccatcattgcatggaacatagtaggtaatctataaatacttgttgagttaaattgaatagacctgacctatattgaatttctcaatatgcctattttaactcctttagtaaattagactgtccattaagagtgtgtctgattcagtgttttattaaatgagatgcctaaaacatagtaggtgcttcaagggccaattttcaaagccctgcttttatggagagaaataatgttccaggtaatctgagtcctatttctagcatgctctggaatactggttctgatttcttggcattttgtttcccttaggctgatatgaaaaggaatttttattctcaagcaaatattaattgatggcaggggaaggccacacagatacatgctgtgtggcagagggaaaccagtttgggattttaatttgccaccaatgattagccaaatggacaatcaagaattggcagtgtacagccattactcacaattagaagttgtttaggcagttcatttattctaagtataactgggtacagaaacaagactggaattatagacacataatattgagaattatatgaaattgtaggtgatttttgctttctgtatcattttgtgcaatttcatgctactgaatatgttcataaatgttctttaaaataaattcagttcagttttgttgatgggactagaactaacatttactgaataactattatgtgttgagcactacactacacactttataaatatatcatttaatctttggagatagtttattcacccaattttatggattatataactgagttccagagaggcaaagtgactttcccacagattacagccaaaaagtgcaaatatgaagacttaaacccagttttttctgtagagcttggtgaaatatgaattgctgagcttccacagttcctcccatgaattgctctcacagtttttgacttagtagttttagggaaaggctgagagtttgcattctaaaagtgcccaggttatgctgactgtgctgttcttggaatgacaccatgggaaccatagctccagggaatctaagtatataaaagccttaagtcatctcatcttgggtttccaaatcagtgtaccaaggcacactagtgtgaattataagtgtgcagaggaatcccttttgccctcaaaatggttgtgtaggacctagggaaactagtcactcaagccacaagcagccctgttgtttacctccggtgtgctatacatacaagtattattttctgtcatgtaaaaggaattagaaagcacccatctagtccatccactcatgaggcctgaatcctttctacaaaaatctctaacagatagtcagattctgcttgaattccttcaaagatggggaactcattcacctatgaaatatttagttccaatttaagactgctctaacctgattattataaagctttttttttctacacaagcagacagctgtgagaagagagagcagaagagaaaatatctgaatcatgagttgttagcccatggcagaatgtttaaatggatgttctggagttgtccatcatttcttttctgtaattgttttgctgcataacaaattacccctaaaatctagcagcttaaaacagctgacatttattatctcactgtttctgtgggtcaagaatccaagcataccttgattgagtcctctgcttcagggtctttcacaggtaactatcaaggtgttggctggactctagtcagctcgagactcacctttggtataatctactttcaagttcagatggtcgttggcaggattcagttatttgtggattgttggactgaggggcctcagttccttgcttgttattgaagagagactgccattagttccttgtcacaagagctttttcaacatggcagcatgttttatcaaggcctgcaagctaaaaaaaatcaataaagagagtctgctagcaagagggaagttgcaaacttttgtaacctaatctaggaaatgacatcccgtgagttttgctatattctgttcatcagaagcaagtcactaagtctagcctgcccctaataggaggggattacacagagaaatggatactagaaggcagggatcactggagccactttagaaatttacctattacatgaatacttccacactccttagaatagctatccctggcaaagccccaacaaggcaaccctcctcactgtttcctgattgccctgggttggaggttagacactgacttggattagaccacacagagactatatcacttgctgcagggatttgagctggcaggtccttgtatcagagacttataactgccaacacggtatccatttccattttcttcgttgctagcacgcctgagatttttttcaggtccaccatgtgcctagttcacttcccctgctccctttgcatgcagcttggtgtggccataagactagttctggccaatgaaatgtaagggaaaatttgtcgagcatttctgaaaatgcttttctttcccaataaaaagagacaaaaacagctagaatttctatctctttctttatctttcctgccacgaatatggatatgatggccggaattgaagtaaacaccttgcaagcacatggagaaggtcactgaaatgttagtcctgctatcattgagctaatctatcaacattgataaccccctgcatctatacttattgaatgagaaaaacccttgtttaagccactgtagttggaattgtttattgctgctgaaaccatgcctacctgatgtagtcatgtagagaactgggacttacatttttgggcaactatgattagctaagcacactcggatagtgaacagaggataaatttaaaaatatgattgttgagcagatgttttgagagaggaagaagtaagattatgtagtacaagagagagtgaatgagagcaagagagggaaaggttttccagttctctgagacataacttggttcttctaagtgtgttacacaagagtctctactgtatcattacaataaccctcaattacttgagctaatttctgtaactggcaaccaaacgtgccttgcatgaatacttgagttatttttttaaagcatgtgacttaaagattgcaattaatgtactagatttctttcttttttttcttttctcttttctttctttctttctttctttcttttttttttttttttttttttgagacggggtcttctgtcacccaggctggagtgcagtggcacaatctcggttcaccgcaacctctgcctcccaggttcaagtgattctcctgcctcagcctcccaagtcgctaggattacaggctaatgtactaggtttctttatggctttcatagctgtagagctacctagactggagtctgccaaacaactacattaatgtaggccactcaaagatggcatgccttcatgcctgtaatcccagcactttgggaggctgaggcaggtggatcacgaggtcaagagatcgagaccatcctggccaacgtggtgaaaccctgtctctactaaaaatacaaaaattagctgggtgtggtggcatgtgcctgtagtcccagctactcaggaggctgaggcaggagaatcgcttgaacccaggaggcggaggttgcagtgagccaagattgcaccactgcacttcagcctggcaacagagcaagactcagtctaacaacaacaacaaaaaaaaatacaaaaaaaaaagatggcatactttatcccctgcatctgaccattattggccccagtcactgcagattgactcaccagggaactcgttcacttccacaaaatatttgttgatgtccatctcaatttgtgtcccagatctatggggttgtaattttcttggtttactaccataatctgattgtcaaaaaagactgtaaattgcatcctgggagaagaacttcactgccaccatacgttatacaaatattgaaattgggttccagacctctccctcacccagggcctcgctaaatccagctaattctctcacagaccagaatcacataagaattgagccaggaaaatggattgagcaaagggggaacatggtgtaacacagtggaaagaatatgggctttagagtcagacagactcaaatctagcctcagtcacttagctaagcgaccctgaaacaagtcactcacctttttgagcctcggcttcctcaaaagtgatataaggataataatacctatcatagaattatagtgaggaacaaaactatcaacatttgtagaaaagctctttgccttatgcttggcatgatgaagtttttttttgtttgtttgtttgattttttatctaaaccttagaagaaaaagactgtttattctgtttctcagctaccaactcaagatccaacttaaatctcatttattctgaaagcctcagcattaagctgaaaaaactaattcaccaaagaggttatctaaatttttaaatttctctgagtttatgcaggtataatcaaatactactttcaataattgaaataacagtttgaaaatagtaactatgaaaataaattctgtatttatattaaataatctctccatgtcctatcaacaaaaagttcatcatattggctttaaattatgttttactgaatatatttaaagaaatgcatattctaaaatatgtcaataaaggaacatgtggtcttttccctaattattttatgtggcttaagaaatattttggaaaaaatcttactgacatactcagtctaaaagataaagctcgtctgagctccagtaagaggagagatttggggaggaataaaaattaatttgtggctcttttacaaagtatctcatcccctaatcccacccttcccctactatgggatagcttcaataggagtggaatcccaaaaaagattggaaatattccttatgggaatttaagtcaatcccaaagaaaaaaaaagatttgaaagtcctgaattatttgagtataactgagaaaagccctaatgtgacttaatatatctggactttactaggctaagttttctgtcactggacaggaagcggacttgaggtagtactaagtttgattgtaagtaaagttacaatgtttgcacatctgagtgtgcagattgaaaataagatgtccattacacatgtgagcagaaacacaaacaataagggtcttcaattaagaaaatagacaattccattgtggagaccaacagaaccagagggaagagaaattttaaaaagaccaaaagagaaactaaaggtttatcctaatttgtgagtggtgggcacttggaagttgatgcatcctttttatggttgttttatacattagtttaggctaatagatagtaaaaagtcattgtctttattcaagaatgtgagttcaataattctcaatatgttcctttgtcttcacaaattctggcattaaatgtgactgctccaggcattcctacctaggttatgtagtgtcaggaactctggagagtatgagattttaccctatgtgcaagacaacaagttaggctgacacagtttcattggtgctgactgaagatatgacactcctgggtcaaagacaaaggactttattacttacagcacagcaagtaccataaacatcacatttatgttggttacccttgccccccaagtctcacaggagtaattcaaaagggcccaggtgtatggatgcacatgcagtggatttgtgccatgctgaagaaccctgaacttagggaacctgaatctttcataatacacagcaaacaaacctgcctgacttttgctttgcagggaaacattacctttattatactgaagaataagcaaaccttctatgctctgaatgaagacactatctctgttttccaagattgtttgctatacaaatatccttgaaaagatagttggcacaggatagaggattctggggcaatggtggagtggaaagcatcacgaatctgtctccccacctagacagcagttgcactggcagagtctgcctgatagtaactattttcaaactctggagtctattgaaggcttgcaacttctgagagaaggcttggacagtaaggtgtagttaatttgggtcaatttcaggtcttagcacagtagcagctacccattctccctgcactcatccgtgtggcaggcagctgtgccctgtgttcctgaagtagcttgcaaagagcttgtgggagtctgcagggcacaaaaaggaccttgtcttccaaatattggagaactttgcttgtattgctaattactttataaaaaaataaaatattgtaaattattatggatacataatagttgtacatatttatggagtacatatgatgttttaatactatcgtaaaatgtgtaatggtcaagtcagggcaattgtggtgtccatcacctcaaacatttatcacctctctgttttaggaacattttaattctactcttttagttatattgagatatagaataaattattgttaacaatagtcaccctattgtgctaccaaacactagatcttattccttctgtttaactgtatttttgtactcattaacaatcccatctttatcccaacctccacactacccttccaagcctctggtaaccatcattctactctatctccatgagttcaattcttttacctcccacatattagtgagaaaatgtgatatttatcattctatgcctgacttacctcacttaacataatggccaccagttccatccaggttgttgcaaataacatgacttcattcttttttatggttgaataatatttcattgtgtgtatgtactacattttctttatacattcatctgttgatagacacttagtttgattccttagcttggctattgtgaatagtgctccagtaaacatgggagggcagttatctctttgatatatggatttcctttgtattggatgtatactcagcattgggattgcccgatcatatggtagttctatttttagttgtttgaggaacttgcatattgttctccatagtggctgtactaatttacatttctaccaactgtgtacaggggttctcctttcttcacatcctcaccagcatccattattgcctatcttttagacaaaagccatattaactggggtgagacaaaatctcatcgtagttttgatttccatttctctgataaatagtgatgttgaactttttttttgtatctgttggctgttcgtgtcttctgaaaattttcttttcacttattttgcctattttttaatcagattatttgttgttgttgttttcctattaagttttttgaactccttacgtattctggttattaatcccttatcagataggtactttgcaaatattttatcccattctatgtgttgtctcttcactttgttgattgtttccattgctgtgcagaagctttttagcttgatgtgatccagtttgtccatttttgttttggtcacctgagcttttggggccttactcaagaaaagcttgcccaaaccaatattctggagtgtttatccagtgttttcttctaatactttcatagtttcaggtcttatatttgaatatttaatcccatttaatttgattttgattcttgtatatggtgagagataggggtctagtttcattcatctgcatatggatatcccattttcccagcaccatttattgaagagtgattgattcttctgatcacagaggtacaaagaagccagaaggcattattgttgcacctccccagttgttacaagtcccttctcctctggctgcagtgacttccaagaagtttgaagggctggcaccctttttattttcccctgttacttttctctttttcccctcttcagagccagatattaaagactgggacattcaaaaacaactgtatatgtgaggaaaattaaaaaatgactgtgcctgcccagggcaaggctcagaaattacccatgaagactttagatttgcacttcaggctgatacttggcatagagacagtctacaacaataaaaacttcaaagcaataaataaaaacagtaacaaaaactagaaaaccctaggtaagggagacaatctgcttttcagagttaccaacattactagattcaaatgtccacttttcaatgataaatcacaaggcatacaaagaatggccctttttaaaggaaacgaataaataaacagaaactatccctcagaaagatctggtggcaggtatatcagacaaagactttaaaatagttgtctttttttttttttgaacaacaagtatttattagtgcctactatgtgccagacattcttcgagacacttcagatacatcagtgaacaaagcaaataactcagcatgcctgcatgaaacttacattttagtaaagtatagctggtttaaatatgtaactttactaatactaaacaactatggaaattatgattacagaataaaaggcaaatatttcaaatctggataaaataaatatcatgtaactggaaaattgttaaggagagaggagacaaagctagtaggtactaatttttcacaaagtgtctacttttaatgtttaaaattgaaaagcagtttaaaatacagttatatgctgcataatgatgttttggtcaactgcacatgcaaaggtcgccccataagattataatgaagttgaaaaattcttttttattgttattatactttaagttctagggtacatgtgcacaacatgcaggtttattgcatatgtatacatgtgccatgttggtgtgctgcacccattaacttgtcatttacattaggtatatctcctaatgctatccctcccccctcccaccaccccatgacagaccctgatgtgtgatgttccccttcctgtctccaagtggtctcattgttcagttcccacctgtgagtgagaacatgcagtgcttggttttttgtccttgcaatagtttgctgagaatgatggtttccagcttcatccatgtccctacaaaggacatgaactcatccttttttattgctgcatagtattccatggtgtatatgtgccacattttcttaatccagtctttcattgatgggaatttgggttggttccaagtctatgctattgtaaatagtgctgcaataaatatacgtgtgcatgcgtctttatagtagaatgatttataatgctttgggtatatacccagtaatggaattgctgggtgaaacagtatttctgcttctagatccttgaggaatcgccacactgtcttccacaatggttgaactaatttacactcacctcaacactgtaaaagcattcctatttctccacatcctctccagcatctgttgtttcctgactttttaatgatcaccattctaactggcgtgagatggtatctcattgtggttttgatttgcatttctctgaagaccagtgatgatgagcctttttttcatatgtttgttggctgcataaatgtcttcccttgagaagtttctgttcatctccttcacccactttttaatagggttgctttttttttttctaaatgtgtttacgttccttgtagattctgtatattagccctttgtcagatggacagattgcaaaaatactctcccattctgtaggttgcctgttcactctgatgatagttccctttgctgtgcagaagctctttagtgtaattagataacatttgtcaaatttggcttttgttgccattgcttttggtgttttagtcatgaagtctttgcccgtgcctatgtcctgaatggcattgcctaggttttcttctagggtttttatggttttaggtctaatgcttaagtctttaatccatcttgagttaatttttgtataaggtgtaaggaaggggtccaatttcagttttctgcatatggctagccagatttcgaatccttttcccattgcttgcttgcgtcaggtttttcaaaaatcagatggttctagatgtgtggcattatttctgaggcctctgttctgttctattggtctatatctctgttttggtaccagtatcatgctgctttggttactgtagccttgtagtatagtttgaagtcaggtagcgtgatgcctccagctttgttctttttgcttataattgtcttgggtatgagggctctttttggttccatatgaaatttaaagtagttttttccaattctttgaagaaagtcaatggtagcttgatgggggtagcattgaatctataaataacttcgggcagtatggccattttcatgatatttattcttcctatccatgagcatagaatgtttttccatttgtttgtatcctctcttatttccctgagaagtggtttgtagttctttttgaagaggtccttcacatccctttgaagttttattcctaggtattttaatctctttgtagcaattgtgaatgggagttcactcatgatttggctctctgtgtgtctattattgttgtataggaatgcttgtgatttttgcacactaattttgtatccagagtctttgctgaagttgcttatcagcttaaggagatttggggctgagatgatggggttttctaaatatacaatcatgtcatctgtaaacagagacaatttgacttcctctcttcctatttaacacactttatttctttctcttgcctgattgccctggccagaacttccaatactatgttgaataggagtggtgagagaggatattcatgtcttatgccaggtttcaaagagaatacttccagcttttgcccatatagtacaatattggatgtgggtttgtcataaatagatcttattattctgagatatgttccatcaatacctacactattgggagtttttagcatgaagccatgttgaattttatcaaaggccttttctgcatctattgagttaattatctggttgttgtcattggttctgtttatgtgatggattacgtttattgatttgcgtatgttgaaccgtccttgcatcccagggatgaagttaacttgattgtggtggataagctttttgatgtgcttctggattcggtttttcagtattttattgaggttttctgcattgatgttcatcagggatattggcccgacattttcttttattcttatgtctgtgccaggttttggtatcaggatgatgttggcctcttaaaatgagttatggaggagtccctctatttctactgtttggaataggttcagaaagaatggtaccagctcctctttgtacttctggtagaattaggctgtgaatccatcctgggcttttttggttggtaggctattaattactgcctcaatttcagaacttgctattggtctattcagggattcaacttcttcctggtttagtcttggaagtgtgtatgtgtccaggaatttattcatttcttctagattttctagtttatttgcatagaggtgtttatagtattatctggtgttagtttgtgtttctgtgggattggtggttatatcccgtttataatttttttttttttttgagacatagtttcactctgtcacccaggctggagtgcagtggtgcgatcttggtttactgcaagctctgcctccggggttcacgccattctcctgcctcagcctcccaagtagctgggactacaggcacccgccaccttgcctggctaatttcttgtatttttaatagagacggggtttcgccatgttagctaggatgttctcaatctcctgacctcgggattcgcccatttcagcctcccaaagtgctgggattacaggcatgagccaccacgcctggccccctttgtcatttttatcatgtctatttcattcttctcttttttcttctttattagtctcgctagcagtctatctattttgttaatttttcaaaaaacgagcttcttcattcattgattttttgcagggtttttttgtgtctctatctctttcagttctgctctgactttagttatctcttgtcttatgctagcttttgaatttgtttgctcttgcttttctagttgttttcattgtgttgttagtgtttgattttagatctttcccactgtctgatgtgggcatttagtgctataaatttccctctgaacattgctttagctttgtcctagagaatctggtacattgtctttgttctcattggtttcaaagtacttatttatttctgccttaatttcgttatttacccagtagtcattcaggagcagattgttcattttccatgtagttttgcagttttttttttttttgaatttcagacaatgaatttttttattataaatatatcccaaatattgcattatttttcttttttttttttattgatcattcttgggtgtttctcgcagagggggatttggcagggtcataggacaatagtggagggaaggtcagcagataaacaagtgaacaaaggtctctggttttcctaggcagaggaccctggggccttccgcagtgtttgtgtccttgggtacttgagattagggagtggtgatgactcttaacgagcatgctgccttcaagcatctgtttaacaaagcacatcttgcaccgcccttaatccatttaaccctgagtggacacagcacatgtttcagagagcaccgggttgggggtaaggtcatagatcaacagcatcccaaggcagaagaatttttcttagtacagaacaaaatggagtctcctatgtctacttctttctacacagacacagcaacaatctgatttctctatcttttccccacatttcccccttttctattcaacaaaaccgccatcgtcatcatggcccgttctcaatgagctgttgggtacacctcccagacggggtggcggccgggcagaggggctcctcacttcccagaaggggcggccgggcagaggtgccccccacctcccggatggggcggcagctgggcggaggcgccccccacctcccggatggggcggctggccgggcgggggctgaccccccgcctccctcccggacggggcggctggccgggcgggggctgaccccctgcctccctcccggacggggcggctggctgggcgggggcagttttgcagttttgagtgagtttttaaatcctgagttctgatttgattgcactgcagtctgagggactgtttgttatgatttccattcttttgcatttgctcaggagtgttttacttccaattatgtggtcaattttagaataagtgtgttgtgttgtgttggtgagaagaatgtatattctgttgaattggggtggagaattctatagatgtctattagttccacttggtctagagctgagttcaagtcctgaatattcttgttaattatctggctctttgctctgtctaatattgacagtggggtgttaaagtctcccactattattgtgtgggagtctaagtctctttttacgtctctaagaacttgctttatgaaactcggtgcttctgtattgggtgcatatatatttaggatagttagctcttctagttttattgatcactttaccattatgtaacacccttctttgtctttttgataattgttgttttaaaatttgttttatcagagactaggattgcaacccctgcttttttttgctttcaatttgcttggtaaatattcctccatctctttattttgagcctatgtgtgtctttgcacataagatgggtctcctgaatatcgcacatcaataagcttaactttttatccaatttgccattctgtttcttttaattggggcatttaacccgtttacatttaaggttaatattgttatgtgtgaatttgatcctgtcattatgatgctagctggtgattttgcccattagttgatgcagtttcttcatagtgttgatggtctttacaatttggtatgtttttgcagtgattagtacagtttttcctttccatgtttagtgcttccttcaggatctcttgtaaggcaggcctagtagtgacaaaatctctcagcactgcttgtctgtaaaggattttacttcccttttgcttatgaagcttagtttggctggatatgaaattctgggctgaaaattcttttctttaagaatgttggatattggcccccaataaccctacaatcttctggcttctagggttcctgcagagagatctgctgttagtctgatgggcttccctttgtgggtaacctgacctttctctctggctgcccttaacattttttcctttgtttcaaccttggttaatctgatgattatgtgtcttctggttactcttcttaaggaatatcttggtggtgttctctttttttctggaagttgaatgttggcctgtcttgctaggttggggaagttctcctagataatatcttgaagagtgtttaccaatttggctccattttccccatcactttcaggtacaccaatcaaatataagtttggtcttttcacatagccccatatttcttggaggctttattcattccttttcattcttttttctctaatcttgtcttcatgctttatttcattgagttgatcttcagtctctgatatactttattctgctgatcaattcagctattgatacctgtgtatgtttcacgaagttctcgtgctgtgtttttcatctccatcaggtcattcatgttcttctctaaactggttattctagttagcaattcgtctaaccttttcccaaggtttttagctctcttgtattaggttagaacatgctcctttagcttggaggaatttgttgttacccaccttctgaagcctacttctctcagttcatcagactcattcttgtttggtttgtttcccttgctgaagaggagttgtgattctttggaggagaagaggcatcctgggttttgggattttcagactttttgcgctggtgtttcctcatcttcatggatttatctacctttggtctttgatgttggtgaccttctgatgggatttctgccaggacgtcctttttttgttgatgttgatgctattcctttctttttgttagttttccttctaacagtcaggcccctctgctggagtttgctggagatccactccagaccctgtttgcctgggtgtcaccagcagaggctgcggaagagcaaagattgctgtgtgttccttcctctggaagcttcttcctagaggggcacccaccagatgccagccggagctctcctttatgaggtgtctgttggcgcctgctgggagatttctcccaatcaggaggcatgcaggttagggacccactttaggaagcagtctatcccttaagcagagctcacatgctgtgcttggagatgtgctgctctcttcagagctggcaggcatgaacgtttaaatctgctgaagctgtgcccacaaccgccccttcccccaggtgctctgtcccagggagatgggggttttatctataagcccctgactggggctgctgcctttctttctgaaatgccctgcccagagaggaggaatctagaggggcagtcttgctacggaggctttgtcaagctgcggtgggctctgcccagtttgaacatgctggaggatttatttacactgtgaggggataagtgcctactcaagcctcagtaatggtggatgcccgtccccctaccaagctcgagagccccaggtcgacttcagactgctgtgctggtgtgagaatttcaagccagtggatcttagcttgctggactccatgggagtgggatctgctgagctagaccacttggcttcctggcttcagccccctttccaggggaatgaatggttctgtcttgctggcattccaggagccactggggtatgaaaagaaagctcttgcagctagctcagtgtctgcccaaacagccacccagctttgtgcttgaaatccagggccgtggtggcataggcacccaagggaatctcctggtctgcaggttgcgaagatcatgggcaaagcatagtatctgtgccggaatgcacaattcttcaaggcacagcccctcagggcttcccttggctaagagtgagttccccaaccctttgtgcttcctgggtgaggcaataccccaccctgcttcagctcaccctctgtggtgggctgcacacagtgtctaacctgtcccagtgagatgagccacgtacctcagttggaaatgcagaaatctcccgccttctgcgttgatctcactgggatctgcagaccggagatgttcctgctcggccatcttgccagccaccccagtaattactttaaatgcaaacagattcaactttttaatcaaaggacaaagattggcagaatagattaaaaaaaaaaaaaaaaaaaaaaaaaaaaacacataatccaactgtatgctgtctacaagagattcactttcaatccaaagacacaaataaaaaaatgaaaggatggaataatattcatattaaatgaaaatagtaattcaaagggatcaggattggttatgctaatatcagacaaaatcaatttaaaaaaatgattataagagacaaagaaaaatagtatatattaataaagcatttaatatagccaatataaaattataaaatttatatacttaatgatggatcatcaaaatatatgaagtaaaagctgataaaattgaaggaagaaaatagataattctataaaaataattggagactttaatatcccactctcaataattgatagaacaaccagacagaagataagtaaggatatagaggacttaacacaacaaactagatctaacatgtgcagaacactacacaacaacaatagcacacacatttttctcaagtgcatatatttttgaggatagatgatatgttaggccacaaatttagccactctgtcagtgtttgcttcatatgttttgaggttctattgtttggtgtggatatgtttataattggaatatatttctgacctttttctcaatgtataatatcctagtttttctcttataatagaagtatttttgtctattttgtctgacattagtatagccacaccagctctcttttggatattatttggatggaatatattttccatcttttcattttcagtatggttgcatgtttagatctaaaggaattctcttgtagacagcatgtaattgaatcgtgtttgtaaatacattctgccaatctctgccttttcattgagagtttaatttatttatattttgtgtttacttctgccattttgctatttgctttctgtatgtcttatatcttttttgtccctcatttcctccattactgccttttctgtgtgtttagttgacttttttgcatgcacagtttctattgccttctcagtgcctcttgtttatacttttagatattttatggttaccatgtagattacatttatcaacctaaatttataacaatttagtttgaattgatactaatttaactttaatagcctacaaaaaatgctacttggcgaggcgtggttgctcacacctataatctcagtattttggaaggctgagccaggcagattgcttgaaccctggagtttgagactaacctgagcaatatggtgaaacccctatctctgccaaaaaagaacatattagccagccatggtggtgtggtcctgccatgcctgtagtcccagctactcagaaggccgaggtgggaagaacacccgcacctaggtgatcgaggctgcaatgacctgtgattgtgccactgcactccatcctgggcaataggtcaagaccttgtctcaaaaaaataaatgccactatatatctttgccccacactttatgttgttgtcacaaattacttctatgtatattgtgtgaccaataagagatttataattctttttacgagtttgtctcttaaatcatgtagaaaataaaaagaagtgttagaaaccaaaaatatgatattactggctgttagatttgcctgtttggttacctttaccagaaatctttatttcttcatatggttttgagttactgcctagttttcttttatttcaacctgaaggacttcctatatgttttctcataggggtggtccagtgttaatgaattccctcaccttttgttcatctgggtgtgtcttgatagtgccatcatccttaaagtatagttttgtcaaatataaaattcttgattaacaattttttcttttagcaatttaaatgttttcccactgccttttggcctccatggtttctgatgagaatcagctgttaattttattgaggatcccatatacagaatgagttgcttttctcttgttgctttcaagattatctctttgtctttggctttcaacaatttgattacagtatgtgtcagtttgtatcactttgaatttatcatatttggaatttgttgagcttatgggatgtatagaatcatgcctttcatcaaattttggaagtattcagtcattatttcttgaaatattgtttctaccatttctctctctctcttttttcgttctaggattcccaaatttgtatgttggtccacttaatggtgtaccacaggtcccttaggctctattcacctttctctattatcttctgtttgtggttcttaggactgggtacttccagttgtcctatcttcaggtttgctgattctgacttctgcctgctcaaattttctactgaacccctgtagtgaattttttttatttcagttattgtacttttcagcttaaaaatctgtttggttcctttttaaagttaatattcctatatgaatattttaattttgttcatacattgtttactgatttcctttagttcattgctcatggtttcctttagttcttttagcatatttatgacagttgtgttaaagtctttgttgcttcctcagagatagtttctgtttattttctttttgaataagctttcttttcctgtttattttttgtgacttgtgcttttttgttgaaaactggacatttggatattataatgtggtaactctggaaatctgattatttctctttctcagagttgggtgggttttttttttaacactgtaatagcctgtttcattacttttcctatttttgcagatactgtatttcttgtctgtggttactgaagtttctgtttcttagcttgtgttcacctatggttttgacatatttccttgaattccaagagctaaaacaaacaaacaaaaaattcacctatttctgtctttacaaattttctatgctgggccgctccttcatcacttagcctgatcttagcctttgaacactgagcctagggatcagcccacagtggaaatctgtgctcttatcaggttttttctgagtatgcatcttgtcttgggcataagtgtggctctctaaattatttcatatacagatactttgaatgccctgatttcccaagcaaactcccccagatttttctcccagacctgttgcatatttcattgctaatcttttgcctcaagcatcttcgtgttgtttatttgccttgctttacgatatttttaagcaatgctcacaagttttctgccctgagaggattccaaggtaggtaaagcagaaaagagcaccttgcatcattccttcaggcagcccccagacagttagaaaatagtttgcatgtgaggtctgctatgcttcttccagaaccagagtccagtgttccacactgagagtgtagctgctatcttcaagatgtagctaagtgtacctaaggcctgatgtggtggctcacgcctgtaatcccagcactttgggaggccaaggcaggtggatggcttgagctcaggagttcgagaccagcctgggcaatatggcgaaaccctgtctctacccaaaatacaaaaattagccaggtgtggtggcacatgcctgtggtcccagctactggggaagctgaggtgggaggatcactttagcccaggaggcataggatgcagtgaggcatagactgcactccagcctgagtgacagagtgagaccccatctcaacaaaacaaaacaaaagaccactgctaagcttgagaggcagtggggcaaagacaagtaaaaacatcacaagatatcctaccattttaaagttgcctttttcttgatttggcatgttctcagctactataaaccactctttttgagagcctgatgaagttgattctgacagtttctgcttctttttaaatattcctgtagagggatgggaatggagttgtttactctgccattttcctgatattacctagaaaatccttttttttttttttttaatgacaaggggattctgtgaaactgatttgcttttttccccatgaatcctagaaaagcatgactgattttgtaatttccttctgactttggctgttaagaagctctgagatagaattatggctaccactagcagttatgtaagattttgttttctagttctacttttgtatgtatcttactttatgcttttatttcccatttgtccctctttactctttcattttctttgtttttttgtttgtttgttttgcaatgtgtgtatctctgtaaactgcatgaaattctttttgtggaagaaggtgagagacaaataagggactaggattaagattctaatattttcacctactactgggccacctttaaactgttaaagaatctaccataagtatttgttgaaattctgttgctttaacaccacaatgttgcttcagtaaataaaaaagccaagcagagcacaaaaagtacatcacaaataataattcatgattgtgaaatgaattcctgaacctgactttcaaccatgaagttcaaaggctggaaatggtaaagtcaacaggaacaaattggaagtaaaaaaagagtgcagggttcctgaaacgaataatgtaaagcaaaacttttcatggatccctaagaatatcctaatttgaacaatataaatataatttttatttgacttgttttatttgacttgttttatttgacttgtttatataaagcattgcatagtggtcaacacatgagctctgtagtcagattgcctggctttgacccttgctgtgtcacttatgaacttggtgaccttgactagttacattacctctctgtgactctgtttctgccgctttaaaaatgagaataataatagagcctaattcatagcattgttgtgagaatcatactaataatacctgtaaaggtttaacagtgcctaggctatactaatcactcaatgaaagttacttattatttaatgatgaatcatcatgcaaaagtgaagttatgtttccataactgcaaaataaaatacttgaggcatttttttaagtggagacacaaacattttaaaattctgatatagacctttttcatgggaaataattatcttagacacatgaaaatacacctaagtaggatcttgattctgccatttagtaagtggttttggcaaatttacttcacctatttgcatctgagtttcctcatctgtaaaacgagagttgaactaacaactgccttgaggatgaaatgaaagactgcaggtaaagcaccaagcagagtgtttgcacataagtgctcaaacatttcttcttattattctgaaataaagagttggcaggtttaaaatgaagaggagggggtgctcttggggagtagggtagaggaagacccttagcaataagtagagtcttattccatttgcactgttataacaaagtaccattagctgggtgcctcattaacaacagaaatttgcttattgtggttctggaggctgagaaatccaagatcgaggcactagcagattccatgtctagtgagagcctgcttcctcatggatgactgtcttctcactgtaactttacatggcagaggcggaatgaacctctctctggcctcttttataagaacactgacctaatcacctcagaaaggacccagctactaataccatcgtcttgggtgttaggattttaacataatttttttaggaggacacaaagactcaggtcatagcaactaggaaacctgagattaagatctaaaatcaataaatcagacaacacacgaatggcagggtgataacaccaagacagggagcttgaagggaagaggtggctaaactgatgccatctccactgggggaatgttgtcaaataaaatacaagatgcctgttaaatttgaactttatataaacaaaaaaacctaatatgtctgaaatgttgcacgacacatacttgtacaaaaaaagtatttgttgtttatctgaaattcaaatttaactgggcatcttgtatagttgctaaatcttgcaactctatggtggaggatgcaacagccttgcttgcagaagttggctaatgagagcacagttaaggggcccaggaccagggtccaatacctgatgtgacatcactaagtttagctttctagtaggtgtgtcaggaagccaaggatccagattcctgtgaaatactcaggaatcaccaaggaagtaggacctgggatttgggaagattctgctccaggacacagtctgcatccaggaggtgcaaggattagatctgtcttaagtaagggtgttagcagacggtaaaagcaggttggagaatgacgagccttgatagtgcttggtatgtgtgggaggaaaagagggaatggaacttggcggtatcaaccacagtaaaccatcagcacagaagatgggacaaaagcagaaatctagccctgaagactgggcacaccatgaggcagagcaggcaagtccgaattagggaatgacgtaccaacatgactagttttggtccctgggataactaaattcttggtatgcttgggataaaggaagcttggggaattcagctattgtgagggatcacccaaacccaagtttgagaatgtgaataaattctgaaccccacaaggcagtgggcagaggttattataactcttgctgatgagcttataaactggagcatatttgagcctggatgtgggcattagtggattcagctacaatcttagcagacgtgtagctgacatagattgagggatgttcaatctgagcctgtcggagattggagtcaggcagggaaggtgaacaagaatgctcatttgctctgaatgtctcatttatgaaaggtcttaagttgagactgaagcgtttatattgtcactgaaataaggcatggtttgacatttttatgaagatataactcaccgtaaatttcaccaataaaaatatacagttatgttttaagtgtataatttagtacattttcagtgttttggaaccatcatgactatctaattcttgaacattttcatacctcatacccattaagaagtcactccccattttttcctccctgcagcccctggcaaccattaatttactctctgtctctatgtacttgcctatactgtatatttcacatgaatggaatcataaacatatagtcctttgtgtctgacttttacttaacatcatattttcaaggttcatttgctttagcatgtgatcaatacttcatttgttttatggatgaataatgtttcattgtaaagacggaccacaccttatttatccactcatcaattgatgggtatttgggttcatttctactttttgggctcttaaggttaatgctgctatgaacattcacatacaagtttttctgtggatatatgtttttatttctcttgggtatatacctaggagtagaattaatgagtcatatgggtaattctatgtttaacttgttgaggaactgccaatgtttctactttttttctttcactcctggcaagctgtgagaatagttttgtttgtttcattttgagacagggtgatgctatgtttctcagcctggtcttgaacttctaggttcaaacactcctcctgcctcagcctcccaagtagttggatttacaggctcgcaccactgcacccctccactttgtaatatgtcagggttcttaaaaaatagaaataaatttgagcctttcaaccactgataagtcctatgcttaaccagtattgaccactgggatgatcttcaaggtctagtggaggtaagtgtgacaatgtaacaccacaatgcctaaataaactcttatacaatcaccatcacatcttcccataccttccctcttttatcttcatttcacagagatagggagatttaaaatgaatattcagatctttcagctacactgaattttccaggtaatgatactttcttcacaggaaggcattattattttcccatttttgcagatgggaaaccgaggctccaagaagtaaagtgccttgtccaaggtcccacatccaatgagttgttaagcctacattgaatactaggattttcaatgcctggtctaggatcctttcagtgtagtctttgcccctatgtgcctctgaaaaaggtagaagattgctgatatatttgggctcccaaactgaaatcagacagcctcaaaaatgttgaaagttgatcattaacacaagagtggaaagaaagaagttggggaggaggagagaaggcatattgtttctctctgtgagcatagtatgactgagaataattcatctgaggggaagccgttcactccccatctgtacagcattaattcactgagggctgggtctacactaggccctggagatacagaaagagaaggaacagggctgaagctagagtgaggtgagtggaggtagttgacttgagcataattttaagggaatgctgaaaatctcagtaatcaagataaacaatattttttcttaggtaacttgttatttttattatagattcacatgcagttgcagaaaaatgatacagatagatctcatgtaaattgtactctgttttccccaatagtaaccccttgcagaactatagtacaataccacagagaagatattgacattaatataatcaagatacagaacatttccaccaccacaaggaaccctcatattgcccttttatagccacacctacttccctcccactaccattccctctgtaacctctggtaaccacaaatctgtttcccatttctatgattttgtcattcccagaatgttacatgaatagaatcatatccctttagggattgacatttttttactcagcataattctctggagattcacccacagatgtatcaatagttttctttattgttgaggagtattccatggtatggatataccaatttgtttaaacattcacctgctgaagaacatataggttgttttcagttttgggctattataaataaaactactataaatatgtataggtttgttgtaaacataaattttcacttttttctggggtaaatgtccaggattgcaattactaggtcatgtggtagttgcatgtttcttttttaaaaatacaaaactgacaaaccattgtccataatggttgtaccgttgtgcatgctcacctgcaatgtattagtgactccgtttctctgtatctttgccagcatttggtattgtcaccattttttaattttagtctttctgataggttatagcgatattgcattgtggtcttaatttgcgtttcccaaatggctaatgacgttgaagaaattttcatgtagttaccatctgtataacctcttcagtgaaatgtttcttcatatcttttgacaattgtttaaattgtattaactttttactgttgaactttgagggttattaatatattttagatgctagtcttttgttgaatatgtagttttcaaatattttctcctagtgtataccttgtcttttcatcttctttcacatagaaaaaaatttcaattttgataaagtccattttatcagcttttccttttatggattatgcttttggtgtcaaattaactcccattcacaactgcttcaaagagaataaaatacctaggaatccaacttacaagggatgtgaagaacctcttcaaggagaactacaaaccactgctcaatgaaataaaagaggatacaaacaaatggaagaacattccatgctcatggatagcaagaatcaatatcgtgaaaatggccatactgcccaaggtaatttatagattcattgccatccccatcaagctaccaatgactttcttcacagaattggaaaaaactactttaaagttcatatggaaccaaagaagagcccgcattgccaagtcaatcctaagccaaaagaacaaagctggaggcatcacgctacctgacttcaaactatactacaagcctacagtaaccaaaacagcatggtactggtaccaaaacagagatatacatcaatggaacagaacagagccctcagaaataatgccgcatatctacaactatctgatctttgacaaacttgacaaaaacaataaacgaggaaaggattccttatttaataaatggtgctgggaaaactggctagccatataaagctgaaactggatcccttccttacaccttatacaaaaattaattcaagatggattgaagacttaaatgttagacctaaaaccataaaaaccctagaagaaaacctaggcaataccattcaggacataggcatgggcaaggacttcatgtctaaaacaccaaaagcaatggcaacaaaagccaaaattgacagatgggatctagttaaactaaagagcttctgcacagcaaaagaaactaccatgagagtgaacaggcaacctacagaatgggagaaaatttttgcaatctactcaagggctaatatccagaatctacaatgaattcaaatttataagaaaaaaaaaacaaacccatcaaaaagtgggcgaaggatatgaacagacacttctcaaaagaagacatttatgcagccaaaagacacatgaaaaattgctcatcatcactggccatcagagaaatgcaaatcaaaaccacaatgagataccatctcactccagttagaatggctatcattaaaaagtcaggaaacaacaggtgctggaaaagatgtggagaaataggaacacttttacactgttggtgggactgtaaactagttcaaccattgtggaagtcagtgtggtgattcctcagggttctagaactagaaataccatttgacccagccatcacattactgggtatatacccaaaggattataaatcatgctgctataaagacacatgcacacgtatgtttattgcggcactattcacaatagcaaagacttggaaccaacccaaatgtccaacaatgatagagtggattaagaaaacgtggcacatatgcaccatggaatactatgcagccataaaaaaggatgagttcatgtcctttgtagggacatggatgaagctggagaccatcattctgagcaaactaccgcaaggacagaaaaccaaacactgcatgttctcactcataggtgggagttgaacaatgagaacacatcgacacaggaaggggaaaatcacaccctggggcctgttgtggggtggggggaggggggagggatagcattaggagatatacctaatgttaaatgatgagttaatgggtgcagcataccaacatggcacatgtatacatatgtaacaaacctgcaggttgtgcacatgtaccctaaaacttaaagtataataataataaaaaaaagaattcagaggtgataattttgagatgagtccaaaaaaaaaaatcctttgcttagtcctagatccaaaaggttttctcctttttttttctaaaagttttataggtttacattttacatttaaatccatcatccattctgagttaatttttgcataagatatgaggtcttttgagtaaaatttttttttcctaacagatactcactttctccaccatcatttgttgaaaagatcatcctttcatctttgtgggaaaaaaaaaaaaaaaacccagcaaaccagtttggcatatatgtgtgagtctatgtctgggtcctgtattctattccattgatccatgtcttttccaccaccaatactacacagccttgattactgtagctatctaataaatgttgacatcaggtagaatgatttattctactttattctctttcaaaattgtttttagctatttcagttcccttgcctttctatataaattttagaactatcttgtctgtgtcggccaggcacggtggctcacacctgtaatcccagcactttgggaagctgagacgggcggatcacaaggtcaggagattgagaccatcctggctaacacagtgaaaccctgtctctactaaaaatacaaaaaaattagccgggcttggtggcgggcgcctgtagtcccagctactcgggaggctgaggcaagagaatggcgtgaacccgggaggcagagcttgcagtttgcctagatcgcgccactgcactgcagcctgggcgacagagtgagactccgtctcataaaaaaaaaaaaaaaaaaaaaagaattatcttgtctgtgtctacggaaaatatttctggattttgatatcagtttccattaaacttgtatgtcaatttggagataattgacattttgtcccagtctttatcattaggctcctgccttgttctttatgccccaatttgctgtccaggtcaccaggtcctctaaaatgaagactggcttttctctcactggacaatctgtctaccttcctccattgcttccaccttagagactacctgaagtctggtagctggaacccctatttccatggacacaccatcttggagccaactgcccactgggaccttcaaaacatggactgccttggagctctccttgttctgcatctcctacctcttgggatgcccctactaatttacgtcatactccactggcttcctgaactatggcttgccacttaatataccgtagtccagctttatacctggagcctgagtcttccctcctcactaactaactccaatgtcagcatgtagtagcagagagatgggggaatgcctggccttagattctggccccttttagcttgacctggcttgccactgctaataaagctataccaggccacatcttgaaacatggaaggcagagcatctagcttgggactggaggactaatagaccaaaaagctgtctttgacaagtaaaggataagcatgtttgtcttaatagcactttttttcttgttgcatttctttgatctttggccaagccttgcttacttttatcctgtttttctgtctttaaaataaggacaaattggaataaatcactgtttttcaaatattttttaagcaacagatcactgtattgaaaaatatcttccacaaaatccccaaatatgaaaataataccaattaagttctagttaaaaaaggagtaggggtggcttcccttcactctaaaatcttagagttctgccaaacccagtttaaaaaccatggatatagctgtcttctgagaagcctttccagctttgatgcccactaacatttatagggttaaataagctgaggaagtaagagggtcaagaggagaaatgttcagtgagcctttactcaaaatgtgatggcttagaggagtgtgggctctagcaaccagcatgcctctgcttgccataggaaaattgattcaaggtttctaacggtgcctgcaacagatctagttctgaaaacacctgtctgggaaaccctttcagattctccctggtagagtttcttaatccctcttacattatcccagagtttactattcactcctccattataacacagcgcacattgtattgtcattgcttatttacgggcccatctccaaataagctatgagcatccccaaagcaggaactattcttatttctctggatctccagcccctaggacagcaggcaaaggacatgtcttctcaaaagaagacatataaacagcaaacaagcatatgaagaaattttcaacatcagaaataatcggagaaatgcaaattaaaactactctgagatactatcttataccagtcaagatggcttttaataaaaagtcaaaaaacaacagatgttggaaaaaagggaacggtcatacactgttgatgagaatgtaaattagttcaacctctatggaaaacagtatggatatacctcaaagaactaaaaacagaactaccattcaacccagcaatcccactattgggtatctatccaaaggaaaagaagtcattataacaaaaaagacccctgtactcatatgtttattgcagcactatttacaacagcaaagtcatggaaccaaccgaagtgtctaccaacagttgattggataaagaaaatgtggtatacatacaccatggaatactatgtagccataaaagaacaaaatcatgttctttgcagcaacgtggatggagttggaggccattattgaaaccagctttgtgaacattgtgacagtgaggaaaatctgacatatgaaaactctaatagtgaaagaaatctgacctaactgccaactccatcttgcttctaacctccaagttgcccttgctcatgcctgtgcatatgccaaggtaattatgggaggaatttagtttgtagtttaacaaacaaagatgctaacagccccttcccaaaacaaatccccttcttgcttggggatcaggcctgttttgtaaaactaacaaagtagccacaagataagaaataatggctcaggattcatgcagccagtggtcacaagattgctagcctccccagttgctcctatagataacatcactgttataaaacctaagattggtgtctgaggtatttttcagaccctgcattctgatggaccagctgggccacccagagaagtaaactggctcatctggtcttgtgccccaactcccaggaactgactcagtgcaagaaaacaagctttgactccctatgaattcatccgtaatgcaaccaaacagcattccccattccctagtcctctgcccatcaaactgttcttaaaaatccctagcctctaaatttttacggaggctgattcgaataataataaactcctgtcctcttgtgtagctggctttgcatttatcgaactctttttctattgtgaaaaccttctgttctcaatgcattggcttttctgggaagtgagcaagatgaaccccttgggtgattacattatcctaagtgaactaacacaggagcagaaaatagaatatcacatgttctcacttataagtggaaactaaacaaagggtatacatggacataaaggtggagaaaatcgactctggagactcaaaaaccatggaggatgggagggaggtgcaggttgaaaaactgcctgctgggtacaatgtccaatattttggtgatgggtatgctagaagctcaacccccaccattatgcatataatatccatgtaacaaacaagcacatgtacccccaaatctaaaatttcaacaaagaaaacaaggaggttactaataaacgtgttgaagtgaaatgttgggtcaagaagacattccttgaattcctttgtgtcttcaattactctttttccctcaagaaacccaaaatcattcaaattattccccaaaaagcttatctaaatttttagaaggcaaaacttttttaagttaaatgtttgaatactattccgtagagctacaggttattttttgatctagtttatgatataagttgagatacatttttatgtgctaacatacactatatatgatttatcttattaattggaagagtagatcatgtaatcagtgtatatagtaaatttacagtcattttataggactgggaacatgattttcatatttttaaataatgtcagatgtataaatttgttatatcctcaattttatgacagattggccacatctatgatgcatttgtttggtattttcattcccaagtagataagcacaatcgttttcaagtcttgtgatttagaggataataggaacctgtctggtaggggagctaggctgccaatgatggaaaacaaggaggtaacaagaaagtttattgaagaatatccatcttaataataatagcagacacttctacagtatttattatgctgttttagccagttccgtatattaatttaattacaaccctaagagttagttacaattactatcatttccattttccatacgagaagaccaaaacccatagaggggaagttatttgcccttgagtcagatagctaaaaatagtagagaccagaggtgagctcaggcagcctgactgaagagtctgggtgcctcaccactatgcatactgccacctgtgctaggaaaggaagggctatctgggaagtcaagctgggcaattatacgtgatatatgcaaggggattttgaaggcccaggagaggacatctgccttcccactcctctcccaatctgtttacttgcagataccagatgtttcattcataggcataaggtttggtctattgtttacaatgcaaccaacccctgggtggggtactactaagatttatgtgttatttttactttcccagtctgtttcatttttattttatgagtgtcatttttcattgtacatttttatacagttgaatctgtccatcttttccttgtggttgcttatttgtcattgtggctttataagttatcatccctctaacgcttctactataaatgaagccattttgccccaaacttaggggaaataatggctacaaccttcacatcaaatgctgccctgtccattttgagatttctaaatgaagcctctgtcattgtcttctcaagcctaaatcaagacaacttatttatagttttttcatgcttctctcctgtttctattcactgaattatccccaaatttgggttctccaaatgactctaagaattagggcaagtggtgagaaggatgagggatattgacctgtaatcaatgcctattataattcaaccaatgtgctaggtgctttctcataacttatctcttttcatttaatcattaaacagctctgtgagggggacaagggccctatgagtagttctaaagtaccccagcctgggaaagatgtgcagggaacctggtaagactcagcccttttggaaactcaatcccatacttagttctggtgatataaaggaggctgttagaaacggaaggtcattggagctagacagtcagttttggtcactctcaaagaggtgagaattgaagaagaggggagggtgtggatgaaagtttactaagaaaatgcagtagatgtacactagactgcttttataataggattttttacactagggtttttcggacttgcagaggggaaaaatgggactcccctacttccactgccagatctttgttccctgaaatttgcatttgggggatctaggtcagtgacattgggtaggtgagaaagaatagaggagtgaaatttcaatgacataaagccatcaaaaacagcaagaatttcagctgaaacattgcctgagaatacctagcactgtctatgtaagcagatacaaattctggctaatcacccacaagtcccatctcctaggggaatcttcaaagttaaggcttcaaacacacccctcaacaccccagctgaagggctgaagtgatggagaacatgaaaattttctgagagagtgtgaagaatgagattacctatctcagctcctaactccctaacctagggaggtcaattaccatttctgttcttcagtttttccatatatcacatgtgagtgccttctagctctaacatcgtacggttctcttccagtctttcctgtttcagtgaatggcactgaccttattactgaagccaaaaatccaggagtcattttagatgccttatctcgccctccgtacctctccatcctatccatgagctaatcatatcagttctgtgcccaataatatgttcccaatcagcccatttttcttcatatctactattactactgtaattcaagccaccataatttctttcctggacaactgtaatagttttcccactggttttcctacttccacttttgccccaataaaatctgttctcacagcagtcagtgatgtttaaaaactagatcatgttgctcccctgcttaaaaccctcaatgtttgcctattgtaattagaataaaacccagactcatcaccatggtttacaagaccctgtttttagaataacagttcaatgacataaactgtctcctcagtctacttctgctccccttaatcagccagagccctacctacttttttttttcataggctaagcattttctgactcaggaccattgcaccggctattcgttctgcctggagcactcttcctccagatcattgtatgcccaactccttatgtctccactacaatgtcatctctgaacaggagccttccctgaccatcctaactaaaacattccccctcctgccatcattctgtcctattatcctcaattagtgtcttatgggcttatctcccccaaatattattatgtttatttttttttcttttctgtcattattgtctggctcctcctactagaatgtaaacttcctaagaactgggatcttgggtaactaatagaacatagtaggtgagagcatggcttctggaggcagactctctaaatttgaatctcagttctgccacttactagctgtgttactctgggcaagttacttaacttctctgtgcctcaacttcctcttctgtaaaataaggatgataataatatatacttcctgtgaagtttttgcaaggattaaactaacttaatacatgcaaagcactatatatccctggaacctaggagagtgcctggcatgtagtaagtgttcagtaaatatttgttggctgtttgcatgaattaatcctcgatacctcctgctgtttccctcccttcctctctcatcctgcctagttttgttcaggaagcttttccctgactccttgcccacttctcaggactaaattggttctccccttatgtgtgtgtgtcttgctcacagaacctagacttatttcaagccctgattgctaggtataactatatatgtatgcatgatctttgtaatagctggtctctctcactaaatggtaagcttggtaagggcagggcccatgtctgtcgtatctgctatgaaatcttcactgaaacctcgatggttcctgacatatcataggtgcacaataaacatttttgggctgaaaacttttggctcacttttctcttagaaatgctgattaagaaatataatgagaaatttaataagtaatttgcactactttttgaaaggcaatttggaaccaagactgttgttgcatctctgcctccttttagtttagttcactgttgaagtacaaagaaatatctgtgaattcaatattctggcctccatttttaaagtcttgatctattccctgaaagtataatcgagactgactggcttcccttttgctaatttcttgcattttaatggtattaaccccaacataccctgccttattgccttagcaataagaataatgttggccctgataaaactaagatttttttttatttctaacccctcaaatcaatcagttcttctaataaaatcatgcattagaactcactgctagcccatatcttaaatattgtttcagccattgcaaacttctgatcaattgagagctactgaacacttactatggaaaagccaccaccttggcttgcagatactgttttaagtgctgcttcagaagaaggggcagaaggctatagtttccttctcttccccactgtttctctacaacattttccttcctctcactgctagcctggattcttaaaattcagcaaggaacaggtgagacatctgttctcaaggaggtcaaggagccaaaagcaaaccagcagaagctaagaggcacattactctttctgtatttggacattttaattgttacaaatagcacaaaccttcttccaagctccaggttttcccatggcctcttctcttagattaactgctatctcccttaaatgtccatagttggaagcatgggacatgcttggccctctgcagacaccctatattggagtgcaccttctggctgaaaagtaacagaggcattcaggccccatggtagcagcagcagcttgatacaggccgcatggggccataggaagagcacaggcccttgagtcaggagtcttggttctgtttcagccaagtagggtgatgtcagacaagtcctttgcctctcttggtctcagtttcctcatctgtaaactaggatttcggtgaggcttgaaagacaagatagttcccaaattattaccaaatcagactctaaacccattaacatatttaattgaaacagatacatacccacatccagacttttaccagatgtgtgaacatagtcagtggtaaggattcttaaggtgaaggggacaatggaaaaagagagagacattaaatttaaaatctcaaaggctgttcataaattgcttcccacacatcccatacaaaccctccgcttctccccaagccagcattaatgcattataaaccactttatgtttgacatagatacatacactcgggaccccattgtagttttggttgctatatatatatattttttttttccagacacactctcttcattaatctgcaagtaacttggtccaaactgggcacaggctctagctttataacttattgtgtggacatggcaaaacaactttccctatctgagtcagttttcttccttctaaaaggggatgaatctacttgcccccttcatagtggttgtgaggatgaaatgatagattgtacatatcagactcagcacagtagccagtacatgtcaggcacttaacgcaggcttgttgcttacctcctccccttacgggacagagctggggccagttcttggctctggatccacaggctttgtgactaaccaactcaatgttctttaaataccaactagtggctgtacaagatagcaaccttcaagacaataggaaaatgtagacaccagggagaattttatggttaagaaagttattacatcttggatccaaagaagagaagggctttaatttcttccctggagaatgcttaaaatcactgtggacatccagaatgacatgagattcatgttccacaaacttctcaagctcctacaaaataccaagccctgtattcagcatgatcatgggaatgatctcatagaggcctcccaacaagcctctgaggtgggctcactaggtacatttttcagatgaggaaactgaagctcaataaaagaaagcacaaactcagagagagttctgactcacttttagttgggagtgagtcaccatcttccttttgcccaacgtccagctctctaggcctgtttgtgcacgctgagtaactgcctcttacctggtctcatgtcctctaatcattctccactttgcttccagagtccctctctaaaatattcctccatccttatcactaccgtgctttgaaacataaaataattaaacattacttggtgcagaataagcacttaaaaaatgtttattagggccaggcgcagtggctcatgcctgtaatcccagcacttttgggaggctgaggcgggtggattgcttgagctcaggagttcaagaccagtctggccaacatgatgaaactccatctctactaagaaatacaaaaattagccgggcatggtgggtgggcgcctgtaatcccagttactcgggaggctgaggcagtagaattgcttgaacccaggagaaggaggttgcagtgggccgagatctgtgccattacacgccagcttgggcgacagagtgagactgtctcataaataaataaattaattaatttaaaagtttattagataaatgtctgcctacaggattaagtccaaaccctttagtctgacatttaacgtatttcatagtctggttcctacctgccttttctaaatactacatctcccatttcttttttccacctctacacctcatataagaaacctatatttcaggcactctgaaccactcatcctttcctttctctctctattgtatcctcacctggagagcccattctcctctatggtctgacaaattcttagtcactcttgagacctatttacatcttctctgcacaggttacaccttatctattcctgtattttgacaccacactgtactgtaattaataggtaaattttcagcctcttctgttcctcaaaggcaaggatttgcttttatttatctgccttgcccggtgactcctacagtacttcttccattgactggcaaagtccgagcttaagtaattgtttgttgaatgggtaagtagctggaagtacttacccactctcctttcccccagcttttgcagcatctccctcctcccatcctcctcttccccacccccgccccaccctaaattgaatgccaaagttactggtccccaggcagcagctagcacattcaacgtctccaaagctactttccctgcagggtttctttccatccccaaggcgtaattagcgactaccgctaatcttttgcgggtgggtaggtgcgagggcccccgaagggagcgaatgggtatgtctctcatctctccaattgccttcaggaatatttttttctccattttcccacacacgggccagacgaatatccccattcctttgcactcttcacaacctttgacataattatctataacaaattgatttaaagtgcggctgcaggaagggaaacaggcatgtctcgcttggccttctgggagttgtagtcctacaggcccccgggcttcctggctggccctgaagctccggactacagctcccaggcctctccaagcccctaccgcacaggctcatagccccaagcccggaggaggtggctacattgtgtctattgtatcccttggctggtgtatttgtacatctctcgggacgtgaaattgacagtgaaaagtatggcagatgagcaagaaatcatgtgcaaattggaaagcattaaagagatcaggtaagtggcacgttgtccccctccccgcccctctccaacccttcgttgcgggagagggctaattatctattgttgggctgtttgtctagaggagctggaaaggggcccattcaccacagacttgccggagaggtgaggatgggaggggcgctgaggagagttgagagagagagagacctcttgccagatgtggctgagaaagcaaagatgaagaaacacgggtttggtaccaagacagttttattcttctcgaggtggaggtcagggctctgcattcatggacacgttttttaaaagtacttgtgtgccccaaggtgtctttggctccttgctctttaggagtcgggatttttttccagtctcttgttcaacttcagaacctggagttcgggaaaggcttttgagagccaagtctagcgcatcggggctggtggctgctgccaggggctgccaactgggggttgcagaggaatctcagcgggcggagctgggagaatggcgcgcgctcgttttcctttcactcactcgccactttcttccttcctatcccgcgcttgggagggggatgggagcaatggggactggggacgcggtcgctgcgctgatggtgggatcgcgacagctgctctgaggagctggaggtgacaggcgggctggcaaagtgggagttgccgaagtggagtccgctacacggttgctcctggagcagcttttggcaaagcgatgatattgtccttgctcagaacacaatagcgccaggcgggctgtgtgggctggcacaaggtctttcttcacctcgccttctcagcgtgagcccctgctttggcttttgctctcactctgagagtggcctgggtcaagctctctccctggagtgttttctgagaacccaaggtggaagatgtcaagtgtgtttctttaagaaataagactttgatcatgagatttaacccttagagtgctggatgagacctacacatggtgattagtggtggtaggtaaagcaccttggtttcttcttcttcttgaggggttgcatctctctttctacaggagaggtaaaggaagggaactatcatttattgagtcccttcccgcccctgtgtgccaggccctttgacctacttttgctcattcagcaagagtcctgtgagcttcctactcctcctttacagctggggaaatagaggcccagagaatttgagtgattttcccacagccacgcagcttgaaattgccacattttgttggtctgcctgcaaaggtattccttttcccactatgtcccaggtaaagtctggaaaggagaagggaatatgttgcaattttttttttttttttttttttttttggcaaaagcatcagaagctagctagaaagtgagacaccttagtacagtagaatgccagctgtcataacgatgcagctagtcagaagcttaggcttgcaaatggagagcctagacttccactctcaccaagcttcaaaggaaccaccaccccatgcccagagaaggaccagttgtgagcaaggactttaatccccagtgaaaatagacctctcccagtgaagaccatatggagaaccatgacttctacccttaccagtggtaactaggagtttctacctcaaccagctaggatggaatcagcataggcccagagagaaggccaaactttcacctctaaacagcagtaacaaacagcccttctccaaactggatgtcaagagacagtggagaaactggacttctactgtccctcttccatccaagagagtggtagaggactgctaaaacaaaagatttaaataagatccagagtatccaacttttaatcaaaaatcactttccatactaagatatccacttgaatgagaagagaaaataaacagatgccaatactgagataacacccatgttagaattatctgataaggatcttaaagcacctgtcctaaaaacatttcagtgagcagttacaatacacttgaaacaaatgataatgtagaaaatctcagaaaatgaatagaaagtctcaacaaagaaatataaaacataaagaagaacaaagtgacatttttagaactgaaaaatacagtaacataaaaaccccaaaaaactcaatggataggttcaacagtaaggtggagaagagagagggaaaaaatagcttacaaatataaaacaatagaaatcactgtggcactataacaaaagctttaacatttatgccaacaaattcccaggagaaagagggcaggattggaaaagtattgggaaaaataatgactaaaatcttcccaaattgtgcaaaagacataaacatttagattcaagaagaggagcaaacaccaacataattgacacaaagaaacacactccaaaacacattgtaatcaaccttctgaaaatgaaagaaaaaggaaacttcttcaaaacagctgaagagaaacaaaagctacaaaggaaaaaaaaaattagaatgacagatttatcatcagaaactgacgatgccctagcattttgtaagtgctgaaggaaaagaagtgacaacccataaatctatgtccaataataatatccttcagtattgaatgggtaatcaagacattctccaatgaagaaatactaaggaatttagatataccctaaaaaaagatgatagtaagctctgaaaacagaaaagaaacaataaacagtaagcaaaagcatggttaatgcagtagactttctctttcctcttgaaatttcttgtattttgataattgaagctaaatttatactgttatctagtgtggtctcagcatatgtagaggaaatatttaacacatttatattgtaaactggggaatgtaaaggggattgtaaatgtaaagagatgtaaaggggaggacatgcttctacacttcattcaagcatgtaaagtggtaatgtcagaagactattaaataaattatgtatacataatatattactgagagaaaacactgaaaatgctatacaaagaaatgtactcaaaacattataaataaatcaatatgaatttttaaaaaatgctccagtcacccacaggcaggcagggcaaagaaaatggagaaactaaaattacggagaatgaacagaaaaaaaaataaaaaggcagacttagccttcatgtatcaataattatgttcacaacaaatagtctaaataccttgcaaacattaatcaaaataaagcaggaatggccatcttaatatcaaataaaacagacttcagagcaaagaaaattcctagagatggatattacataatgaaaaatagtcaatctaccaagaagacataacaattccaaatgtgtgtgttccaaaagtgacttaaattaaactgcttttgacaattttacagtaatatacaaaggttaagccacttggtttaagaatttaaaatggagaaagtactataaatatatacttgatgttcacatatggacagataaacatgtatgagagatagaaataaggaaggagcaaagggtcaaagaaactgaagaaaggaactaacatttgtcaagcaccttttaatttaaaagctcctggctcatttactctttagtcttcccaaaggaaatctgggataggaattattacccccactttacggataaggacattgaggatcagacagattaggcaactttcccatggttacacagctaggaaagaaaaaataatatatcctcctattcacatggcatgcacatttcaatgttattaactgcccttacaaatgctgattatctgattaaccattattcacagttcttcaactgctataatcctaaatctcctgaagtataagcatagcagcatatttctgttaaagaaataatgtttgctggacagaagcaggaatgatgacagcagcatcatctaatgacctattgaagtcaagctaagagccttacacacatcaagacacgagcccagaaatatatgcattcatactcagcactcacaccaatggcagaatttgcagtgggaaaaacatcagaagcagattctcccaccacagaccattttctgcttctaactctgaacacacgcctacccctgtctttcctcccaatcccaatcacactcccacattatgttcccaacctcagcctccaaatcctacactaatctattttgcccatgttttccttggacttttaaatggtgatgaaggagcatgtagataagtggaagaagagagacaagaatggaacaaaagaagggagatagaaaagagggaaagggaggatagcagtaataaaacagagacagtgagtacaggcaccattaaatggaccagagccctacaccagctccccaagtacaaaacaatatttccttaaaatgcacatgccatccattcatgtgtattgcgtacactcacaccccgatgtacacatatccatacacaaagagctttcctcacttgaaaaaaagaaaaaccattttggaaggagatgttgagttaagtaggtactcttaaatgaatgtttctcgactgggtccttcttttctttttttctttctacacactcttttgagtaaattcctgtacttccatggcttcaaatattatcctccaaatctccaacctctataccccacccacattcatgctttagcccatacatatgacagcctactgggcttgtccgcctggaagtttcacagataaatctcagctttatatctacgtctcttcctacagcaatcaagctcctccccttaaacctttggtttaataccaccattctctgcacagttacctcagatggcaatctgaaagtcaatgttgactcccctttctctttaatgactcacctgcaatcacttagttaattctatttctatcctgaatatcttacccaatacctgccccactctccacctcccagttcactgctccatttcaggccttcattatgaattggcatggatatttgtaatgcagtatccatttccatctgaagaattacttccctgtctacagtctctcctctgtctgcaatggcatccacattgccttgagaactaccttcctaaagcatggttgttattttatttctcaaacatcttcactaacttttcattgtgtatgacaatctttttgaaaaatacaggctgcgtcccattattagctcataaaaagaatttagttggtcactagtagcatttttaaaaaaccttttttaaaataaaaaggaaattatcaacatacattgcatatgaagtagtaggtatactttggagaaggttttgtttagttttaaatatgtgtatgtgtgtattgtgtcatgaggtgaaattcatttctcacttacgtcatttcttactgtgtctctgttgaacacacatttacctatcggtgtttccatggcattcatgctgcctccccggaaatctgtcccatacccactattctgaccttatctgctactgctttttattaatcctatcctttagccatatagaagttcttactgttttatatatttccgttccaccagacctttgcctctgcagattcctcgttctagaatgccactctcccattccaagcatctaaatcctactcatttttcaaggaagacccatatgaaatgcctcgtcttctccaaaaccttctcgagttccccagtcaaaatgaattacaataccccaaccacagactccacagggagatttattatagcactcaagttatcccatctaatgatggaattttgaattgatatcctcccttccttcctcccttccttccttccttcccccctccctccctccctcccttcctctcttcctctcttcctcccttcttcctttccttccgccattggtgtggcagtcttggtaagctcctctgttacctggcttggggattgactcagaaccagtgcttactcaagaccaaggcacaggacaactggaacctctgggacttgtggatgggcaaattaagccaaacaatgctggccacaggagagactgaaaaggtgttggcatttggtattgagatgtaagaaagttatcagaatgaactgttataagaaatctactttgctgacagtagctttgtttccagttgagcaaataaatattacatggaagaatgcttagtacttaggcaatattctcaccagactggagtaagcaggaaaaactagctcctttgtgttcattcagtgacatttactgagcataaatctgggccataatcagggctgggctatcctttggtggcccatcacttaggataaataagacccatcagaaggatcttctaatcaaagtcaatagctctgatctctcccttgagttccagactcacatatctaactgcccatttaacttacacccttgcatgtatcactggcatctcaaacaggccctcaactccagccccacccctaaacatttttatttcccagtcttccccatctcagtaaatgcctcactatgctgaaatctggaagccattctttattcctctttttatgtgaccctctccatccacaccattagcatagtggttattatacttgaccatgcaggaggttacacctaaagggcttttaaatcattgattgctgagccccatttccagggtctctgattcagtagatatggagtggggcctgagaatttacatttctaacaagttcccaggcaatgctgctgctggtggtgcagggactacatgtggagaacaactgcattagtaagacctggccagttatacctatacaatataatctggaattgtccacttctcatcatcccctcaacttattaacaaataccagcacttttccatcaatctccagtaaacagtatcttttcacctaattttcccatcttcaaggcctacaggtcccagctgtcctaccctgctttttgagtgtgcattggggctgagtcacctctgaaactgggtgacagatgagcctgccaagtttgtcccagcaatggatgatccatggccctagaacttctccttctttgcacctgtcctcttccatatttgccagaaagaaatcattgaaaagaaggtatccagctgaatgttttatagtcttggctcaggagactgtctggagaacctgtggcctagcagtctgctatgatttgaatgtaccccaaatttcatgtgttgaaacataatcctaccattttgatggtattaagaggagagacctttcgggaagtaattaagtcatgaagcctctgccattatgaatggattagtgccttagaaaatgacttggaatgagtttagacccttttttgtacttctgtgattccaccatatgaagacacaacattcactccctcttgaaaatgcagcaacaaggtgccatcttggaaggagagaccaagcccctcaccagacaccaaatctgttggcacattgatcttaaacttcctagccttcggacctgggagaaataaatttttgttctttacaaattacccagtctgtggtattgtgttatagaagcacaaacagactaggacaggagctcaggaatactggtccaaaagttacctaagactgtcatcctggtgactgtagaaaccctaaagtaccctgaaaaccctgtggtttccctgtggttcacgagtcatactagctgtgctttagcctcttggaaaaatctcattaggaaattttatatataaaattgcatctttaatgatctggatggcttcctcacttgtagggccaaacattccacagatttcatctcattgaagcatccaacaattccatgcaaggctacactgagtcctactttccaggtagaatttccaaggtgccaagagattccatgaagtgcactatttcaccctgaaaattgatgactgagccaggacaagaattcaccctactggcctggtttttatggctttaaatccatcatatgatgaaagttccttgttgtgatggaaaggtgatcagatttacaacgctggattttccacttcctgaatttgtcttcttgggcaagtcactttacttctctcagcctcaaattcttcatgtgtgaaaataaagtgaaacatacctgccgatatggttcttatgaagattaaattttgatagcataaaaagtgcctaatacagttgctggaacatagtaggcaccacaaatataatagctattgttattaaataaagcctttcttaacagacggttgctttcagttcctgtcacttagatagattcttaataaatatgaaccaaatgaatgaaatccttgccacccatggtaatgtcttttcttctctgaggctactgatgctataatcactcccctggatttactacctaccattcagtagtttctcattccaaatgtaatgattgagccccgcttatggccaaagcagaatgataggtgttgtggaggttaaagagagaaatatggcatagtgccactgtctagaaagccctcgtgtatataattactctgatttcaagttgcttcatgcataaatctgtactttttagaggacccagaggaccatgactatgtgccttgtgctagtccctttcccatcctggacctttatttattcacctctgaaataaagaggatagatttcatgggtgactttgaaataatgttctgacgagcccagggaattctaaggagggttttaaagggccactgtgatagagtcaggtggtggttgaatttgaggacagattaatgactctgggggtcccacttccactttaaccataacagttatgatttgttccattttctatattggatctcaatcagttattttatttgaaggaagggatcttatcattcatccacaagaaccagcgcacttctggataaatggtgcttgcttaatacaatttttaagtctgcttgattgatggaagtttgtaaagagggaatttggtattgtgagtacatctaagcagtgactggcatgacactctttgtagattagagagaggaagggccttttatttagatttaatcttagctcaaacttctcaattgctggacagagaatggaaggctgggaattagatgcaaatcctgaagaccatagtaaaggcaatctacctcaaatgcaacaaattatttatttatttatttattattaagccattaagctccttctcatttctcctggctgccttaatcagcaaactttaaaaaaatccattccctctacgtaagccttttgacaagtcatttatttttctgggaaaacatgagcatgcttagaagttatgtttagtgggagttgtaggtttagatttaattctgggtgcagtaagaggtcattacaggataatttgagttatattttatataccataggaaacatccatttcaagtgtacaattcagcatgttttaataaatttaaagagttgtacaatcatcaccataatattttagaaaatttccatcattccaaaattagctctttgttcagtttcagttgatctttgttcttatccacagccccaggaaacctgtaatatattttctgtctaaatagagtggctttttcttgatgctgcatataaatagttatacaaatgtggccttttgggtctgccttcagtcacttagcttattgtttttgagattcattcacattgtaacatgtaacagtatttcattcctttttgttgacaaataatatcccattgcatggatatcgcacattttgggtgttcactcacaagttgaggagcatttcagttatttccactgttttggctcttatgaataatgctgctctgcacatttgtgtacaagtctttttgtggaaaaatgtttccatttctactgcttagattctcaggagtgagatttctgtttcatattgtaagtatatgtataactttttaagatacaagtgtttttgaaagtggatgtcctagtttccatcccaagagggagtgtatgagggtcccagtttctctacatcctcaacaatacttgttagtgtctgcctcaaaaaggcattatagccatcctagtggtgtgatgtgatagctcacagtagttttaacttgcatattcctaatgaccaatcttgttgagtatctcttcatgagtttatttgccacccatatatcctcttctgtgaagtgtttattcaaaccttttgttcattttttaactgggctgtttgtttactgattgtgagttttgagtgttatttacattttctggaaacacatttttaccagacacttgatttgcaaacatgttctcccagtctgggacttatcttttcattgtcttaacagtgtcttttgaattacaatgtctttttttttttttttttttttgcttctttgtttgaaacaggatatcactccgccacccaagctggagttcagcagtgccatcgtggctcactgaagccttgaattcctgggctccagaagttatcccacttcagcttccccaataactggactacaggcttgtgccaccatgcctggctaatttttcttaaatattttgtagagacagggtctcactatgttacccagggtggtcttgaactcctgggctcaagcgatcctcccgccatggcttcccaaagtgttctgattataggtgtgagacaccgcactgagccagaaacttttaatgttgatgaagaaatccaatttatcagtattttttatggattgtgaattcttgtgccatttaggagaaatgtttgcctaagtcgtattcacaaagattttctcctatattttcttccagaaattttatttttaggtttcacgtttaggtctatgatccattttcacttaatttttttgtatgttgcaaggtacgggttaaggattttcttttgcatttggatgttcagctgtttcactatcatttgtttgaaagacttgtccttacatctgtgggtttatttctgacctatctgcttcattgctttatttgtgtatctttatgccaatagtttgctgatttgattactatatctttttaataattacggaaaccaggtcatgtaggttctccaacttcattattcttcctcagaaataattttgactattctaggcgctttgaatttctatgagttttagattccccttgtcagtttctaccaaaaaccatactgggattttaataggattttgttggatctgtagattagtttgttagatttcaccagtgtgtaatgaaataatgtcctatttctgttctaggatctaacccaagataccacattgcatttttatgattccatttaacttattttatgacttattagctataatgctgttttattatttcagtggctgctttagagtttataatatacatccttaacttatcacaacctaccttcaattgagcgcataatactgcacatataatgtaagaaacatacaacactatatttctccctttctggcctctgtgctattgcattttggtactttttggtttaaactgttgattatatttttaagtaacttaattaaggaagaaaataatcatgatatttttctatgtagttaccattttcagtgctctgtattcctttgttttgatacatttccctctgctatcattttccttttgcttgaaggactccctttaacatttgtggtagtgcaagtttgctgatgatatagcattttacctttccttgtgtgaaaagttctcattttacctttgttttcaaagttgttttccctgggtaaataattctatattggcatggatttcgtccgtactttaaaagtgatacaccactgtcatcttgcttccaacattctttgatactctttgtgtaacatatcctttgtttctgactcctttactggttttgagcaatttgattatgatatagcttggtgtgatgttctttatggattttatgcttggagcttgatgaatctattggatcagtgggcgtgtagctttaatcaaatttgaaagatttttggccatttattcttcaaatatttttatcttcctctttcttcttggtcttcagttacctgtatttttaattcaatttaatttaatttgatttaatttaatttaatttaattttactgtggtaaggtcacagaacttgagatctaccctcaacaaattttatatttataatacagtattgttaactagaagcataatgttgtactgcaaatctcttgcagttatcatcctgcacaactgaaactttatacatattgaatagcagctctacgtttccccctccttcagttcctagcaactgccattctactctctgcttctaagaatttgactattttaaatacctcatatgagtggaatcatgcagtatttctccttctgtgattagcttatttcacttaggattatgtccatgttatctcatattgtaggacttccttcttttttaatgcttaataatattccattgcataaatatactacattgttaattcattcatttaggttgttttcatatcttggctattgtaattaatgccatgataaacacgggagtgcagatatctctttgagatcccgatttcaattcttttggacaaatacctagaagtaggagtgctggatttatatatttttatatatttattatacctgttggccatgtttatgttctttggaataatgtttatggaactcctttgcccagtgttcaatcgggttaatagcttttgtactattggtttgtaggatttcttatattttatacaaattaatccattatcagatatatgatttgcaaatatttcatcctttatgcagtttgccattttactctgtttattgtttcctttgctgtgcagaaacattttaatttgatgtgatcctacttggtcatttttgcttttgttgcctgtgcttttggtgtcatatccattaaatcattgccacaagcaaagtcttgaagtttttctcttatggcttcttgtaggagttttgtagtttcagaagttatgttcagtgtttaatacatttgtagttaatttctgtgtatggtataagataagggtccaatgttatacgtttgcatgtggacatagtttttcccatagcatttattgaaaggactatcatttcttgcattgtgtattcttgtaaactttgtcaaagatcaagtgactgtatgtgggtggattcatttctgggctctctgttttttcccatggcctctatgtctgtttttatggcagtaccatactgttttaattactgcagctttgtaatatattataaaatcaggggataagattgttctggctacttggagtttacatgaatgtaaaaaaaaatgccattgggatttttataaggattatattgaatctgtagattgccttgagtagtatggttaagtcttccaatccatgaacatgtatgtcttcccatatgtttgtgtctaccttaatttctttcatcaatacgttatagtttcatttattgctaagtattttgttctttttggtgctatcataagtgggattgtgtctgaatttccttttcagatagtttgttgatagtgtacagaaacacaactgactttgtatgttgattttgcatcttgtaactttactgaattcatttattaattctaacaatctttttggaattttttgggttttgtacaaataagattttgtcaactgaaaacagcaataatcttaccatttccttctcaattttggtgacttttatttcattttcttgtctaattgctctggttaggtctctaggatctatgttgaatagaaatgtcaagagtggacatccttgtctttttgctgatctttcagtgttttaccattaagtatgacttagctgtgggcttttcatatatggcttttattgtgttgaggtaatttccttctatttttagttgttgagagtttctatcaggaaagggtgttgaattttgtcaaaggctttttctgcatttattgagatgatcatgtgactgttatctttcattctgttgatgtgatatagcacattaattgacttttgcatgctgatctctcctcacatcacagggataaattccactggccgtgttgtatgatacttttaatgtgctgttaaatcagtttgctagtcttttgttgaggatttttacctgtatattcatcagagatagtgtcctctagttttcttttcttgtggaatcttcatctagctttattattagggtagtgctaggctcataaaatgagtttggaagtgtcgcctcttcacttttttggaaaagcttgaaaaggattggcattaactcttctttaagtgtctgtcagaagccaccagtgaagccagctggtcctggccttttctttgttgggaagtttttaattactgtttcaatctccttactaactacaggtctattcagattttctatttatacaggactcagtcttgccagattgtatgcttataggaatttatccattttttatgttatccaatttgttgatatgtgattcttcatagtagtcttatgatcctttctacttctttggcatcagttgtagtgtgtcatctttcatctctgatttcaattagttgattcttttctattttctcttagtctagctaaagatttgtcaattttgtttattttttcaaaaaaaaccctcttagttgcattaaaaaaatttgattctttatttggcttatttctgctctctcttcattatttccttcaaaactgaccaataaatcacatggttaatagaattattagctgatgacattaaaagttattataaatccatttcatatgttcaaaaagcttgaggaaaaactgaccaagtagaggcatggcagaaataaaaaagattcaaataaaaagtctatagatgaaaactattatgtctaagatcaaaaaatttcttagtttagaaaaagagggagaaaagattagtgaacttccagaaatagtaatagaaatcatcccaaacaaaatacatagggttaaagatttttaaaaataaacagtatcagcaaattgtgggacaacttcatttggttaaaaatacagataaccgtcatttaaaaacaaagaagaacattatgtaatgataaaacagtcaattcaccagaaatatgcaacaattataaatatatatacacccaatatcagaacactgaactatataaggaaacattgacaaactgatggtagaaatagacagaaagacaataatagtaagagacttcaataccccacttttaataatggatggaacagtcggacagaaaatcaataaaaaacagcaggcttaagaaacactacagaccaaatggaccttacagacatataaaacattaaacccaagagcaacagaatagatactcttcctaactgtacacagaacattctccaggatagaacacattaagacaattagcacatcttaacaaatgtaagaagatcaaaatcctaccaagtatcttttctgaccacagtgaaattcaacagtagaaggaaaactggaaaattcacaaatacccatcttaagggttatatttttcctgcttatttgtacatctggtaatagtaaagtgtgaatggatgccagaaatagtgaatttcatcttgttggttgctgcatgtatttgtattcctatacttagtatcagttttatccctataagtcttgctgttaagcatagttaagtggaaccaaagtagtgctttgtctagaagtcatttccccagtactaatgcaaaaccttctttgtattttaatgctttatgaattgtgaagttcttctaccttggctattggaaataggtccatgtgggctctgatcactgtcccctttgggtggttattttcctggccttatgtagttttcttatacacgtgtgctaatcaatatttaactgaataattggtggagttggatcctctgaaaattgagagagtcccctttttttcattaaaaaaaaattaaaacggtgctattgcaatagagttctctttctacataggtctacactctccaaaactcttttctgaaaaattttgataccttggcttccccagagtcatggctccatttttttcaattgaaggagactagcaggctctgactgagtttcccttccctgcagcctagaatatttatctaggcatgaagatatagccatcttagggctcatctaagcctttccatcttttggagatcactgaccttacttgcctgaagtccagtgacttaagtgctattttttcatataattttgtcagtttttttctgtttttagttatgcctgggagggtaaatcaggtccctgttactctatcttgactagaagtgaaagtcaaggttatttctcaaatatggtttcaaaagatcagattttgtcatttaagacacatattttacattcaaaaatgtaaagtcagggtgtgtcttaaaatccattggtgttttaatcatgcttaaacatgtgactgctgttggccaggatacagttgtggtggtgtcgtcagtatctgagcacatgtgaactttgccatgactattcatattgtcttctcttaaactgaattatgtccatggttgccaacatgtactgtccatagttgccaccatgtatttaggttgtcatttaaaatgtcctcaaaaagatttcaccatgattctccatcaaaatagaaagctattttgtatgaagaagaactcagaccagaaaagtctgataaaaataatctcttaaataagtctacattaggtctttcaatttgtataaaatgtaaattttgaattataagaaaacaatttgttatactgtaattggtagcattttttcttagtagtgtacaaaataatgtgtaccttacattcaaaggcatcctagattcaattaaataaaataactgattagccaggatattaataatgctaatctaagaaagtcctaaaataacagtgtttaaaacaagacagttttaattctccctcacattattgatctgggaacaaggtatttgtggtttgtggtggtgtttgatattggggacctaggctatttttatattgttgcttcactgtatacagggtttcgccctcatctatatgattcaagcccactgttgtgtacacattttatccaataggaaaatagcaatgggaatggttcttccatttatagtcacaatccagaagttgtagacatcatttctgcttccataaaattggccagaaagttgtcatatggtcacaaatagctgcaaaagggatggggtaatatagtccttatttcagacaacttcatgcccagctgaaaatcagagggtctattgctatagaaagaggggagaatgaatttggggagacaggaagtattgtgttgtttaagagagaaatgagatcagctcagggtatattctgctacaggtctccaattgggtgccacccccagtaccttcttaattctccatctttctgaatgcaaacacagatacaagagcccttatgcactgctggtaagagtatgaactgttatagccatcctgctgagcaaattggcactgcttaatcaaagtaagaatgcacattacctgggcccctgaaatccaactcctgggataaatcaccccccaccaccaccaaaaaaaaattactgagacaggtacaaggctattcacttaaatgttattttggaggtggggagattgaggcaaagtgggagtctgtccctggaagagtcaacagataaaatgtggttgatagccatatatagaagcaaggaattctggatattaacttgagattgctgtgtgaaaaccatattttggaaattggccaatataacaatttttatatacacatatatgtacatatatacacacacacaaatacacacacacacacatatacaggcatgtgccatataatgatgtttcagtgaacaatacaccacatataccatagtgtggtccctgaagattacaatggagctgaaaaactcctatcacctagtgacgtacccactgtaacatcatagtgcaatgtattactcacgtttgtgatgatactgcactgccagtcatataaaagtctagcatataaaattatctacagtacatgatacttgaaaatgataacaaatgactatgttactggtgtatgcatttactatactatactttttatcattattttagagtgtactcctcttacttattaaaaaaaaataactgtaaaacaggttcaggctggacttccaggaggtattccagaagaaggcattgttttcatattccttgaagactttccagtgggacaagatgtagagttgggagacagtgatattgacaatcctaaccctgtgtaggcctaggctaatatgtgtgtttctgtctttatttttatttttatttttttttatttttgaaacctggtctcactctctcacccgggctggagtgcaggggcatgatcatggctcattgaagccttgacatcccaggctcaaacaacccttccacctcagcctcccaagtagctaggaccacaggcatgcaccaccacacctggctaatttatatatttttttaatagagatagggtcttcctatgttgcctaggctggtctcaaactcctggcctcaagcgatcctcctgccttggcctcccaaaatgctggggttacagacttgagccactgtgcccagcctgtatctttatgtttaaccaaaaagtccaaaaagtaaaaataaataaataaatacaaacatagaaaaaacgcttatgaaataaggatataaagaaataaaatatttttgtacagctgtacagtatgtttttgtgtcaagctaagtattattgcaaaagagttgttaaaagaaaagcttcagccaaattaaatttaaaggaggttaattgagcaatgaatgattcatgaattgggcagcccttagaattacagcagatgcagagagactccagcacagccatgtagtggaagaagatttatagacaaaagggaagtgacatacagaaatcggaagtgaggtacagaaacaactggattggttacagctcagtgtttgcactatttgaacacagtttgaaccctcagcagtgtatgagtggttgaactatggctgctaggactggccaagactcagctattgttacaggcacatactcctaagttacgttttcaatcttgtctacctaataagttaggttatgctttgtcctcatggactcaaatgtagaagtacagtccttctcaggctatatttagttggctttaacaattcctcccttttggttactttctcaattttgagatgttgaccaaaactttagtcattgatgtcactatcaccattgtaaatgtacttatttggtcttgaaacccactggaaaacagtagaacagtgggttttacaaggtgggaacaaggacagagtagagggtacctccttatgctgtaacatcctgtttgcaggagaaaaacaaaatctggtctgttctaggatctatgtgtttccttaaagtcttagtttgattatgtcatatttagtatgagtgactccatgtttgtttggtttggtctgttagggcctaatgcaagagctcagtccaaaacaatggcctcccataattttgttttaaaactctacttttcgggtcaggttcttacttaggtgagggtgtgaccaaaacttagggccttagtgccactctgttaccatcattttgggtttctggtctcagcgtgtaattcataagttaccatgtgttcatggttgcatatttttttcagctcttgtcatcccagttgaagagagaccatttgatattctatagatggctgcatgcaaacatttaaaacttttgagagaatgcagcgcacaagggagactactattatgactattgggaggataacaccaacagtttgtagtatgctccttacccagggttcccataaatcaaaccacttaaaattaaatagattaaagaatgggctaaagagtctactcacttaactaagcagtctttccattaatcccctacaactgaatttttatattctacattttatgtatttctccataggcgacaagtgccagcagctgcacagatatttttccattgagccaatgctattatttagtataactttcacaagagaatttaaagtctgttgtgtagccatagcctttacagtaaaatctgctatagagcctatcatgagggatacatttttaatcattgcttcttttactccaaaccaaggaagaaagatctaacaaatgatgtcctctagaagagtaaaggcctcctcataatgttcactttaacccatgatgtgggttaagaggagtgaaccaatgttccctttctgactgattatgaggcaacgtgtgtaccgttaaagcttcttgtctacattgagccttcgtcttttatctgtcaaagtataaggttatccatgtataaggctggctgcaaaatccttcacaaataaaagtataccccataagtacacacaacagaccctcttttcacttctattcttcagaggcataagcaaggaaaaaaatagttagacaagaatctcatgatgctagagaagtcttgatctttgatcttgggaaaagctattcacatcagagatgccatcttcttctggggagaaacttcccaggttagctttactttaagggcttcactgggtgtacagttccaagagtgtggagggacccttctcagttgtgagattatgaacttaaaattcaaggtcctgaagttttgctgtagtgtggatggcaaatacagcctttctctgatgttctcagaagatccaatttttgggttctagattgtgaaggggttgattgtcctcagtcagtgatccataaaaactttctttacctggtgaaaataccctgtagcataataatctactgttataacagcaaccctcatacatgggaaaacttttatacaaccagaaaacatgcattgaaaatgacaactgaatgaaattcttatacaaaatgtttaaatggcccatcagctaaccaaatgcacctgaaggtttgattgttttcccaggaatatgggtgtgacaaaccaaatattgttcataaactattttaggaatttagaagacaccacattaatatataattaatttggatcattttgtcttttccatgatgagtcacagaatacagaacctttaataacaaaagctttaacgactcaggaaggacaaagtggctgtcctgcttctccatgagtccatgcttaattaacattagacttatgtcctcttgaataccagttatttctccaaattaggtacatagcactgataactggtgggttatcataggtaatttgacttagaccgtggagtttattcaaactgtatacctaaacaatttcagtattggctgattcagcattcaaatctggcagagtattttcttgttattccataactttctgttctacttgggttagtagttttataaaccagtccaccttttcattaaaatttcaggaattcttatccggtccaaatgatatgattttatagaaacctgtattgaagagtgattttcagggacctttcaatcctttcatgaacctcctaaaagacaccatattctaggattttgcatgcttgtgaaatttttcagaaacagcatcagcattaagcaactaactgtggaaatgacttcaaaggattatagttaaaaacacaattaaaaagaaaacttcattctttctgttgtctacaataacataataaccataataatgattaatagcaagcactcaaacatattagaaattttgaaatccaatacaatttttgagcatatatatatataattataaatatatataattatatatatatatataattatatatatatataattatatatatatatatatataattatactttaagttttagggtacatgtgtacaatgtgcaggtttgctacatatgtatacacgtgccacgtaggtgtgctgcacccattaactcgtcatttacattaggtatatctcctaatgctatatctccccaattcccccaaccccacaacaggccccggtgtatgatgttccccttcctgcgtccatgtgatctcattgttcaattcccacctatgagtgagaacatgcagtgtttggtttttcgtccttgcgatagtttgctgagaatgatggtttccagcttcatccatgtccctacaaaggacatgaactcatcattttttatggctgcatagtattccacggtgtatatatgccacattttcttaatccagtctatcattgttggacatttggcttggttccaagtctttgctattctgaacagtgccacaataaacatacgtgtgcatgtgtctttatagcagcgtgatttatagtcctttgggtatatacccagtaaggggatggctgggtcaagtggtatttctagttctagatccctgaggaatcgccacactgacttctgcaatggttgaactagtttacagtcccaccaacagtgtgaaagtgttcctatttctccacattctctccagcaccctttgttccctgactttttaatgatcgccattctggtgtgagatgctatctcattgtggttttgatttgcatttctctgatggccagtgatgatgagcactttttcatgtgacttatggctgcataaatgtcttcttttgagaagtgtctgttcatatccttcacccacttgttgaaggggttctttgttttttccttgtaaatttgtttcagttctttgcagattctggatattagccctttgtcagatgagtacattgcaaaaattttctcccattctgtaggttgcctgttcaatctgatggtagtttcctttgccgcccagaagctctttagtttacttagatcccatttgtcaatttcggcttttgttgccattgcttttggtgttttagacatgaagtccttgcccatgcctgtgtcctgaatggtattgcctaggttttcttctaaggtttttatggttttaggtctaacatttaggtctttaatccatcttgaattaatttttgtataaggtgtaaggaagggatccagtttcagctttctaatatggctagccagttttcccagcaccatttattaaatagggaatcctttccccattgcttgtttttgtcaggtttctcaaagatcagatagttgtagatatgtggcattatttctgagggttctgttctgttccattggtctatatctctgttttggtaccagtaccatgctgttttggttactgtagccttgtagtatagtttgaagtcaggtagcgtgatgcctccagctttgttcttttggcttagggttgacttggcaatgagggctcttttttggttccatatgaactttacagtagtttttttttccaattctgtgaagaaagtcattggtaacttgatggggatgacattgaatctataaattaccttgggcagtatggccattttcacgatattgattcttgctatccatgtgcatggaatgttcttccatttgtttgtatcctcctttatttcgttgagcagtggtttgtagttctccttgaagaggtccttcacatctcttgtaagttggattcctaggtattttattctctttgaagcaactgtgaaagggagttcactcatgatttggctctctgtttgtctgttattggtgtataagaatgcttgtgatttttgcacattggttttgtatcctaagactttgctgaagttgcttatcagcttgaggagattttgggctgacatgatggggtcaatattgtgaaaatggccatactgcccaaggtaatttatagattcaatgccatccccatcaagctaccaatgactttcttcacagaattggaagaaactacttgaaagttcatatggaaccaaaaaagagcctgcattgccaagtcaatcctaagccaaaagaacaaagctggaggcatcacactacctgacttcaaactatacttcaaggctacagtaaccaaaacagcatggtactggtaccaaaacagagatatagatcaatggaacagaacagagccctcagaaataacgccacatgtctacaactatctgatctttgacaaacctgagaaaaacaagcaatggggaaaggattccctatttaataaatggtgctgggaaaactggctagccatatgtagaaagctgaaactggatcccttccttataccttatacgaaaatcaattcaagatggattaaagacttaaacgttagacctaaaaccataaaaaccctagaagaaaacctaggcattaccattcaggacatacgaattggcaaggacttcatgtctaaaacaccaagagcaatggcaacaaaagccaaaattgacaaatgggatctaattaaactaaagagcttctgcacagcaaaagaaactaccatcagagtgagcaggcaacctacaaaatgggagaaaatttttgcaacctactcatctgacaaagggctaatatccagaatctacaatgaactcaaacaaatttacaagaaaaaacaaacaaccccatcaaaaaatgggcgaaggacatgaacagacacttctcaaaagaagacatttatgcagccaaaaaacgcatgaaaaaatgctcaccatcactggccatgagagaaatgcaaatcaaaaccaaattgagataccatctcacaccagttagaatggcaatcattaaaaagtcaggaaacaacaggtgctggagaggatgtggagaaataggaacacttttacactgttggtgggactgtaaactagttcaaccgttgtggaagtcagtgtggcgattcctcagggatctagaactagaaataccatttgacccagccatcccattactgggtatatacccaaaggagtataagtcatgctgctatacacatgcacacgtatgtttgttgtggcactattcacaatagcagacttggaaccaagccaaatgtccaacaatgacagactggattaagaaaatgtggcacatatataccgtggaatactatgcagccataaaaaatgatgagttcatttcctttgtagggacatggatgaaattggaaatcatcattctcagtaaactatcgcaaggacaaaaaaccaaacaccgcatgttctcactcataggtgggaattgaacaatgagaacacatggacacaggaaggggaacatcacactctggggactgttgtggggtggggagagtggggagctatggcattaggagatatacctaatgctaaatgacgagttaatgggtgcagcacaccagcatggcaaatgtatacatatgtaactaacctgcacattgtggacatgtactctaaaccttaaagtataataataataataatcaaaaataaaaaagaatccagagccatcagtgtgctgtattcaggaaacccatctcacatgtggagacacacataggcttaaaataaagggatggaggaagatctaccaagcaaatggaaaacaaaaaaggtggggattgcaatcctagtctctgataaaacagactttaaaccaaccaagatcaaaagagacaaagaaggtcatttcataatggtaaagggatcaattcaacaagaagagctaactatcctaaatatatatgcacccaatacaggagcacccagattcataaagcaagtccttagagacctagaaagagacttagactcccacacaataataatgggagactttaacatcccactgtcaacatgagacagatcaacgagacagaaagttaaaaaggatatccaggaattgaactcatctctgcaccgagcagacctaatagacatctacagaattctccaccccaagtcaacagaatatacattcttctcagcaccacaccgcacttattccaaaattgaccacatagttggaagtaaagcagtcctacacaaatgtaaaagaacagaaattataacaaactgtctctcagaccacggtgcaatcaaactagaactcaggattaagaaactcactcaaaaccgctcaactacatggaaactgaacaacctgctcctgaatgactgctaagtacataacgaaatgaaggcagaaataaagatgttctttgaaaccaacgtgaacaaagatacaacataccagaacctctgggacacatttaaagcagtgtgtagagggaaatttatatcactaaatgcccacaagagaaagtaggaaagatctaaaattgacaccctaacatcacaattaaaagaactagagaagcaaaagcaaacacattcaaaagctagcagaaggcaagaaataactaagatcagagcagaactgaaggagatagagacacaaaaaacccttcaaaaaatcagtgaatccaggagctggttttttgaaaagtacaacaaaattgatggaccgatagcaagactaataaagaagaaaagagagtagaatcaaatggatgccataaaaaatgataaaggggatatcaccaccaatcccacagaaatacaaactaccatcagagaatactaggaacatatattaatatcattcactaaaatataacctgaggaaagttaatttttttgacagtgcttcccgtgtaacttgctatgtcaaataattctgtttacctttcctctgggtgcttaagggtccctctggagcattccaagttagaggtcgcataatataattttgaagctgcaatttgattttgggaaggccatcaaatatggtaaagttttaaaacagtttgatatgatgaaatggaattctaggtactgtaagtcattcatttagccaaaatgatgactcaaaaaatttaagaaggcaaaaactgttagtcattgataggcagaaaccttagctttccaaacagtctgtctcttgtctttcccttcttttttggtagtttattcaaaaggcaaagaaaaatcttttattgtcctttactattgcatgaaaatcttgttcaagagagaaagcaaaatttcaccctggcattagtgtaccatgaatgttaaccctaattcttaagaaatcttatagacaaattgattcaatcttaatcatttggaccataaggtgagattcccataaaccttttattaccctttacaaatttttgttgaagagcagattagtgctctaagaaaaccctgttgtgcttttatttcaatgttcaagttatggaaaaaataataatacctctttaaatttagtcaatatgtttacagacaaaatttgttttacaatattaatttttacgaaccttttacaacttggtgaaacgtttacctttatcttatgtaatttaaaacaatcatttagccctttaatctaggcaaacatttacattcccatgccttcttataatattttaccaaaaatactttttattgtcttcacacaccttgcatataaaacttttttcagtagtctcaaatacatgttataatggtaactctccagaattttaatttttggtagaaaacctggcaagtaagtaattttaattatgtagtaggtttgtatccaaggaaatcagacagaagtacagataaggtgtgactctttcatcatttctgttagacttcactgcttcccaggttaacatttatgcatgtgttagccagaggaactcagttcttcagaaattaaaaattaaatttgtacctaaaatattggctttgctctcagattcccctgatgaacttagccaatgatttttcctacctaagtgtgcacaaaaaaaaatgtgaaacaaaggggtagaacgtaaaaatcctcatgaatatccagaagccaattttttttcaatttctacaatattgccatttactgccagtttttttctgacccagtcaggtgtaagagccctctaactggatccaagccagttaatcactggaacgaatccaatcctggaccaagtccggtttctatagtgacttataaaccaagtttggatgagaaattcgcccaaagaaactcaaagagctcaaaacacaaatccatgaagctccaaaacccaaaagagaacttaaccaagatctctagctcctctgatagatcaaacgacacaattgggtccttgcagttaccttgcttgttcactcagtgctcctgggggtcgttaaaagttctacttcagatgccacttctgacatcatctgttaaaagaaaaaaatcagccaaattaaatgtaaaggagtttaactgagcaatgaacaattcatgaatcagacagccatcagaatcacagcagattcagggaggccagcacagccacttcatggaagaagatttataaacaaaaaaaaaaaaaagagaagtgacatacacaaattggaagtgaggtacagaaacaactggattggtcacagctcagtgtttgcattattcacagtttgaacactcagcagcgtatcagtggttgaagtatggtttctgggattagccaaggctcagctattgttacagacacatactcctaaattaggttttcagtcttgtctacgtattaaattaggttgtggttcatccacaaggactcaaatatagaagtgcagagtctttctcagccatatttagtttgcttaacagagtaaaaatgtttttaaaaagtttaaagtttataaagtaaaagcattacaataacctaattttaatttattatggaagaaagacatttttaaagataaatttagtttagcctaggtatacagtctaactatagctggagtcttcaacatacctctatcaacatttgataaaacaagccagaaatcatcaaggatatagaaccatcaccatcaaccagcagaatctcattgacatttatagaacacttcacccagcagcaggatacacattctttgcaagtgctcatggaacatataccaaaatagatagaccatttcctgggatataaaataatccccaacaaatttaaaagaacagaaatacagaaatgtgttgtgtgacattaataaaatcaaactaaaaaccagtaaaccagaaaaaattaccagaaaaatctacacacgcttggacactaaacaacatatatctgaatgatgtgtatttcatagagagtctcaagaaaaataaaaatacactaaactgagtgagctgaaaaatatcaaaaattgtgagatgcagtaaaagcagtaatgaaaaaaattaacagcactaaatgcttacattataacagaagagatgccttaaaacaataatctaagctcccacttcaagaaactcgaggaagaagagaaaaataagatgaaggcaagcaaaaaacagaaactaataaaggtaagaacagaaatcaatgaaattgagactagaaaacaacaaagaaatgaatgaaacatttatatatttaaaacaacatatacacatttcatgcacattacctgtgctgtgaaatcccactcctgagatgaatccctggttgttttaagaatctatctatctatttatctatccaaacatatatatttcatatatataaaacaaccagggtttatccccagtgaaatttatatttaaatagacgtgtgtgtgtgtgtgtgtgtgtgtgtgtgtgtgcacgcatttaaaacaaccaaggggtttttccaagatggctgaataggaacagctctgatctgcagttcccagcaagaccaaagcaggaggtgggtgactgctgcatttccaactgaggtacccggttcctctcgttgggactggttagacagcgggtgcagcccacagagggcgagcagaatcagggtggggtgtcaccttacccaggaagtgcaaaggaccagggacctccctgttctagccaagggaagctgtgaggctgtgctatctgccccagatactacgcttttcttatggtttttgcaacctgcagactaggagattccctcatggacctgtaccaccagggccctgggattcaagcacaaaactgggtggctgtttgggtagacactgagctagctggaggaggttttttttgttttgttttgttttggttttggttttttttcccacacgccaggggcacctggaacccaagcgagagagaactgttcactcctctggaaaggcggtggaagccagaaagccaagtgatctcgcttagcaggtcccacccccacagagcccagcaagctaagatccaccagcttgaaattctcactcccagcacagcagtctgaagttgacctgggatgctcgagcttggtggggggaggggcttccaccattactgagacttgagtaggtggttttccccacacagtgtaaacaaagccaccaggaagttctgacttagcggaaaccatcatagcacagcaaagcagctgtggccagactgcctctctagattcctcctccctgggcagggcgtctcgggaaaaaaggcagcagtcccagttaggggctcatagatggaactcccatccctgggacagaacacctgggagaaggggtggctgtgggggcagcttcagcagacttaaatgttcctgcctgccagctctgaagagagcagaggatctcccatcagagtgctagagctatgctaagggatggactgccttgtcaagtgggtccctgacgcctatgcctcctgactgggagacacctcccagcaggagtcaacagacaccgcatacaggagaggtcagggtggcatctggcaggtgcccctctgggatgaagtttccagaggaaggagtaggtggcaatctttgctcttctgcagcctccactggtgatacccaggctaataggatctggagtggaccaccagcaaactccagcagactgcagaagaggggactcactgttagaaggaaaactaacaaacacaaagcaataacatcaacatcgacataaaggatgcccacacaaaaaccccatttaaaggtcattaaagtcaaagatcaaagttaaataaatacacgaagatgaggaaaaaccagtgcaaaaaagatgaaaattccaaaagctacaatgccacctctcctacaaaggatcacaactcctcgccagcaagggcacgaaactggatggagcaagagtttgacgaaatgacagaagtaggcttcagaaggtgggtaataacaaacttctctgagctaaaggagcatgttctaacccaatgcaaggaagctaagaaattttataaaagttgacaagaactgctaactagaataaccagtttagaggaaaacataaattacctgatggagctgaaaacacagcacgagaacttcatgaagcatgcgcaagaatcaatagccaaatcaatgaagcagaagaaaagatattagagattgaagaccaactttaagaaataaagcatgaagacaagattagagaaaaaaaatgaaaaggagcgaacaaagcctccaagaaatatgggactatgtgaaaagactaaatctatgattgactggtgtacctaaaagtgatggggagaatggaaccaagttggaaaacactcttcaggatattatccagaagaacttccccaacttagcaagacaggccaacattcaaattcagaaagtgcagagagcaccactaagatactcctcaagaagagcaaccctaagacacataagcgtcagattcaccaaggttgaaacaaaggaaaaaatgttaaaggcagacagagaaaaaggtcaggttaccaacaaaagaagcccatcagactaacagtggatctctctgcagaaaccctagaagcaagaagagagtgggggtcaatattcaacattcttaaagaaaaaaaattttgagattgagaccatcctggctaacatggtgaaaccccgtctctactaaaaaaatacaaaacaattagccaggcatggtggcaggcacctgtagtcccagctactcgggaggctgaggcaggagaatggcatgaacctgagaggcagcgcttgcagtgagctgagatcacgccactgcactccagcctgggcaacagagcgagactccatctcaaaaaaaaaaaaaaaaagaaaaaagaaaaaaattttaacccagaatttcatatccagctaaaataagcttcacaagcaaaggagaaagaaaatcctttacagacaagcaaatgctgagggattttgtcaccaccaggcctaccattcaagagctcctgaaggaagcaataaatatggaagggaaaaactggtaccagccactgcaaaaacgtaccaaaatacaaaaaccaatgacactaggaagaaactgcatcaactattgtgcaacaaaccagctagcatcatgattacaggatcagattcactcataacaatattaaccttaaatgtaaacaggctaaattccccaattaaaagacagagactggcaaattggataaaaaagactcaagacccatcactgttctgtattaaggagacccatctcatgtgcaaagatacacatgcgctcaaaataaagggatggatgaatatttaccaagcaaatggaaagcaaaaaaaaagcaggggctgcaatcctagtttctgataaaacagaccttaaacaacaaagatcaagaaagacgaaggatattacatgatggaaaagggatcaatgcaacaagaagagctacctatcctaaatatatatgcacccaatacaggagcaccaagattcataaagcaagttcttagagagctacaaagagactaagacttccacacaataatcatgggaaattttaacaccccactctcaatgttagacatatcaatgagatggaaaaaaatacaaggatattcaggacttgaactcagctctagcccaagcggacctaatagacatctacagaactcttcactccagatcaacagaatatacattcttctcagcaccacatagcactttttctaaaatcaaccacataaaggaagtaaaacactcagcaaatacaacagaacagacataataacaaacagtctgtctgaccacagtgtgatcaaattagaactcaggattaagaaactcattcaaaaccatacaacttcaaaagaagacatttatgcagccaacaaacatgaaaaaaagctcatcatcactggtcattagagaaatgcatatcaaaaccacaatgagataccatctcacaccacttagaatggtgatcattaaaaagtcaggaaacaaaagacgcagtagaggatgtggagaaataggaacacttttacactgttggtgggagtgtaaattagttcaacccttgtgaaagacagtgtggtgattattcaaggatctaattagaaataccatctgacccagcaatcccattactgggtatatacccaaaggattctaaatcattgtactataaagacacatgcacatgtttgcttattgcagcagtattcacaagagcaaaaacttggaaccaatgcaaatgcccatcaatgatagactggataatgaaaatgtggcattatacaccatggaatactatgcaaccagaaaaaagaaggagttcatgtcccttgcatagacattgatgaagctgaaaaccatcattctcagcaaactaacacaggaacagaaaaccaaacaccacatattctcactcataagtgggagttgaacaatgagaacatacaggcacaaggagggaaacatcacacaccaggacctgttggggggtgggggggcaaggggagagatagcatttggagaaatatgtaatgtagatgacaggttgatgggtgcagcaaaccaccttggcacaaacctgcacattctgcacatgtatcccagaaattaaagtataataaaaaaatcaatgaatctaggagctggttttgggaaagattaacaaaatagacggctagccagactaataaaaaagaaaagagaagaatcaaatagacacaataagtagtgataaaggggatatcaacactgaccccatggaaataaaaactaccatcagagaatactaaaaacacctttatgcaaataaactagaaaaatctagaagaaatggataaatttctggacacaaacacactcccaagactaaactagagggaagttgaatccctaattacaccaataacaacttctgaaaatgaggcaataattaatagcctaccaaccaaaaaaaagtccagggccaggcggattcacagccaaattctatcaaaggtaaaaagaggagatggtacaatttcttctgaaactattccaaacagtagaaaaagagggactcctccctaactcattttatgaggccagcattattctgataccaaatcctggcagagacacaacagcaacaacaataacaaagaaaatttcaggccaatattgctgattaacatcaatgagaaatactggcaaaccgaatccagcagcacatcaaaaagctcattcaccatgatcaggttggtttcatccctgggatgcaaggctagttcaacatatgcaaatcaataaacgtaatccatcacataaacagaaacaatgacaaaaacctcatgattatttcaatagatgcagaaaagacattcgataaaattcaacacctcttcatgctaaaaacattccataaactaggtattgatggaacatatctcaaaataataagagctatttatgacaaacccatagccaatatcatactgaatgggcaaaagctggaagcattccctttgaaattcagcaaaagacaagaatgacctctctcaccactcctagtcaacatagtattggaagttctggccagggcaatcaggcaagagaaggaaataatggtattcaaataggaagagaggaagtcaaattgtctctgtttgcaaatgacatgatggtatattcagaaaaccccattgtctcagcccaaagctccttaagctcataagcaactttagcaaagtctcaggatagaaaatcaatgtgcaaaaatcacaagcattcctatacaccaataatagacacacagagagccaaatcatgagtgaactcccattcacaattgctattaagagaataaaatacctaggaatacaacttacaaaggatgtgaaggactgcttcaaggagaactacaaaccactgctcaaggaaataaggacacaaacaaatggaaaaacattccatgctcatggataggaagaatcaatatcgtgaaaatgaccatactgcccaaagtaattcatagattcaatgctattcccatcaagctaccattgaatttattcacagaattaggaaaaagtactttaaatttcatgtggaaccaaaaaagagcccgtatagcaaagacagtcctaagcaaaaagaacaaagctggggatatcacgctacctgacttcaaattatactacaaggctatggtaaccaaaacaccatggtactggtaccaaaacagatatatagaccaacggaacagaacagaggcctcagaaataacaccacacatctacaaccatctgatctttcaccagtctgacaaaaacaagcaatggggaaaggattccccatttaatatgtagtgttgggaaaacaggctagccatatgcagaaaactgaaactggaccccttccttacaccttatacaaaaattaactcaggatgaattaaagacttaaatgtaagacctaaaatcataaaaaagaaaacccaggcagtaccattcaggacataggcatgggcaaagacttcatgactggaacaccaaaagcaattgcaatgaaagcaaaattgacaaatgggatctcattaaactaaagagcttctgcacagcaaaagaaactatcatcagagtgaacaggcaacctacagaatgggagaaaatttttacaatctatccatctgacaaaggtctaatatccagatcctacaaggatcttaaacaagtttactagaaaaaaccaaccccattaaaaagtgggtgaaggttatgaacagacaattctcagaagaagacatttatgtggccaacaaacatatgaagaaaagctcgtcatcactggtcattagagaaatgcaaatcaaaaccaaaatgtgatagtatctcatggcagttagaatggtgatcattaaaacgtcaggaaacaacagaagctggagaggatgtggagaaataaggaagcttttataataattgcaaaaattttctcccattctttaggttgcctgttcccactgataatagtttcttttgctgtgcagaagctctttagtttagttagatcccttttgtcaatttttgcttttggtgccattatttttggtgttttggacatgaagtctgtgcccattactatgtcctgaatggtattgcctaggttttcttctaggatttttatgattttaggtgttatgtttaagtctttcatccatcttgagtaaatctttgtataaggtgtaagtaaggggtcgagtttcagttttctgcatctggctagccagttttgccaacaccatttattaaatagggaatcctttccccattgcttgtttgtgtcaggttggtcaaagatcagatggttgtagatgtgtggtgttatttccgaggcctctgttctgttctatgtatctgttttggtaccagtagcatgcagtttcggtttctgtaaccttgtagtatagtttgaagtcaggtatcgtaacacctccagctttgttctttttgcttaggagtgtcttggctatgtgggctcttttttggttccatatgaagttaaaagtagtttttttccaattctgtgaataaagtcaatggtatcttgatggggatagcattgaatctataaattactttgggcagtatggcaatttttacgatactgattcttcctatccataagcatggaatgtttttccatttgtttgtgtcctctcttatttccttgagcagtggtttgaagttctccttgaagataaccttcacatcccttgaaagttgtattcctaggtattttattctcttagtagcaatggtgaatgggagttcactcatgatttggctctctatgtgtctattattggtgtataggaatgcttgtgatttttgcacattgattttgtatcctgagactttgctgaaattgcttatcagcttaaggagattttgagatgagacaatgaggttttctaaatatatgatcatgtcatctgcaaatagagacaatttgacttcctctctttctatttgaataccctttatttctttcatttgcctgattgtcgtggccagaaattccaatactatgtggaatagaagtggtgagagagggcatccatgtcttgtgccagttttcaaagcaaatgcttccagctgttgcccattaagtatgatattcgctgtaggtttgtcataaataggtcttattattttgagatacatttcattgatacctggtttattgagagtttttagcataaaggggtgttgaattatgtcacaggccttttctgcatctagtgagataatcatgtgacttttttgtcattggttatgtttatgtgatggattgcatttattgatttgcatatgttgaactaactttgcatcccaggtatggagccaacttgatcgtagtggataagctttttaatgtgctgctggattcagtttgccagtattttattgaggattttcacatcgatgttcatcagggatattggcctgaaatttcccttttttgttgtgtctctgccaggttttggtacccggatgatggtggcctcataaaacaagttagagagtattccctctttttctgttgtttggaatagtttcagaaggaatggtataagctgctctttgtacctctggtagaattcggctgtgaatccgtctggtcctggactttttttggttggtagtctgttaattactgcctcaatttcagaacttgttattagtctattcagagattcgacttcttcctggtttagacttgagggggtgtatttgtccaggaatttctccatttcttctagattttctagtttatttgcatagaggtgttcatagtattctctgatgatagtttgtatttctgtgggatcagtagtgatatgccctatgtcgttttttactgtgtctatttgattcttctgtcttttcttctttattagtctggctagcagactatctattttgatgacttttttcaaaaaccagctcttgaattcattgatttttttgaaggttttttcatgtctctagctccttcagttctgttctgatcttagttaattcttgtcttctgcgagcttttgaatttgtttgctcttgcttctctagttcttttcattgtgatgttagggtgtcaattttagatcttttctgctttctcttgtggggatttagtggtataaatgcccctctacacactgctttaattgtgtcccagagatcctggtacgttgtatctctgttctcattggtttcgaagaacatctttatttctgccttcatttcattaattacctagttgtcattcaggagcagattgttcagtttgcatgtagttgtgtggttttgagtgaatttcttaattctgagttctaatttaattgcactgtggtctgagagactgttatgattttcattgttttgcatttgctgaggagtgttttacttctaattatgtggtaaattttagaataagtgcaatgagttgctgagaagaatatatattcttttggtttggagtggagagttctgtagatatctattaggtcagcttggtctagagctgagttcaagtcctgaatattcttgttaattctctttttcgttgatctgtctaatattgacagtggggtgttaaagtctcccactattattgtgtgggagtctgtgtttctttgcaggtctctaagaacttgctttatgaatctgggtgttcctgtattgggtgcatatatatttagaatagttagctcctcttgttgcattgatccctctaacattatgtaatgcccttctttgtctcttttgaccaacaaacacaaccaacaggttagtttcaagtctgctttaccagagattaggattgcaaccccagcttttttttttttctttccatttgcttggtaaatattactctgtctctttattttgagcctatgtgtgtctttgcatgtgagatgggtcccctgaatacagcacactgatggatcttgactctttatccattttgccagtctgtgtcttttaactggggcatttagctcgtttacatttaaggttaatattgttatgtgtgaatatgattctgtcaatttgatgctagctggttattttgcccatttgttgcagtttcttcatagtgtcaatggtctttacaatttgttgtttttgcagtgactggtacctgttgtttctttctatgtttagtgcttccttcaggaggtcttgtaaggcaggcctggtggtgacagaatctctcagcatttgcttgtctgtaaaggattttttttctccttcacttatgaagcttagtttgggtggatatgaaattctgggtttaaaattcttttctttaaaaatgttgaatactggcccccactctcttctggcttctagggtttctgcagagagatctgctgttagtctgatgggcttccctttgtgggtaacccgacctttctctctggcttcccttaacattttttcctttgtttcaaccttggtgaatctgatgattatatgtcttggggttgctcttctcaaggagtatctttgaggtgttctctgtatttcccgaatttgaatgttggtctgtgttgctaggctagtgaagttctcctggataatatcctgaagagtgttttccctgttggttccattctacccatcactttcaggtacaccaatgaaacgtaggtttggtcttttcacatagtcccatatttcttggaggctttgtttgttcctctttattcttttttctctaatcttgtcttcacgctttatttcattaatttgatcttcaatctctgatatactttcttctgcttggtcgattccactattgattcttgtgtatgcttcacgaagttcttgtgccatggtttttatccccatcaggtcatttatgttcttctctaaactggttattctagttagcaattcctctaacctttttcaatgttcttagcttccttgcattgtgttagaacatgctcctttagctcagaggagtttgttattacccaccttccgaagcctaattctgtctgttcatcaaactcattctccatctggttttgttcccttgctgatgaggagttgtgatcctttagaggagaagaggcattctggttttcatctttgtagatttatttacctttggtttttatgttagtgaccttagaatggggtctctgagtggatgtgttattcctttatgtttgttagttttccttctaacagtcgggcccctctgctgcaggtctgctggaatttgctggaggtccactccagaccctgtttgcctgggtatcaccagcggaggctgaagaacggcaacgattgctgcctgttctttcctctggaagttttctcccagaggggcacctgccagatgccagccagagctctcctgtatgaggagtctgttggcccctactgagaggtatctcccactcaggaaacatgggggtcagggactcacttgaggaggcaatctgtcccttagcagagcttgaatgctgtgctgggaggtccactgctctcttcagagctgtcacacagtgacctttaagtctgccgaagctgtgtccaccactgccccttcccactggtgctctgtcccagggagataggggttttatctataagtccctgactggggctcctgcctttttttcagagatgccctgcccagagaggagaaatctggcagtctggccacagcaaacttgctgagctgccatgggctctacccattttgaacttccctgaggcttctttacactgtgaggggaaaactgcctactcaagcctcagaaatggcggacgcccctcctcccaccaaactcgagtgtcccagtcggtatcagactgctgctgtgctggcagagagaatttcaagccagtggatcttagtttgctgggatccatggggttggaacccactgagcaagactacttggctccctggcttcagccgctttccaggggagtgaacatttttttctcgctggcccttaaggtatgggggaaaaaaaaaaaaccctgcagctagttcagcgtctgcccaaagggccgcccagttttgtgctggaaacccagggtcctggtggtgtaggcaccgaaggggatctcctggtctgcgggttgtgaagactgtgggaaaagcacagtatttgagttatagtgcacaatgcagtccctaatggcttcccttggctgggagatggagttccccgaccccttgcacttcccagttgaggcgatgccccaccttgctttggctcgtccttcttggtctgcacccactgtccaaccagtcccaatgagatgaactgtgtacctcagttggaaatgcagaaatcacccaccttctgttttgatctcactgtgagctgcagacagagctgttcctatttggccatcttgccagcaatcaagacacaaattttctgatatcaggaatgaaatagaggatattgctgcagaccccacaggcatcaaaagaataataactatgaacaactgtgtacgtgtaaattggacaaattgcatgaaatggaccagtttatccaaacactaccacagttcacccacaatatattagagaatttgaataaccctatgtcactatttaggaaattgaatttgtaatttaacagtttccaaaaattgaatcttcaggcccagatgttacaatggagtaaaaatgttaaaaattttggagaatattccacatgtttaaggagaatcttccagtcactgcaatctgtttctcaggaagccacagtcctagcagaagggaccacaacaaggtaacaccctgtgggacaaaagaatctgaatagcaggtcttctctcccaggtctctctgctgataggatcagaggtgtccatctgacctgaatagccagaacactgggacaaggttgaggctgtgagttggatagctttcctgcttgcctggcaggggaattgaggtagcttccactcttcacccttataaaacctcagcacatctcattgagagctcctccaacacccttatcaagtctggggtcttagcctaccattatgtatgacatctcacctgccttagctacaactggtgcctatacaggaatatgtttcctcttgacctgaagcctgaatcatcaactcagcaagtataaaaatgggggaaaattaaataaacaaataaagtgtacaccatgagagaaggaaataagctttaagagatccctgccattctgaccccataagaaacagtgaacttgcccacacaccaagaacttaactactaaaaccatcatctgggaaagccagttggaaaagattctctataaataaggaactcatacagagttttcatcctaaaatcaccaagaatcaaactaggctaaaataaacattggcgtatgatccttaagaaagaaaaaaagaagttaaaaaaaaccacagtccaataaaaaataaattcaagaacaatttgattagtctacccaaatgagaaggaagcaggaaagtaattctggtaatatgacaagacagggttctaaatcatcctgaaaagatcctactagctccccagcattggatccaaaccaagaagaaatctctgaagtgccagataaagaattcataaggttgattagtaagctactcaagaagacaacagagaaaggtgaaaaccaacttaaattttaaaaaatcaggatataattaaaattttttcagaggaatagatatcataaaggaaaaaacaatgagagctactggaaatgaaagacacacttagggaaatacaaaatacagtggaaaattttaacaataagctagaacaagtagaagaaagaatttcagagcttgaagacaagactttcgaaataacccaaacagacaaatacaaataaaaaagaatgaaataaatgaacaaagtctccaaggaatatgggattatgtaaaatgaccaaacctaagaataagtggtgattctaagaaagaacagaaatctaaaagtttggaaaacttatttgagggaataattgaggaaaacttccctggccttgctagaggtctagacatccaaactgaagaagtcaaaagaactcctgggaaattcattccaaaacaatcatcattaaggcacagggtcaccaggttatctaaagtcaagattaaaaaaaacataattttaagagctgtgagataaaagataacctataaagcaaaacctatcagattaacagcagatttctcagcagaagctttacaagtcagaagggattggagtcttacctttcacctcctgaaacaaaataatgtcaccctaaaattttctatctagcaaaactaagcttcataaatgaaaggaagataaagtcttcttcaaaaacaaatcctgacagaatttgccacccccaaacaagcactacaataaatgctaaaaggagttctaaatgttgaaagaaaaccttgatatacaccaaaatataaccttcttaaagcataaatctcacagggcctataaaacagtaacacaatgaaaaaaatccaaaacatataggcaacaactacatgataagtacaacagtacctcacatttcaatactaacatcgaatgtaaatgggcctcaacgctacacttaaaagatacataatagcagaatgaattaaataaaccaccaaccaagtatgtgttgttttcaagagactcacctaatgcataaggactcatgtaagcttaaggtaaaggggtggtaaaaaatattccacacaaatggaaaccaaaagcaagcaggagtagctattcttatatcagacaaaacagactttaaagcaacaacagtttaaaaaaaaaagacaagcaaggacattgtataatgataaaaggattagtccaacaggaaaatatcaccatcctaaattatatgcacctaacactggagcacctaaatttataaaacaattggtactagacataagaaatgagataaacaacaacacaataatattggaggacttcaatactatacttacagcactagacagatcatcaagacagaaagtcaacaaagaaacagtggacttaaactataccctagaacaaacagaattaacatatatttacaaaacattatttccaacaactacagaatatgcattctttttttcagtgtatggaacattctccaagatagaccatatcataggtcacacaacaagtttctataaatttaagaaaatcaaaattatatcaagcattttctcagaccacaggggaataaaattggaaatcaacttcaaaaagaaccctcaaaactatagaaatacatggaaagtaagtaatctgctcttgaatgagctttgggtcaacaatgaaatcaagatagaaatttaaaaattatttgaaatgaatgataatagttacacagcttacaaaaacctgtgggatacagcaaaagtggtgctaagacaaaagttcatggtgttaaatgcatcaatcaaaaagtctgaaagagcacaaatggacaacccaatgtcacacctcaaggaacaagggaaacaagaacaaactaaactcaaacccagcagaagaaaagaaataacaagatcagagcaaaactcaatgaaactggaacaaacaaaaacaatgcaaaagataaatgaaacaaaaagctgattctctgaaaagataagcaaaattgatagactgttagtgagattaaccaagaaaagatccaaatgaactcaatcagaaatgagactggagatattacaactgataccatggaaatacaaaagataattgaagtgtactatgaacaccttttcacacacaaactagaatgtgtagaggatgtggacaagttcctggaaatatacaagcctcctagattaaatcaggaagaaacagaaaccctgaacagaccaataacaaaaagcaagattgaaactgtaattttaaaattgccaacaaaataagttcagaaccaggtggattcacagctgaattctatcagacattcaaataagaattggtaccaatcctactgaaaccattccaaaagacagtaaaagaagaaatcctcattaaatcattctatgaagccagtgtcaccccaatacccaaaccaagaaagaacacaaccaaaaacgctacagaccaataccctgatgaacatagattcaaaaatcctcagcaaaatactagctacccaaatccaacagcatattaaaaagataatacaccatgatcaagtcagttttatcatagggatgcaggtatagtttaacatacacaagtcaataaatgtgatacatcacataaacagaatcaaaataaaaaatcatatgattagctcaatagatgcagaaaaagcatctgataaaattatcccttttttataaaaacactcacaaaaactggcatagaagagacatacctcaagataataaaagccatctatgacatacccacaggcaacattatactgaatggggaaaaattgaaaacattccccgtgagaactggaacaagacaaggatgcctattgtcaccacttctattgaacatagtactggaagtcatagccagtgtaatcagacaagagaaagaagtaaagagcatccaaattggaaaagtggaagtcaaaatgtcactgtttgccaatgatatgatcatatgcctagaataccctaaagaataatccaaaagctccttggcctgataaacgaattcagtaaagtctcaggatacaacatcaatgtacacaaatcagtagcactgctatataccaacaatgactaagctgagaattaaatcaagaagtcaacccattttacaacagccgcaaaaataataataataagatatttagaaataaccaaggaggtgaaagatatctgcaaggaaaactacaaaacactcctaaaaaagatcatagatgacacaaacaaatggcaacatattccatgctcatggaggggtagaatcaatagtatgaaaatgaccatactgcccaaagtaatccacagattcaatgcaattctaatcaaaataccatcatcattctttacagaacaagaaaaaagcaatctaaaattcatatggaaccaaaagagagcccacatggctaaagcaagactaagaaaaaggaacaaatctggaagcatcacatttcccgacatcaaattatactacaaagctataagctaccaaaacagcatggtaatggtataaaaataggcatgaagaccaatgaaagacaatagaaaacccagaaataaggccaaatacttacggccttctgtaagtattgacaaagcatacaaaaacataaagtggggaaaggacaccctattcaataaatggtgctgggaaaactggcaagccacatgtagaagaatgaaactagatcctcacctctcaccttatacaaaaattaactcaaaatggatcaaatacttaaatctaagaactgaaactataaaaatactagaaggtagcattgggaaacttttctggacattggcttaggcaaagaattcatgactaagactccaaaatcaaacgcaactaaaacaaaaataaataaatgggacctaattaaactaaaaatcttctgtacagtgaaattatcagcagagtaaacagacagcctatagagtgggggaaaatatttgcaaactatgcatctgacaaaggactaatacccagaatctacaaggaactcaaacaaataagcaaaaacaacaaaaaaaatcccatcaaaaagtgggcaaaggggcaggtgcagtgactcacgcctgtagtcccacaactttgggagtccaaggaaggcagatcactggaggccaggagtttgagactagcctggccagtatggcgaaatcctgcctctactaaaaagaaaacacaaaaattagctggcacggtggcttatgcttgtggtcccaggtatttgggaggctgaggcatgagaattgcttgagcctgagaggtggaggttgcagtgagccgagatcatgtcactgtacctcagcctgggtgacagagtgagactgtgcttcaaaaaaaaaaaaaagaaggagaaagagaagaaaagaaggagaagaaggagaaggaggaggaggagaaggaggaggaggaagagaagaagaagaaggagaagaagaaggagaagaaaaagaagaagaagagaagaagaaaagaagaagaaaagaagaagaaggagaaggagaagaagaagaggaggaggagggggaggaggaggagaagaagaagaggaggaggaagaagaagaagaagaagaagaagaagaagaagaagaagaagaagaagaaggagaaagcaggcaaaggacatgaataggaaattctcaaaagaagatatagaaatggctaataatcatatgaaaaacccgcttaacatcactatactatactacaagtctgcagtaaccaaaacagcatggtactagtaccaaaacagatatatagaccaatggaacagaacagagtccttggatttaatgccacaaatctacaaccatctgatctttgacaaacctgacaaaaacaagtgatgtggaaaggattccctatttaataaatggtgttgggaaaactggctagccataagcagaaaaattaaacaggacaccttctttacaccttatacaaaaattaactcaagattgattacagacttaaatgtaagacctaaaaccataaaattcctagaagaaaacctaggcaataccattcaggacataggcatgggcaaagacttcatgactaaaacaccaaaagaaatggcaacaaaagccaaaattgacaaatgggatgtaattaaactaaagagcttctgcatagcgaaaaaaactatcatcagagtgaacaggcaaactacagaaaaaatttttgcaatctatccatctgacaaaagtctaatatccagaatctacaaggaacttaaacaaatttacaagaataaaagaaagaaccccatcaaaaagtgggtgaaggatatgaacagacacttctcaaaagaagacacttaagtggccgtcaaacatatgaaaaaagctcatcatcactggtcattagagaaatccaaatcgaaaccaaaatgagatactatctcacaccagttagaatggtgatcattaaaaagtctgtaaacaacagatgctgattatgtggagaaataggaatgtgtttacactgttggtggaagtgtaaattagttcaaccattgtggaagacagtgtggtgattcctcaaggatctagaaccagaaataccatttgacccagcaattccattactggatatatacccaaaggattataaatcattgtactataaagacacatgcacacatatgtttattgcaacacagttcacaatagcaaagacttggaaccaacccaaatgcccatcagtaatagactggataaagaaaacgtggcacttatacaccttggaatactatgcagccataaaaatggatgagtttatgtcctttgcagggacatggatgaagctggaaaccaccattgtcagcaaactaacacaggaacagaaaactaaacactacatgttctcactcataagtggtagttgaacaaaaagaacacatggacacagggaggggaacatcacacactggggcctgtcggggtggggggctagggtagggatagcattaggagaaatacctaatgtagataacgggttgatcggtgcagcaaaccaccatggcatatgtatacctatgtaacaaacctgcatgttctgcacatgtgtcccagaacttaaagtataataataaaaaaaagaaagaaaaatttgataaattggacttttaaaaaaaatttaaatactcttccaaagaccctttcaaggtgacaaaaaggcaagctactgcgtgggagaaaatattttcagccacatgtctgcggaaatactcaaatctagaatatataaagaaatattaaaactcaacagtgagaaaacaaatatggttgtccctcagtgtatataggggattggtcctaggcctctacctgtaccaaaatttgcacatatccatactcaatcttacagtcagccctgggcatacaaaaagtcagccctccatatatgcaggtattacatcctgtgaatactgtatttttgatccatattttgttgaaaaaaatccatgtacaagtgaatctatgcagttcaaacccatgttcttcaagggtcaatggtaatccagttagaaaatgaaccaaagacatgagcagacatttcatagaaaaggatatatggatggcaaataagtatgtggaaaggtgttcaacatcaatgggcattagggaaatgcaaattaagatcactttgaagtatcactacatatttattatgatagttaaaataaaatagttggccaggtggagggactggatcactcatattttgctggtgggcatgtgaaatgatacactctggaacagttgggcagtttattgaaaagctaaatgtgcaattatcatataacccagcaattgtactcttggatgaaaacttatggttaccataaaacttgtacatggatattcatagtggctttattcataattaccaaaaattagagtgagtctagatgtcctttaatagacattgtttgagattgccattgcatggtggtaataaagagtagaccaactttagttggttttatttttatattttaattttctacacacagcatacccccttattgtcttcaccccagggtagactgttgttactgccctgcacttgatgcaccactattgaaagatattaatggcaccatcaaagcctgcagtgacattgttgtccctccactaaagcaaggaccaggcttccctcagagaaactgactttacaaatagtaaatagaggctctttctgaaacctatcttcgtaaacatatttccctctcctaacaaggagttttggcccttctgccctttagtcagggtcttggtccttggtatttcttgccacagcaggcaatagacaaaggctcccaaagaccttggatggaggcagacattgtggctatgtaccttgtacccaaaggattaagctgccatcttgctggtggcagcccttcaccccagagagaggaaatgccactggtgctttgaggaaggctttgtgcctttgattttccatgtcaagtcagcacttaactgtgaccctggacacatgaggtgaaaaatctttggtttattttggcattaatgtctcttgcccaataacatgggtttctgtaaacagaagtaggcatggagggaggagggaggattacataaaagggactcatccaagcagggctagctgcactatgctgatttctattaaatggcaatgggagataccctcttacccctgatttcagttagtggtagttactttcatcttaatcgaattaattacaaattgggaaggcttgggtcagcttcataaaatgctgttatttatgttgacatttttatgtggctttagctaatatatgttttaattttagattcagggactacatgtgtacatttgttatatgaatatgttgcataatattgaggtttgggcttctagtgtacccatcacccaaatagtgaacattgtacccaataggtaatttttcaacctttattcccttcccattctcccactaatgattattattttaatctcagtaaccagcaatatacctggccactcatgcatgtgcacacacacaaaccctatttgctgtagtggaaaccactctggtgaaggagatatccatggtggaagagttgggcagagtggagaaagaaggaccctatcatttgttgactgcccaccatgtgccacatactctgcttggtgactttacatgtcttagctcatttaatcctcaccacataatgtgtaaagtagatgctattattattcctgtgttactgatgaggaagccaaggctgagggaagtgaagtgagatgatcagataacgtcactcttccggtgcttaaaattataaaattccccttccactgaggataaaagtcccaactcgtcccattctccaagctatgttttagggcctgtcaacctccctagttttatctaggcccctctccctcttgcagtaggtgctccagccacactgctcttcactcagttcctttaatgtgccatattcttcttctgtggggccattactcatgctattctttttgtctggactgttctcctgtgtgcccacctgcactcaccagcgaactcctattgattcttcaggtctcagcttagatttcacatcctcagttctcagggaagcctcctctgactgtcccctttaccctatagtgtccctcagactatgttaggtccctttgttgtatccttctatcacattctgcatctcctccctaccactaatatgattttacatacaaccttgtgttcaggatcgattttcttcattagatgaaacttgctgtctatatactgtcttgttctctgctctatccctagtacctagtacaatgaatgcctggcacatgataagtattcaataaataattattgactgaatatatattgaaaccctctataattaatacatagtaagtgctcaataaatatagttaaaatacagttgttattattgtccaaaagcaaatagttaatcagaggcagaaccaggatttataattgaagtctgagtctaaagcgcatgcttcttttatgatatgactttgtctgcagaaataggttcttggcccagcactgccctaactggttgtatgacacttagggtgagacactatactactctgaatcttagttttcccatcggtaaaatggttacaggagcaggcaaagttcaggtttatcttcacgtaacctagaaaaggaggagaatagaagtctagatagatggggatataagcaaataagtaattaaccaatacaaatcagtatcttccctctgcaagacagttgatgagctataacaagaacccttgatgtttttatgcccttcagcctggtaaccctgttcaaaggcaatatagagtagtggatggtatggatggtatgtaggctttggtgttagagagccctggttcaaatcccaacatccaatttactagctctgtggtactgggcaagttaccaccctgaacctcactcaattcccttctctacaaatgggataacacccaccttttaacccatttctaaggttacaaaaaaaaaaaaaatacaataacatgaaaagatgttttcttagtatagaaagagaaacttctcccaccatcctacccacctaacagttctttctgtagttctgtgccattgaaggctacctcttgaggcaagaggcacaggcaatgtcaagaaaagagagactgaagacaagcaggctgatggcagaagccagagtccagtgtgtggagttggatcacccataggatagactggggcagaggggaagatcagctactgagggagaagaaaggagactacaaatctgagtaaggggataatggctaggcagatcctgagaagcatggtagggagccagtgggaagacaacaacatgccttagagggtacccctttcaaaactttgtagccctttcccagaggcaggcttcaaattatgttattaaaggcccttgaaactgtgtttcttccaaatctttttcttatttagtcacatccatgtatgttttgaaattgtaatcttagtgtgtacactttttcagcgagtatcttatcttcaacattttctatgtcacaagtcttcagtggctgtcaaatatcctaattttgctgaaagcccagaaagtacacctctgtgtattaactttttgcttccttgaattacctccttaaaatatattcccaagtataggattcctgagccacacggtatacaattgggatttaatgaccaaaaccaggtttttctttttctaagaaagaaattacccataatatcctttccccttccttttctggaactgataaacacaccctctagagttgtgctgtctaatatgacagccagtagccacacgtggctgtttaaattttaagtttgattaaataaaattcaaaactcagttcctcagtagcactggccacatcacaagtgctcagtagccatatgtgcatagtggctattatactggacagcacagatacaaaacatttccatcactgtagtaagtttattggacagtgcttacttagagtttctcaagagatcatttttggtttcttgggtgggagttctttgtgttcaggactttcctgggcattgagaggctatttagcatctctggcccatgtccactaaatgccagtaacacatttccttgagtcaatctaacagccaaaacactccatatttgcaaatgccccataagggaacaaaattaaccccattcgagacccactgagcttttagagggaaacatctcctaactttttcttgagacaaggtcttgctctgtcacctaggttggagtgcagtagtgcaatcatagcttaagcaatcctcctgccttatcctcctgagtagttgagactactggcatgtaccaccatgtgtggctaattctttctttctttctttctttttctttttctttttcttttttttttcttttttctttttcttttttttttttgtagatataaggtctcactatgttgcccatgctggtttcaaactcctgggctcaagtgatcctcctgcctctgtcttccaaattgctgagattactggcatgagccattgcacctggccttcttttttgagatggcctcaggttggctctgcctggagagggggaagcttgtaaagatggcttagaaaaaaagtcctggctccatttctattttctcccttcttttgctggcctgtttcctgctttttgcaaattgcaggaacaagaccctgcagatggagaagatcaaggctcgtttgaaggctgagtttgaggcacttgagtcagaggaaaggcacctgaaggaatacaagcaggagatggaccttctgctacaggagaagatggcccatgtggaggaactccgactgatccacgctgacatcaatgtggtacgtggctgcctggagcctatctctaaagcctttgagaaagaggtagtggtgaatgatagggcctttccttgagatgtggcttaggcctagctcggggagcaggcatcagtgcaggctgtggtagagcagaagaattcaggagttctgagatccagccctggctctgtcactaactgactatatatcactggacaagtcccttctctctgggcctcattttccctctctgcactataagggggactcagtaccctctaaatgtactgatttgatgtgctctcattctgggattctgggagttgagagctagccttggggaaaagcagagcaggcagctgcctctggaatgtagtttaaagcactccaagctttcagtcagaccaaacaaatcatttctgcctgctaccaaagtggagcttcctcattgatatatcctttggaaactcttggaacacagaatatgaactgtctgctaaggtggtaagctcccctctttggaattattcaagcagcatcttaatggacacttgtatgagctactgtactgatgattccttcacaaggaaggaggttggcagtgctgaccagtaaggtcttttcaaacccttatcacccataaccatgaagaatatatttttaaaatttactttcaaaggaactaagtttatatttctggaaaactcatttctgtggcaatactcattttctgatgttgtcagacctaggatcataaaggaaatatgaatgaggtttggacagtaagcaattgggattttctgtgttagagatcgcagaattctagatctcataaagtgttgacagtttggctgccagctaaccaatgatacagggccagttaaatgaggaagatatttgccagaagggctaagaatataagccagtggatctcaaacttgagcatgcatcaaagccactttgagagcctaagacacatattgctagactccacccctgattttctgattttgtatgtctgaggtgaacctaagaatatgcatttctgagttcccaggtgatgctgatgctgctgatcccttggccacattttgagaatcactgatctaggagaaaagactgctggcctgggaggcggaagccctaagtctttatgcaggatttgatactaagaagtatttccccaggaaagtccctttttctctttgagcctcagttttctataaaatgggagtaaggtggactaaatgagctctgaaggacattccagctctaagatactatatttgaacaataccatttatttagcagtaaatattaatttagcccatttactgagtgctttatatgaatcctatcattacatcttcaccaagattgcatgagttaagcactagaatatcaccattataccgatgaagaaactgagacttgaccagagttacatggagagggcatgggagatcaaggacttgaatatagactgaacaagttctggagcttgtgctattattcactcagctatagatcctctctgagaaccttaggatcttttctctgtgcctatcccactctatgttccagatggaaaacactatcaaacaatctgagaatgacctaaacaagctgctagagtctacaaggaggctgcatgatgagtataagccactgaaagaacatgtggatgccctgcgcatgactctgggcctgcagaggctccctgacttgtgtgaagaagaggagaagctttccttggagtaagctacctgcccccagtccctacaacataccctccctccgacccacatacatacttacatacctacacacacacgggcaggtatacatacacaaagcctagcctgaaagtcagagtgcctagttttagtcccaggcctttcagtggcttactcactgtgtgatcttgggcaagtctctgtgccagcttgttaaaacagaaggaggattattaaactggatgaattactagatgaattagaacaactactaggtggctttttaaattctttgtgtgatattgacaatacaagactatgtctataactcttaagagatcatttcccaagtcagggtctagaaggcgatatctagaaacctctaaaaacaaaaaagactgagctttcctggtcttcaggaagtggcctgggacttacttcatctcctggctcagagttaagaactaggcttgccttgcagagagacagaatttgacctggtagaggaaatcatttcctaaaggtagagcaaggtgtctgtggagtttgtgagcttcctactcttagagatatgtcaccagaggccttaggacacttaataggaatactcaaaagagcatgagatagcagataggactgaataccctttaaggatcttgctagccctaagatttcttggtcttcttggcctatcagagctaaggacaaagaggattacccttctcatcagacattgggcctagtacccagggacaatagccttgtgcttgggaaggtgtggggaccttctagaatgagccacagctcaacccttggttgtatggcatggagtctttaagaggagcaaggttctcattgctttcagaatgatctagccagtgtctctcatctccaaagttactttgagaagcagaaagcagaatggcagacagaacctcaggagccccccatccctgagtccctggccgctgcagccgctgccgcccaacagctccaagtggctaggaagcaggatactcggcagacggccaccttcaggcagcagcccccacctatgaaggtaagtgagctgggtaatggttgtggaggaagcaaagtatcctcccatggaagggccgtggaaggctagttctgggtctttggctttatttatgctgggccttcttttaatggcctttgcttgtgacacagtggaaggggtgacatgggtgtgctgtgttggacacacacagcacaggttttgttgccccatgttcccagaggtgttagaatgcagggagattttcaggccctgctagagtgcaattctaaaagttagaaatgactcttacacaaagatgtaatgagcatgtatcataaatgagggaaccagcaggattataaagctggttccaggagcatttggaacaaatatctatatagtcaagaaaggagaggaaggctgaaacaaatttgcaaagttagatgcaaaactggtttacatcccacaggacaataaaactgtaactttatagttactttttcttccaaacagaagtaatttgcatctctactgggcaaaagccatttgcagcttatcagtgtaacatcacagagcctgggtcctaatcaattggtaaatagtcaaacaaagagacattcttctagagcaggggtcatcaaattacagcctacaggtcaaatctaatctgttccctgttttcgttaaagttttattggcccacatgcatgtctgtgtttgcaagctattgcaaacaacatgcatgcaagctattgtctatcacttctttcatgcaaaacagaattgagtagttgcagcaagtttatatgatgtaaaaagtctaaagtatttgctgtcctggcctttacagaaaatgtttgttgacccctgttctagaaaattaaatagtccttaagtgggcctgttagacaatgcttcattataatgacgaaaagatgtgtagttctcattttgccttactttctagttttgtatactttttctcaacaccattctctgaactgggttatgtccttccttcccatcttccatggcatccaagaatacttgagtctactcactgattattgctctcttctgatgggaaatcactttgctttctgggcccctggggaatcagaagtctaagttgttgcctggaagaatctgactactaactttctttttcctgtgtccctcaccaggcctgcttgtcatgtcaccagcaaattcaccggaatgcacctatatgccctctttgcaaggccaagagtcggtcccggaaccccaaaaagccgaaacggaagcaggatgaataaagaaagggagagcacatgaagctttgctaattataacccctcaccttgaccagagtcattgatgtcctgatgtgaaacaacccttgcccaaccccacgaagtctcctatttaatgtgatggaagcacaacccctctctcactttgctcctatttctttctgctcttgggatttctggtttaggaagagatgtggttcaggtgctaaacagtgtgtctgatgatcccttctctcccactcacatttcaacccctgcccttgtttggagctaagggaagggcaaaaggctcagatatgattctctatctcttgtgcctgaggcctggagcctaaggagctgtagggtctgaggggcaggggaggcccatatcttgtttcaggtaaaggacccagtatttcccctccttgtacttttgccttaggttctcaagggacaatagtcttcatgttggattctccaacaggctgggtgcatgtatccccctactcctaccctcatctcatccttaaggcccagaggtagcttggacaagccctccttttcataatcatttgggaggcatggctgtaattctttagctttctccacttctgtctcccacatatactaaaattcttaggtactaggctgtgtgtcttgggatcttaagatcaatgaacctttccccaatatctagtctttgcaaattctagtagaagatttccacagtgaaatcagtgagccagaccaactctacatctcctgcctaacctactgcctaagtcattagggctgagggctcggctgtaggggcttccttaggctgagagtgcccccaggctgacatctgtgttggcttttgttcagaaccattactctggcacatgctcaatggtatattgcagggaggagaggagtagatttagatttgagtaaatgccaatcactttacacatgaaggtgggtgggactttccttccattcatcccttgctctcttggatctgaactcttctggagcctcagctcaggatagctgctggccactcctgtcctgtggattgtgcaggtggcctttcctcccaaaagaaaaggcatcaggctccccaagccccacagctctcctttccaccaaagccaggtttcctggtaaggtcactcgaagataagggatggggatgggggctgactgacaaaaaattttagccccaggtctcagtacctggctggggagggggatatttttccttccttaagtagttttacattgccacagtgtgtatgtgttcactatataaaatgttcctctgctctttgaaagtaagagtgttgtgtctgtacaaatccttttaacatgcattcattggagtaaattctgagtatctactgtgtattggataatacaaaagatgtaatgtcatt

SEQ ID NO: 4655 - DNA, 116829 bp, human
caaaaccccacttcctaaggcctagaaggagcgacgtgaaggtaagcgtgggtgaggagaggtccaggatgctctgcaattcgataggcccgaggacttgggatacgaccgtctcccagcccctcgacaggcacctctgcggttaagagtgacagtcccaacaacctcactacttgtctcactgccttttatttgtcttttatttgtttttattttatttgcctacgtatttgtcttggctcctccaattcatccttcacaagggctgccagggtaattttctaaataacttctctgactatgtcactcgtctgcataactcaggtggttaagggtcacctcccttaatagggcctaacaattcttgactactgcaacagcatactctctggtttctttgcctttagacttgtctttctgcaatttgttctcatacttctaccagtgatcaaatgaaaatctaatctcacttccttctggcttagagaatgggctttgaaattacagccaagtttgaatttctgctccaccaccaagtagctctgtttccttgaactaggaatttttttttttttttttttttgacaaagtcttactctgtcgcccaggctggagtgcagtggcgccatctcagctaactgcaatctcttacttctgggttcaagaaattctcctgcttcagcctcccaagtagctgggactacaggtgcaagccaccatgcctggctaatttttgtatttttagtagagacggggtttcaccatgttggccaggctggtcttgaactcctgacctcaagtgatccgcccgcctccgcctcccgaagagctgggattacaggcgtaagccaccgtgcccggcctgagctaagattcttaacctgtctaaatctgtttccttatcagtaaaatggggataattataatacctatagagtagttatgaggattaaatggaaaagtgaatgtaaagcacttaacatacataacttactgtggctcagagtaagcgcttagtaaaaattggagttatttttcaatagattcattatctataataaaggagaaaatacagattccctagcttaacattcaaagtcctctaagatcttgcctctatttttctagccctagctccttccacacccccttaggcacccagccacagaccagtttttaccttttctgagacacatctagatctataaagtgcttagacatatttcccaaaggttcacctgggtaagaaatctgcataaaccctccagttaattaacatgtaaatatccagtgattcttctaaaactacactttttaattttaaaatattgacactgagaattgacatgtaggcaatggctacgtacaaacttgtgtgatattctaggggcttatttacttgatctttttgaaattaggtttagaggttctgtattaaacttaatacaatgtataaacatatttacaaaatgtgccctgctggatgtttatttaataaaatatttaaacattttagaaagtgtaaaaatagctatgccatgtgtaagaactttaagaagccctataataagtgccagtgaaacattagtggagggccaggcatggtggctcacccctgtaatcccaacactttgggaggccgaggtgggcagatcacctgacgtcaggagttcaagaccagcctggccaacatggcaaaatccctcctctactaaaaatacaaaaattagccaggcgtggtggcacttgcctgtaatcccagctacttgggaggcgggggcagtagaatcacttgaacctaggaggtggaggttgcagtgagccgagatggcaccattgcactccatctaggcgacacaacaagactccgtcccccaaaaaaaagaaagaaggaaggaaggaaggaaggaaggaaggaaggaaggaaggaaggaaagaaagaagaaacattagaggagagctcaaatggactgtcaaactaaaatgaaactttatacagaccagccaaaaagtactgaagaaagagaagaacaattggaaaggcgaaaaagagtgaatcactctagaactaattaagtagaagtatcagattggagatcatcaacaagctggaaccaatgtggaagaccataacatagggaatatatattacaattatgaatgtggaaatgagcttggatagagttctcacacagctcatacctttccttccgtatggaacagacatgcctttcaggttctaaggaaaacaattccctagtgttcagccttttctaatgaccatcagtaactcacagggacagactttttacaaaatttgcttatatcttctaaaacctgtattttaccacataaaacctatattctctgttcacttattgaactaatcacattctatcacacatttttttatcagtgtatagagaaatacatatataaaatgctgctagtcatctttaattcttctgtgttcctttctatataaagaactgtgccactgctgtacttaaactccttcaatatctttcctggggtttcaagataaaatctgagctcctttgcccacatcagtgcatctgcctttactacgatagaaaggtaaaaactcctacaacaaacagacctctctatatcaatatggaaaaaaaagaaagctgatttattattgagtaagcacaacagagtacatgcatataagtagccttcaagagactgcaaattcaaaataaaattctatacaacttatatattgcaacagtccacttgagaattgaggcagctatttgtttagttaattgaattcttccaacagaataataaaacttttcttacctccctaaagatacctctagtcttcctgaaagacaaatggttacaccttgagatgggctcctacattaactttgaagacatgtctttacatttcaaagagaaatgtgaccttgaccttggaaatatgtgtgcattataaaactggagactgagactctgtagtctctggagagatttatctacattccaaaagttagagaaaggataaaggttcactctgtcccccaaggagatacattaagaagctaaggaggagaaaataatatatttctctttattcaccttcttttcatttcttttttttttccttattcaccttcatttacctttacaattacaaatcagtgagttcttcaaaaacagaactctgtgctggcacagtagatgcacctagtaaatcaagagtaggtcttccttgaataaataaagtcatagaagaagatgtcaacagatgagtgggaatttgccaaaaggggataaaaatatcccatgcaaaggaaaaagtatattcaaaagcccagaaaatttgaaagtgcatgatgtgttcagcaaaagtagaaaagtgtgacttatgcatattttatctgtatttatgggctgggaagtgtaaagttgtaatggagttgaatatagagaagtaggttgagcaaaagattatgaaatgccttgtatgccatgccaaagtttggaaaaggtctatatctcatggctaaatacggtgttaaagaaaatttttcatgatacttgttaaagatggtaagaaagatttaatttaaggaggattattattatggagttttacagtaggggagagagatgaggctcaactctgagtccaacaagggagggagtaacatttataagtgggaatttataaacaaggagcacagtggaggcatcaattattggaaaattactaagaggaaacattaagtctaggggaattcttgctaaaccaacatgatggaaatcttgctaaaggcagaccagggtaataagatatcaggggtgggagatgagatatctaatcagatatccagaatgatcagataccaagggtaggggacttccactaaactgactcagcaggattcttgctaaaactgaactaagcaagccaagcttagttgagaagaaggctcacaaggacctgactcaaatttggtcaagcagagagtctttgtcaaaggcaaggtactattacttgtttaggagtctagtacaaatattagacagtgctccagccccaaagagcttataatctaatgatgcaagaagacaagttaataaataatttacataaatgaaatcataaattgacagatgtatttgtggaggaggatataggattggaaatagactttgagtaaagtttctgagaaagctccttgaatgagtttgtcttgacatataatataaagggtcagctagacacagtggttcactcctgtaatcccagcactttgggaggtcaaggcaggtggattgcttgagctcgagaccagcctgggcaatgtagcaaaacccggtctgtacaaaaaaaaatacaaaaattagctgggtgtggtggcatgtggctgtagtcccagctactcgggaggctgaggtgggaggatgacttaagcccaggagacagaggttgcagtgaactgcaattgctccactgcactccatcctgggcaagagagccagaccctgtctcaaaaaataaaaaagaaaaataaaaaaataaagagtctccagaattgaagtaattcctagaatttcaaacacttgaaccctttgtgtctgtatgctatagatcttcatcttttgttcactgtttccatttaagctcctctgaagaacatcactatgaccttttaacgcaaattgatgttgccacagatttagtttctcatctacgaactacttggcaatcctttttttttttggtcagtccttctccagttcccctcagctatttctccaaactttaaccattctccactatggcagatgacctcatccttcacacagcaaatctgccacccaactggtgactttattaccttatgttccttaaaaaaattgcaggttacaggaatttttctcacctacaatctgcatctgctcccatattatacccttattcctccagtctcacatagactaaatctcctattagagctcctgatctttgtctcatctagcacctcagaggtcttacccactttttctttctatctcacgtaccttacaactgtccgtctcaactatattattctcctcagcctgtaaacatactcaagactcttccattcttaaaagacatactctcctgtgatcctggagcctccttcagtttcctagaagtgtctcctgttaccctatcatgtttccttctcacccagaggtctcaaaagtggttatcttacattcactgcctctatttcttcacttcccattcaccctccaaccactgtaatagggatttaacctctacctctccactaaaacctattttgttaagaacaccagttactgacaaatttccctatgcaatggacacttttcagtatgtttgttattggacctcactgctacatatgatagtattgatcatttgggtctgcttgaaagtttctgctccacttgattccagacatacattctctgttcttttccttcctctttatattttttatttatgtaactttcatggacacttctccttcaacctacccctaaaacgttagttttccccctcccatagttccactcttggcctatttcttttgttctactctccatgctctattacctgcacatggatgactttaaaatatatattactagctcagaccaccgtcctgagatctagataaataggtccaactgtccactcaacatcctgacttggatgccacccaagcagttcaaattcaacctgtccatgcttgaatgtattttcccatgctaatgggttatttgtctttgttggggtagattccccaaaaaaatttccccaaagagaggcccggcacagtggctcatgcctgtaatctcagcactttgggaggccaaggcaggtggatcaggagtttgagaccagcctggccaacatggtgaaaccctgtctctactaaaaatacaaaaattagccaggcatagtggctcacgtctgtggtcccaactattcaggaggctgaggcctgagaatcacttgaacccaggaggcagaggttgcagtgacccaggatggcactactgcactccagcccgggctacagagcaagactctgtctcaaaaaaaaaaaaatccccaaagggagaccctggtattgtcacataatgatttcaccttctcacagaaacagatgaaatgactgcattatgatcattttatgtgactcaagccaagacttctgtacttttcctgaaaaataagctgcatatatgcaccaaggaagaataagttgaatcactagaattgaaacttcatgaagacagggattcttgcctactttgttcactgctgtatctctaatgcttagaatagtacctgccacatagtaggctctcaataaatctttgttgaataaatgaatggatgaatttgtatatcctcttcttaaaagccctctgggaattctactagattatagcagctagctagctagctagctagatagctggctagacagatatagatagatatcaatatatatacatagattagggaggtatatatctttttgtgtctgaaataggacaaaaggaaattataactgcacttcactcagatttcttcctattgaaagtaaagaaaaaggaggcagagagggataaaaaccactttatctgcctcttggaatagccatttggtagttcttcagctcttccaggtgctcagatctctgctttaggaaaatctcctttgtagtatgccttcaattcccgcatgacgaatgtcatcttctggaatcaagacaattcagacaactgaagatgcccacttcaaacagaaggttgatctggacctcatttggcattatattcaatagcgaataaaggacacatgaaaccctttgcctgatctctgtctcttggtgtgctgaaatttctgtctcactgagaccaaacaaagcaaagtatgatctaatcccaagagtggatgcacttctaagtttggtaggcccccaacggtcctattgtccctctctgggtaggtgtattttaccttgtctcccaaaccaaaaacataaaggtcacctcagactctctcttctaacctcctacatctaactaagttaataagccttgctgattctatctcctaaatatctctcatattcattcatcattcttttacacctgcaccaccaccaattttgccttaatttatttatttcctcctaatttttttcaggagtatttcagcaacttcctaatcaggctccttaccttcattcttacctctcttccaaaccatcttctgcactgcctcttgaataagttatctaaaaatgcaaaccttaccaaattctctccctgctaaaaacgtttcagatctattccccattccttattgattacacttcaagctccacattacttttcataatctgtctcttttccagccatatcccctaccattctctacattctacttcatgctcaggaatctaatactacttgcaattctgtgctgagcatcacccttcttggagcttctctttccatcacttccatcctaatgttactgtagaagtttttaatgttatgtgacccgttggccacagttaaccaatctggaactattatagtccttccttgggagtctggaatctagattaagatatttcatcgtggtctggttgctttcttatgctgagcagtataaacttcatagctgttggcagcagcaacttttctaccatatggtctggggaaaaagaaaatgctggtctgctataaaagatgaggcagaaacacagagagatgcagcagtgaaagagggagagtgtccagatagcagctgagttcctagctgcagcttattccttgaagcccacctgccttcctgtttttgggttccataagacacttctctatccttgtgctaaattcctttttttttttttcctgagacggagtctcgctctgttgcccaggctggagtgcagtggtgcgatctcggctcactgcaagctttgccacccgggttcacgccattctcctgcctcagcctcccgagtagctgggactacaggcgtccaccaccacgcctggctaattttttgtatttttattagagacagggtttcaccgtgttagccagggtggtctcgatctcctgcctcgtgatccacctgtctcggcctcccaaagtgctgggattacatacgtgagccaccgcacccggccgctaaattcctttcgttgctcaagctagtttgaattgaatagctgtacaaacattctgctctcccatattaaactgcttagctcttctgcatctttgcttattcttttccctttgcctgaaaaacagtagttctttccacaaccattttgcctgaataatttatatttgtaatggcccttttcctgtatctggaaggtacctatatttctactctgcccttcattccttcctccccaaagggaaatatttctattataggtcagatggcatgacactgattaggtcagatttaataaagggtggggttgatatttgcaaataggtctcatgcccattcgtggtccttccattcctattcctcctctgtccctgtgggtggatactgtaagagggccagggcctaccttgaggcagtttcagcaatgctctctctctctgtacctaagcagactggcatcaattcagatttatgtgttatgtggctgggtcagaggaccgtaacatttggatttgagcttggggacaggaatgccattagggaacctcattaaggcttcaagtgagccactttttaatcacattttcccatagctttacacagaaaatattttgtgcagcatcctatgtttagtaatcagagttgcagctggtatttagaggggaagagattctctcctgaagtaagagatccctgggggatgtagactgaagaggagagctgcacttaagctagattacaaggcagagttccacatggagaaagcaaaattctccttatggactctatggataaaaaatgattttggtttgcatattttggggcattggttggagggatggcatcttgctttccctaatcccactctctcactcggagctgaggagtggtatatttctccagacagatcacatcttgttgtggcaggaatttaaatggtaggagaaatgtttatattaccatttagataaccaaagtctggagaattcaaaatctgaaggaaagcaatacgattatggatgtttgataagtgccaatagtagcagcacagaactagtaaagatttgcagcctgggcaccatactgagacctagtctctaccaaatatttaaaaaaactagccagacatggtgatcacctgtggtcccagctacttgggaggctgtggtgggaggatggcttgtgcctaggaggtggaggctgctgtgagctgtaattgtgctactgcactacagcttggttgacagagcgagaccgtgactcaaaaaaaaaaaaaaaaaaaaagcaaaaaacaaaccaacaaaaaaaccatggatttggaatttcatgaagcttttagaaaataaatatgacagctcaactgctctctccacaggcaatttctttcagttgaattttattttattttgttttcagcttttattttaaatacggggagtacatgtgtaggattgttatgtggatatattagaccaagtaatgagcataatactcaataggtggttcttcaacccaagcccctctcgttttctcccctttctagcaggtcaccgtgtatattattctcatggttacattcatgtctactcaatgtttagcggcaacttacaagtgagaatatgtggtatttggttttctgtttctgcattaattcacttaggattatggcctccagctccattcatgttgcgaaaaagacatggtgtcattttttatagctgtgtagtattccatggtgtatatataccacatttaattgatcccatctaccattaatgagcacctggattgattccatgtcttcggtattgtgaatagtgtggcgattaacatacaagtgcatgtgtttgtttgtttgtttgtttttttcatataatgatctatattcttttaggtatatacccaggaatgtgattgctgtgtcaaatggtagctctgccttaacttctttgagacatctttaagctgttttccacaggggctgaactattaataatttacaaatttacattccaaccaacagtgtataagtgttcccttttctctgcagcctcaacagcatctgttgttttttgactttaataatagccattctgactggtgtgagatggtatctcatggtggttttgacttgcatttctctgatgactagtgatggtaaacttttttttattatactttaagttctggggtacatgtgcagaacatgcaggtttgttacataggtatacacatgccctggtggtttgctgcccccatcaacccatcatctacattaggtatttctcctaatgctatccctcccctagtgcccccccacccgccgataggccccggtgtgtactgtttccctcactgtgtccatgtgttctcattgttcaactcccacttatgaataagaacaagtggtgtttggtttcctgttcttatgttagtttgctgagaatgatggtttacaaattcatccgtgtccctgcaaaggacaggaactcatccttttttatggctgcatagtattccatggtgtatatgtgccgcattttctttatccagtctatcattgatgggcatttgggttggttccaggtctttgctattgtgaacagtgccacaataaatgtatgtatgcacgtgtctttatagtagaatgatttataatcctttgggtatatacccagtaatgggattactgggtcaaatggtatttctagttctagatccttgaggaatcaccatactgtcttccacaatagttgaatcaatttacactcccaccaacagtgtaaagcattcctatttctccagatcctcaccagcatctcttgtttcctgactttttaatcatcaccattctaactggcatgagatggtatctcattgtggttttgatttgcatttctctgaagaccagtgatgatgagcttttttttatatgtttgttggctgcataaatgtcttcttttgagaaaaactgaaagcattccctttgaaaactggcacaagacaaggatgcccttgctcaccactcctatttaacatagtattggaagttctggccaggacaatcaggcaatagaaagaaataaagtgtattcagttaggaaaagaggaagtcaaattgtctctctttgcagatgccatgattgtatatttagaaaactccatcatctcagcccaaaatcttcttaaggtgataagcaatttcagcaaagtctcaggactaccattgactttcttcacagaattggaaaaaactactttaaatttcatatggaaccaaaaaagagccctcatagccaagacagtcctaagcacaaataacaaaactggaggcattatgctacctgacttcaaactatactacaaggctacagtaaccaaaacaggatggtactggtaccaaaacagatatatagaccaatggaacagaacagaagcctcagaaatagcaccacacatctacaaccatctgatctttgacaaacctgataaaaagaagcaatgaagaaagtcattggtagtttgatggggatggcattgaatctatagattaccttgcgcagtttggccattttcatggtattgattcttcctatccatgagcatagaatgtttttccatttgtttgtgtcctctcttatttccttgagcagtggtttgtagttctccttgaagacgtccttcacatcccttttaagttgtattcctaggtattttaattctttgtagcaattgtgaatgggagttcactcatgatttggctttctgtttgtctgttattggtgtataggaaggcttgtgatttttgcacaatgattttgtatcctaagactttgctttcagtttttacccattcagtatgatattggctgtgggtttgtcataaataattcttattattttgagatgcattgcatcaatacctagtttattgagagttcttagcatgaaggggtgttgaattttgtcaaagaccttttctgcatctactgagataatcgtgtggtttttgtcattggttctgtttatatgatgggttacatttattgatttgcatatggtcaaccagccttgcatcccagtgatgaagccaatttgatcatggtggataagctttttgatgtgctcctggatttggtttgccagtatcttattgaggattttcgcattgatgttcatcagggatattggcctgaaattttctttttttgtgtgtctctgccaggttttggtatcaggatgatgctggcctcacaaaatgaattagggaggattctctctttttctattgtttggaatagtttcagaaggaatggtatcagctgctttttgtacctctggtagaattcggctgtgaatccgtctggacctggactttttttggttgctaggctattatttcctgcctcaatttcaggacttgttactgatatattcagggattcgacttctccctggtttagtcttgggagggtgtatgtgtccaggaatttctccatttcttctagatgttctagtttatttgcatagagttgtttatagtattctctgatggtagttagtatttctgtgggatcggtggtgatatcccctttatcattttatattgcagctatttgattcttctcttttttcttctttattagtctggcttgtggtctatctattttgttaatcttttcaaaaaaccaactcctggattcattgattttttgaagggtttttcatgtctctgtctccttcagttctgctctgatcttagttatttcttgtcttctgctagcttttgaatttgtttgcacttgcttctcaagttcttttcattgcgatgctagggtgtcaattttagatctttcctgctttcccttgtgggcatttaattagtgctataaatttccctctacacactgctttaaatgtgtcccagagattctggtatgttgtgtctttgttctcattgttttcaaagaacatctttatttctgccttaatttagttatttacccaatagtcattcaggagcaggtcgttcagtttccatatagttgtgaggttttgagtgagtttcttaatcctgagttctaatttgattgtactgtggattgggaaactgttattatttccattcttttgcattttctgaggaatgttttacttccatttaagtggtcagttttagaataagtgcgatatggtgctaagaaaaatgtatattctgtcgattttgggtggagagttctgtagatgtctattaggtccacttggtccagagctgagttcaatcctggatatccttgttaattttctgtctcattgatctgtctaatattgacagtggggtgttaaaatctcccactattattgtgtgggaatctaagtctctttgtaggtctctaagaacttgctttatgaatctgggtgctcctgtatggggtgtatatatattaggatagttagctcttcttgttgcattgattccttaccattatgtaatgcctttcttttctcttttgagctttgttggtttaaagtctcttagagtctaggactgcaacccctgctttatttttgctttccatttgcttggtaaatattcctccattcctttattttgagcctatctatgtctttgcacataagatggggctcctgagtacagcacttcgatgggacttgactctttatccagtttgccagtctgtgtgttttaattgggcatttagctcgtttacttttaaggttaatattgttatctttgaatttgatcctgtcattatggtagctgcttatttttcccattagttgatgcagtttcttcagagtgtcaatggtctttacaatttggtgtgtttttgcagtggctggttttggttgttcctttccatgtttattgctttcttcaggagcccttgttaggcaggcctagtggtgacaaagtgtcttagcatttgcttgtctgtaaagtattttatttctccttcacttatgaagcttagtttgactggatatgaaattctgggttgaaaattcttttctttaataatgctgaatattggcccccacactattctggcttctagggtttccactgagagatctgctgtagtctgatgggcttccctttgtaggtaacccgacctttctttctggctgcccttaacattttttctttcatttcaaccttagtgaatctgatgattatgtgtcttggggttgctcttctcaaggagtatctttgtgatgttctctgtattttccgaatttgaatgttggcctgccttgctaggttggggaagttctcctggataatatcctgcagagtgttttccaactttgttccattctccctgtaactttcaggtacaccaatcagacgtagatttggtcttttcacatagtcccatatttcttggaggctttgttcatttcttttcactcttttttctctaatcttgtcttcatgctttatttcattgagttggtcctcaatctctgatatcctttcttctgcttaatcgattcagctgttgatacttgtgtatgcttcatgaagttcttgtgctgtgtttttcatctccatcggatcatttatgttcttctctaaactggttattttagttagccattcatctaaccttttttcaaggatcttagcttccttgcattgggttagaacatgctcctttagctcagaggagactgttattacccaacctctgaagcctgcttctgtcaatttgtcaaattcattgtctgtccaattttgttcccttgctggcgaggagttgtgttcctttggaggagaagaggcgttctgatttttggaatttttagcctttttgcactggtctccccatcttcgtggatttatctgcctttggtctttgatgttgttgacctttggattgggtctctgagtggacgtcctttttgttgatgttgatgctattccttttggtttgttagttttccttctaacagtcaggcccctctgctgcaggtctgctggagtttgctggaggtccactccagaccctgttttcctgggtatcaccagcagaggctgcagaatagcaaagattgctgcctgttccttcctctcgaagctttgtcccagaggggcacctgacagacgccagccagagctctcctgtatgaggtgtctttcggcccctgctgggaggtgtctcccagtcaggatacatgggggtcagggacccacttgaggaggcagtctgtcccttatcagaccttgaatgctgtcctgggtgatctgcttctctcttcagagctgtcaggcaggggcatttaagtctgctgcagctgcgcccacagctgtccctcacctgggtcctctgtcccagtgagatgggggttttatctataagcccctgactggggctgctgcctttttttcagagatgccctgcgcagagaggaggaatctagagaggccttctggccgcagtggccttgctgagctgaggtgggctccatccagttcaaacttcctggcagctttgtttatactctgaggggaaaactgcctactcaagcctcagcaatggcagacgcccctccccccaccaagcttgagtgtcccagatcgaccttagactgctgtactggcagtgagaatttcaagccagtggatcttagcttgctcagcttcatggggatgggacctcccgagccagactacttggctccctagcttcagccccctttccaggggagtgaacggttctgtctcgctggcattccaggtgccactgggatatgaaaaaaaaaagctcctgcaaccagcccagtgtctgcccaaatggccgcccagttttgtgcttgaaacccagggccttggtggcgtaagcaccggagggaatctcttggtctgctggttgtgaagactgtgggaaaagcacagtatctgggcaagagtgcaccattcctcaaggtacagtctctcacggtttctcttggctaggggaaggaaatccaccaaccctttgtgcttcccaggtgaggcaacaccccactctgcttcgtcctgccctccatgggctgcacccactgtccaaccagtcacaatgagatgaaccaggtgcctcagttggaaatgcagaaatcacccaccttctgtgtcaatcttgctgggagctgcagaccagagctgttcctatttagccatcttgctggcaaccaatgaacattttttcatgtttgttggcagcttgtatgtcgtcttttgagaagtgtctgttcatgtattttgcccactttttaatggagttatttagtttttgcttgttgatttaagttccttccttatggattctggatattagacccttgtcagatgcatagtttgtgaatattttatcccgttctgtgagttgtgtttattggtgttttcttttgctatgcagaagctctttagatactggcattggtggttcagtggtagaattctcagttgaattttatttaatgggttatagacactacacagttagcacaaattgacaggcatacagatgaagttaaaaccccaatttttttctgtttcaccctctatccttgttatctgaacaataggcttggtaacagcaatatgataatgttatttttgcttaagattgtcgtaagcatttgatcctacattttatgagtgtggaactgaaacttgagaaaagtggtatccaagggagacttgaatttgtatcactgcagcttcagaagtgctggaggagttacaaccctagtgaaatatagccaagcatgcagctgctgaaggaaaacagactccacctaggaatctggtgaaacctcctctggctgagatacagcaaaataataaattggggagaaagttatttttggctttaatttctttgggaattcaatttctacatagtacatagatttcagcatgaaattttaactttcctgaaacttaatacttagagtggtttcatattgttcaaatgtagacattctgatattgctgttctgatgttgcattatttggactatgctaccatgcagtactcattgaaccaggttggaaaattgtagctatgcataatttcgtgtgtgaaataaaatagcaagtaaatgtttgaactgttgtgcagctttggtcctaggaggataaacaaaataattgatgagtgtcagggagatggtgttagaaaaggaggggtagaactcatgggtcttccctcacaagggggatggttatggctgaccatcatcttgactattaagcccaaagaggtgagagaaaaaatgcagaataatctaaggggagaggagtcccgatggctcttttcacatcagaaataactctagcagatggtttccacatgttttcctactattttcttccctctttctaaacggaagggaacatcaaaccaacagatcagaatgtgagacatgcctggatcacatttacttgtaggccaaagaatgggaacactagactacagaccaggcagctgggcaaagccttggtctcagctgctcctccttccattttgctgggatcatcaaagttctttctttttagctatatgcagctgatagaaaggtaatatttttattcatccttagttagggaaatactagactctcttagaactctagccaagtacttcaaatcaggtttcccagaactctgtattagacatattgggccctggtccaactaataataacatgatgctctgttcccagttttttaattgttctgttctcagggaacaattgagaattaagagtaaggcagaatctgagcattcttggttattctagccaaaaccaacaaaatctcttcacattcccaatacgattcatcttctaactttattctagcaggtacttatgggattatctactccaaaactctctctaaaaagtctgctctcatcttttttgtgcatcctacaacctacatggttgcaacaagagttgttatattattacaacatgatcatactccctaaacatagttgattggaccaggggataagtacattatttcaggcgggccaatcaatactttccctagggtaaagaagcagcatcagctgcatctgtctcttttatcagaaaagcaagagcttttccataagcttccccaggtgattcccacttaagatcattggtcaaaactgggtgcatggccaccctgacttgaaggaagctgggaaagttagtatctcacctgaagctggccacaatgatgcccagaaccaatttaagtctctttttggcaaaaaagaaaaggggaatgggtattaggaaggcaattaacagggtcggccacattaatatatttatttatagatataatgcaaaaataaatttgctaaatataaacctagctgccttgcaaggagagtaattcattttaaaaatgaacttttttggctatatatctttatggattggggtaagcaagctagtaggaaggaattggggaggataaaagtgttctgcataatagaggggaatgtgtttgaaactatgggagcaatcttggagggagaagactaagagaagagatgggaagaggaggaagaagatgatgaagacacgtggttcctgctctgagctttctctttacctccaaatctttaacaaagtctagaactcatgaaagtattattgtgaatagatttcttgtataaactagtgaagggttgaggtccatatgtatactgtattaaaatgaaatatgtataggaagtgcagatgcaggaggcagagaaaagaacctgagaaaagagtgtataagcccctgggattatcatagaatcatgaggaaagtcaggagttcacatatcatggaatgagagaggcctaaaccaattattccaagatctttgaggagtaaggctaacccagccaacatttggattttatgtgtttcttgtccttaccaagtggtgatccccttgaggagtgaggtgccatcatacccatcattgcatggaacatagtaggtaatctataaatacttgttgagttaaattgaatagacctgacctatattgaatttctcaatatgcctattttaactcctttagtaaattagactgtccattaagagtgtgtctgattcagtgttttattaaatgagatgcctaaaacatagtaggtgcttcaagggccaattttcaaagccctgcttttatggagagaaataatgttccaggtaatctgagtcctatttctagcatgctctggaatactggttctgatttcttggcattttgtttcccttaggctgatatgaaaaggaatttttattctcaagcaaatattaattgatggcaggggaaggccacacagatacatgctgtgtggcagagggaaaccagtttgggattttaatttgccaccaatgattagccaaatggacaatcaagaattggcagtgtacagccattactcacaattagaagttgtttaggcagttcatttattctaagtataactgggtacagaaacaagactggaattatagacacataatattgagaattatatgaaattgtaggtgatttttgctttctgtatcattttgtgcaatttcatgctactgaatatgttcataaatgttctttaaaataaattcagttcagttttgttgatgggactagaactaacatttactgaataactattatgtgttgagcactacactacacactttataaatatatcatttaatctttggagatagtttattcacccaattttatggattatataactgagttccagagaggcaaagtgactttcccacagattacagccaaaaagtgcaaatatgaagacttaaacccagttttttctgtagagcttggtgaaatatgaattgctgagcttccacagttcctcccatgaattgctctcacagtttttgacttagtagttttagggaaaggctgagagtttgcattctaaaagtgcccaggttatgctgactgtgctgttcttggaatgacaccatgggaaccatagctccagggaatctaagtatataaaagccttaagtcatctcatcttgggtttccaaatcagtgtaccaaggcacactagtgtgaattataagtgtgcagaggaatcccttttgccctcaaaatggttgtgtaggacctagggaaactagtcactcaagccacaagcagccctgttgtttacctccggtgtgctatacatacaagtattattttctgtcatgtaaaaggaattagaaagcacccatctagtccatccactcatgaggcctgaatcctttctacaaaaatctctaacagatagtcagattctgcttgaattccttcaaagatggggaactcattcacctatgaaatatttagttccaatttaagactgctctaacctgattattataaagctttttttttctacacaagcagacagctgtgagaagagagagcagaagagaaaatatctgaatcatgagttgttagcccatggcagaatgtttaaatggatgttctggagttgtccatcatttcttttctgtaattgttttgctgcataacaaattacccctaaaatctagcagcttaaaacagctgacatttattatctcactgtttctgtgggtcaagaatccaagcataccttgattgagtcctctgcttcagggtctttcacaggtaactatcaaggtgttggctggactctagtcagctcgagactcacctttggtataatctactttcaagttcagatggtcgttggcaggattcagttatttgtggattgttggactgaggggcctcagttccttgcttgttattgaagagagactgccattagttccttgtcacaagagctttttcaacatggcagcatgttttatcaaggcctgcaagctaaaaaaaatcaataaagagagtctgctagcaagagggaagttgcaaacttttgtaacctaatctaggaaatgacatcccgtgagttttgctatattctgttcatcagaagcaagtcactaagtctagcctgcccctaataggaggggattacacagagaaatggatactagaaggcagggatcactggagccactttagaaatttacctattacatgaatacttccacactccttagaatagctatccctggcaaagccccaacaaggcaaccctcctcactgtttcctgattgccctgggttggaggttagacactgacttggattagaccacacagagactatatcacttgctgcagggatttgagctggcaggtccttgtatcagagacttataactgccaacacggtatccatttccattttcttcgttgctagcacgcctgagatttttttcaggtccaccatgtgcctagttcacttcccctgctccctttgcatgcagcttggtgtggccataagactagttctggccaatgaaatgtaagggaaaatttgtcgagcatttctgaaaatgcttttctttcccaataaaaagagacaaaaacagctagaatttctatctctttctttatctttcctgccacgaatatggatatgatggccggaattgaagtaaacaccttgcaagcacatggagaaggtcactgaaatgttagtcctgctatcattgagctaatctatcaacattgataaccccctgcatctatacttattgaatgagaaaaacccttgtttaagccactgtagttggaattgtttattgctgctgaaaccatgcctacctgatgtagtcatgtagagaactgggacttacatttttgggcaactatgattagctaagcacactcggatagtgaacagaggataaatttaaaaatatgattgttgagcagatgttttgagagaggaagaagtaagattatgtagtacaagagagagtgaatgagagcaagagagggaaaggttttccagttctctgagacataacttggttcttctaagtgtgttacacaagagtctctactgtatcattacaataaccctcaattacttgagctaatttctgtaactggcaaccaaacgtgccttgcatgaatacttgagttatttttttaaagcatgtgacttaaagattgcaattaatgtactagatttctttcttttttttcttttctcttttctttctttctttctttctttcttttttttttttttttttttttgagacggggtcttctgtcacccaggctggagtgcagtggcacaatctcggttcaccgcaacctctgcctcccaggttcaagtgattctcctgcctcagcctcccaagtcgctaggattacaggctaatgtactaggtttctttatggctttcatagctgtagagctacctagactggagtctgccaaacaactacattaatgtaggccactcaaagatggcatgccttcatgcctgtaatcccagcactttgggaggctgaggcaggtggatcacgaggtcaagagatcgagaccatcctggccaacgtggtgaaaccctgtctctactaaaaatacaaaaattagctgggtgtggtggcatgtgcctgtagtcccagctactcaggaggctgaggcaggagaatcgcttgaacccaggaggcggaggttgcagtgagccaagattgcaccactgcacttcagcctggcaacagagcaagactcagtctaacaacaacaacaaaaaaaaatacaaaaaaaaaagatggcatactttatcccctgcatctgaccattattggccccagtcactgcagattgactcaccagggaactcgttcacttccacaaaatatttgttgatgtccatctcaatttgtgtcccagatctatggggttgtaattttcttggtttactaccataatctgattgtcaaaaaagactgtaaattgcatcctgggagaagaacttcactgccaccatacgttatacaaatattgaaattgggttccagacctctccctcacccagggcctcgctaaatccagctaattctctcacagaccagaatcacataagaattgagccaggaaaatggattgagcaaagggggaacatggtgtaacacagtggaaagaatatgggctttagagtcagacagactcaaatctagcctcagtcacttagctaagcgaccctgaaacaagtcactcacctttttgagcctcggcttcctcaaaagtgatataaggataataatacctatcatagaattatagtgaggaacaaaactatcaacatttgtagaaaagctctttgccttatgcttggcatgatgaagtttttttttgtttgtttgtttgattttttatctaaaccttagaagaaaaagactgtttattctgtttctcagctaccaactcaagatccaacttaaatctcatttattctgaaagcctcagcattaagctgaaaaaactaattcaccaaagaggttatctaaatttttaaatttctctgagtttatgcaggtataatcaaatactactttcaataattgaaataacagtttgaaaatagtaactatgaaaataaattctgtatttatattaaataatctctccatgtcctatcaacaaaaagttcatcatattggctttaaattatgttttactgaatatatttaaagaaatgcatattctaaaatatgtcaataaaggaacatgtggtcttttccctaattattttatgtggcttaagaaatattttggaaaaaatcttactgacatactcagtctaaaagataaagctcgtctgagctccagtaagaggagagatttggggaggaataaaaattaatttgtggctcttttacaaagtatctcatcccctaatcccacccttcccctactatgggatagcttcaataggagtggaatcccaaaaaagattggaaatattccttatgggaatttaagtcaatcccaaagaaaaaaaaagatttgaaagtcctgaattatttgagtataactgagaaaagccctaatgtgacttaatatatctggactttactaggctaagttttctgtcactggacaggaagcggacttgaggtagtactaagtttgattgtaagtaaagttacaatgtttgcacatctgagtgtgcagattgaaaataagatgtccattacacatgtgagcagaaacacaaacaataagggtcttcaattaagaaaatagacaattccattgtggagaccaacagaaccagagggaagagaaattttaaaaagaccaaaagagaaactaaaggtttatcctaatttgtgagtggtgggcacttggaagttgatgcatcctttttatggttgttttatacattagtttaggctaatagatagtaaaaagtcattgtctttattcaagaatgtgagttcaataattctcaatatgttcctttgtcttcacaaattctggcattaaatgtgactgctccaggcattcctacctaggttatgtagtgtcaggaactctggagagtatgagattttaccctatgtgcaagacaacaagttaggctgacacagtttcattggtgctgactgaagatatgacactcctgggtcaaagacaaaggactttattacttacagcacagcaagtaccataaacatcacatttatgttggttacccttgccccccaagtctcacaggagtaattcaaaagggcccaggtgtatggatgcacatgcagtggatttgtgccatgctgaagaaccctgaacttagggaacctgaatctttcataatacacagcaaacaaacctgcctgacttttgctttgcagggaaacattacctttattatactgaagaataagcaaaccttctatgctctgaatgaagacactatctctgttttccaagattgtttgctatacaaatatccttgaaaagatagttggcacaggatagaggattctggggcaatggtggagtggaaagcatcacgaatctgtctccccacctagacagcagttgcactggcagagtctgcctgatagtaactattttcaaactctggagtctattgaaggcttgcaacttctgagagaaggcttggacagtaaggtgtagttaatttgggtcaatttcaggtcttagcacagtagcagctacccattctccctgcactcatccgtgtggcaggcagctgtgccctgtgttcctgaagtagcttgcaaagagcttgtgggagtctgcagggcacaaaaaggaccttgtcttccaaatattggagaactttgcttgtattgctaattactttataaaaaaataaaatattgtaaattattatggatacataatagttgtacatatttatggagtacatatgatgttttaatactatcgtaaaatgtgtaatggtcaagtcagggcaattgtggtgtccatcacctcaaacatttatcacctctctgttttaggaacattttaattctactcttttagttatattgagatatagaataaattattgttaacaatagtcaccctattgtgctaccaaacactagatcttattccttctgtttaactgtatttttgtactcattaacaatcccatctttatcccaacctccacactacccttccaagcctctggtaaccatcattctactctatctccatgagttcaattcttttacctcccacatattagtgagaaaatgtgatatttatcattctatgcctgacttacctcacttaacataatggccaccagttccatccaggttgttgcaaataacatgacttcattcttttttatggttgaataatatttcattgtgtgtatgtactacattttctttatacattcatctgttgatagacacttagtttgattccttagcttggctattgtgaatagtgctccagtaaacatgggagggcagttatctctttgatatatggatttcctttgtattggatgtatactcagcattgggattgcccgatcatatggtagttctatttttagttgtttgaggaacttgcatattgttctccatagtggctgtactaatttacatttctaccaactgtgtacaggggttctcctttcttcacatcctcaccagcatccattattgcctatcttttagacaaaagccatattaactggggtgagacaaaatctcatcgtagttttgatttccatttctctgataaatagtgatgttgaactttttttttgtatctgttggctgttcgtgtcttctgaaaattttcttttcacttattttgcctattttttaatcagattatttgttgttgttgttttcctattaagttttttgaactccttacgtattctggttattaatcccttatcagataggtactttgcaaatattttatcccattctatgtgttgtctcttcactttgttgattgtttccattgctgtgcagaagctttttagcttgatgtgatccagtttgtccatttttgttttggtcacctgagcttttggggccttactcaagaaaagcttgcccaaaccaatattctggagtgtttatccagtgttttcttctaatactttcatagtttcaggtcttatatttgaatatttaatcccatttaatttgattttgattcttgtatatggtgagagataggggtctagtttcattcatctgcatatggatatcccattttcccagcaccatttattgaagagtgattgattcttctgatcacagaggtacaaagaagccagaaggcattattgttgcacctccccagttgttacaagtcccttctcctctggctgcagtgacttccaagaagtttgaagggctggcaccctttttattttcccctgttacttttctctttttcccctcttcagagccagatattaaagactgggacattcaaaaacaactgtatatgtgaggaaaattaaaaaatgactgtgcctgcccagggcaaggctcagaaattacccatgaagactttagatttgcacttcaggctgatacttggcatagagacagtctacaacaataaaaacttcaaagcaataaataaaaacagtaacaaaaactagaaaaccctaggtaagggagacaatctgcttttcagagttaccaacattactagattcaaatgtccacttttcaatgataaatcacaaggcatacaaagaatggccctttttaaaggaaacgaataaataaacagaaactatccctcagaaagatctggtggcaggtatatcagacaaagactttaaaatagttgtctttttttttttttgaacaacaagtatttattagtgcctactatgtgccagacattcttcgagacacttcagatacatcagtgaacaaagcaaataactcagcatgcctgcatgaaacttacattttagtaaagtatagctggtttaaatatgtaactttactaatactaaacaactatggaaattatgattacagaataaaaggcaaatatttcaaatctggataaaataaatatcatgtaactggaaaattgttaaggagagaggagacaaagctagtaggtactaatttttcacaaagtgtctacttttaatgtttaaaattgaaaagcagtttaaaatacagttatatgctgcataatgatgttttggtcaactgcacatgcaaaggtcgccccataagattataatgaagttgaaaaattcttttttattgttattatactttaagttctagggtacatgtgcacaacatgcaggtttattgcatatgtatacatgtgccatgttggtgtgctgcacccattaacttgtcatttacattaggtatatctcctaatgctatccctcccccctcccaccaccccatgacagaccctgatgtgtgatgttccccttcctgtctccaagtggtctcattgttcagttcccacctgtgagtgagaacatgcagtgcttggttttttgtccttgcaatagtttgctgagaatgatggtttccagcttcatccatgtccctacaaaggacatgaactcatccttttttattgctgcatagtattccatggtgtatatgtgccacattttcttaatccagtctttcattgatgggaatttgggttggttccaagtctatgctattgtaaatagtgctgcaataaatatacgtgtgcatgcgtctttatagtagaatgatttataatgctttgggtatatacccagtaatggaattgctgggtgaaacagtatttctgcttctagatccttgaggaatcgccacactgtcttccacaatggttgaactaatttacactcacctcaacactgtaaaagcattcctatttctccacatcctctccagcatctgttgtttcctgactttttaatgatcaccattctaactggcgtgagatggtatctcattgtggttttgatttgcatttctctgaagaccagtgatgatgagcctttttttcatatgtttgttggctgcataaatgtcttcccttgagaagtttctgttcatctccttcacccactttttaatagggttgctttttttttttctaaatgtgtttacgttccttgtagattctgtatattagccctttgtcagatggacagattgcaaaaatactctcccattctgtaggttgcctgttcactctgatgatagttccctttgctgtgcagaagctctttagtgtaattagataacatttgtcaaatttggcttttgttgccattgcttttggtgttttagtcatgaagtctttgcccgtgcctatgtcctgaatggcattgcctaggttttcttctagggtttttatggttttaggtctaatgcttaagtctttaatccatcttgagttaatttttgtataaggtgtaaggaaggggtccaatttcagttttctgcatatggctagccagatttcgaatccttttcccattgcttgcttgcgtcaggtttttcaaaaatcagatggttctagatgtgtggcattatttctgaggcctctgttctgttctattggtctatatctctgttttggtaccagtatcatgctgctttggttactgtagccttgtagtatagtttgaagtcaggtagcgtgatgcctccagctttgttctttttgcttataattgtcttgggtatgagggctctttttggttccatatgaaatttaaagtagttttttccaattctttgaagaaagtcaatggtagcttgatgggggtagcattgaatctataaataacttcgggcagtatggccattttcatgatatttattcttcctatccatgagcatagaatgtttttccatttgtttgtatcctctcttatttccctgagaagtggtttgtagttctttttgaagaggtccttcacatccctttgaagttttattcctaggtattttaatctctttgtagcaattgtgaatgggagttcactcatgatttggctctctgtgtgtctattattgttgtataggaatgcttgtgatttttgcacactaattttgtatccagagtctttgctgaagttgcttatcagcttaaggagatttggggctgagatgatggggttttctaaatatacaatcatgtcatctgtaaacagagacaatttgacttcctctcttcctatttaacacactttatttctttctcttgcctgattgccctggccagaacttccaatactatgttgaataggagtggtgagagaggatattcatgtcttatgccaggtttcaaagagaatacttccagcttttgcccatatagtacaatattggatgtgggtttgtcataaatagatcttattattctgagatatgttccatcaatacctacactattgggagtttttagcatgaagccatgttgaattttatcaaaggccttttctgcatctattgagttaattatctggttgttgtcattggttctgtttatgtgatggattacgtttattgatttgcgtatgttgaaccgtccttgcatcccagggatgaagttaacttgattgtggtggataagctttttgatgtgcttctggattcggtttttcagtattttattgaggttttctgcattgatgttcatcagggatattggcccgacattttcttttattcttatgtctgtgccaggttttggtatcaggatgatgttggcctcttaaaatgagttatggaggagtccctctatttctactgtttggaataggttcagaaagaatggtaccagctcctctttgtacttctggtagaattaggctgtgaatccatcctgggcttttttggttggtaggctattaattactgcctcaatttcagaacttgctattggtctattcagggattcaacttcttcctggtttagtcttggaagtgtgtatgtgtccaggaatttattcatttcttctagattttctagtttatttgcatagaggtgtttatagtattatctggtgttagtttgtgtttctgtgggattggtggttatatcccgtttataatttttttttttttttgagacatagtttcactctgtcacccaggctggagtgcagtggtgcgatcttggtttactgcaagctctgcctccggggttcacgccattctcctgcctcagcctcccaagtagctgggactacaggcacccgccaccttgcctggctaatttcttgtatttttaatagagacggggtttcgccatgttagctaggatgttctcaatctcctgacctcgggattcgcccatttcagcctcccaaagtgctgggattacaggcatgagccaccacgcctggccccctttgtcatttttatcatgtctatttcattcttctcttttttcttctttattagtctcgctagcagtctatctattttgttaatttttcaaaaaacgagcttcttcattcattgattttttgcagggtttttttgtgtctctatctctttcagttctgctctgactttagttatctcttgtcttatgctagcttttgaatttgtttgctcttgcttttctagttgttttcattgtgttgttagtgtttgattttagatctttcccactgtctgatgtgggcatttagtgctataaatttccctctgaacattgctttagctttgtcctagagaatctggtacattgtctttgttctcattggtttcaaagtacttatttatttctgccttaatttcgttatttacccagtagtcattcaggagcagattgttcattttccatgtagttttgcagttttttttttttttgaatttcagacaatgaatttttttattataaatatatcccaaatattgcattatttttcttttttttttttattgatcattcttgggtgtttctcgcagagggggatttggcagggtcataggacaatagtggagggaaggtcagcagataaacaagtgaacaaaggtctctggttttcctaggcagaggaccctggggccttccgcagtgtttgtgtccttgggtacttgagattagggagtggtgatgactcttaacgagcatgctgccttcaagcatctgtttaacaaagcacatcttgcaccgcccttaatccatttaaccctgagtggacacagcacatgtttcagagagcaccgggttgggggtaaggtcatagatcaacagcatcccaaggcagaagaatttttcttagtacagaacaaaatggagtctcctatgtctacttctttctacacagacacagcaacaatctgatttctctatcttttccccacatttcccccttttctattcaacaaaaccgccatcgtcatcatggcccgttctcaatgagctgttgggtacacctcccagacggggtggcggccgggcagaggggctcctcacttcccagaaggggcggccgggcagaggtgccccccacctcccggatggggcggcagctgggcggaggcgccccccacctcccggatggggcggctggccgggcgggggctgaccccccgcctccctcccggacggggcggctggccgggcgggggctgaccccctgcctccctcccggacggggcggctggctgggcgggggcagttttgcagttttgagtgagtttttaaatcctgagttctgatttgattgcactgcagtctgagggactgtttgttatgatttccattcttttgcatttgctcaggagtgttttacttccaattatgtggtcaattttagaataagtgtgttgtgttgtgttggtgagaagaatgtatattctgttgaattggggtggagaattctatagatgtctattagttccacttggtctagagctgagttcaagtcctgaatattcttgttaattatctggctctttgctctgtctaatattgacagtggggtgttaaagtctcccactattattgtgtgggagtctaagtctctttttacgtctctaagaacttgctttatgaaactcggtgcttctgtattgggtgcatatatatttaggatagttagctcttctagttttattgatcactttaccattatgtaacacccttctttgtctttttgataattgttgttttaaaatttgttttatcagagactaggattgcaacccctgcttttttttgctttcaatttgcttggtaaatattcctccatctctttattttgagcctatgtgtgtctttgcacataagatgggtctcctgaatatcgcacatcaataagcttaactttttatccaatttgccattctgtttcttttaattggggcatttaacccgtttacatttaaggttaatattgttatgtgtgaatttgatcctgtcattatgatgctagctggtgattttgcccattagttgatgcagtttcttcatagtgttgatggtctttacaatttggtatgtttttgcagtgattagtacagtttttcctttccatgtttagtgcttccttcaggatctcttgtaaggcaggcctagtagtgacaaaatctctcagcactgcttgtctgtaaaggattttacttcccttttgcttatgaagcttagtttggctggatatgaaattctgggctgaaaattcttttctttaagaatgttggatattggcccccaataaccctacaatcttctggcttctagggttcctgcagagagatctgctgttagtctgatgggcttccctttgtgggtaacctgacctttctctctggctgcccttaacattttttcctttgtttcaaccttggttaatctgatgattatgtgtcttctggttactcttcttaaggaatatcttggtggtgttctctttttttctggaagttgaatgttggcctgtcttgctaggttggggaagttctcctagataatatcttgaagagtgtttaccaatttggctccattttccccatcactttcaggtacaccaatcaaatataagtttggtcttttcacatagccccatatttcttggaggctttattcattccttttcattcttttttctctaatcttgtcttcatgctttatttcattgagttgatcttcagtctctgatatactttattctgctgatcaattcagctattgatacctgtgtatgtttcacgaagttctcgtgctgtgtttttcatctccatcaggtcattcatgttcttctctaaactggttattctagttagcaattcgtctaaccttttcccaaggtttttagctctcttgtattaggttagaacatgctcctttagcttggaggaatttgttgttacccaccttctgaagcctacttctctcagttcatcagactcattcttgtttggtttgtttcccttgctgaagaggagttgtgattctttggaggagaagaggcatcctgggttttgggattttcagactttttgcgctggtgtttcctcatcttcatggatttatctacctttggtctttgatgttggtgaccttctgatgggatttctgccaggacgtcctttttttgttgatgttgatgctattcctttctttttgttagttttccttctaacagtcaggcccctctgctggagtttgctggagatccactccagaccctgtttgcctgggtgtcaccagcagaggctgcggaagagcaaagattgctgtgtgttccttcctctggaagcttcttcctagaggggcacccaccagatgccagccggagctctcctttatgaggtgtctgttggcgcctgctgggagatttctcccaatcaggaggcatgcaggttagggacccactttaggaagcagtctatcccttaagcagagctcacatgctgtgcttggagatgtgctgctctcttcagagctggcaggcatgaacgtttaaatctgctgaagctgtgcccacaaccgccccttcccccaggtgctctgtcccagggagatgggggttttatctataagcccctgactggggctgctgcctttctttctgaaatgccctgcccagagaggaggaatctagaggggcagtcttgctacggaggctttgtcaagctgcggtgggctctgcccagtttgaacatgctggaggatttatttacactgtgaggggataagtgcctactcaagcctcagtaatggtggatgcccgtccccctaccaagctcgagagccccaggtcgacttcagactgctgtgctggtgtgagaatttcaagccagtggatcttagcttgctggactccatgggagtgggatctgctgagctagaccacttggcttcctggcttcagccccctttccaggggaatgaatggttctgtcttgctggcattccaggagccactggggtatgaaaagaaagctcttgcagctagctcagtgtctgcccaaacagccacccagctttgtgcttgaaatccagggccgtggtggcataggcacccaagggaatctcctggtctgcaggttgcgaagatcatgggcaaagcatagtatctgtgccggaatgcacaattcttcaaggcacagcccctcagggcttcccttggctaagagtgagttccccaaccctttgtgcttcctgggtgaggcaataccccaccctgcttcagctcaccctctgtggtgggctgcacacagtgtctaacctgtcccagtgagatgagccacgtacctcagttggaaatgcagaaatctcccgccttctgcgttgatctcactgggatctgcagaccggagatgttcctgctcggccatcttgccagccaccccagtaattactttaaatgcaaacagattcaactttttaatcaaaggacaaagattggcagaatagattaaaaaaaaaaaaaaaaaaaaaaaaaaaaacacataatccaactgtatgctgtctacaagagattcactttcaatccaaagacacaaataaaaaaatgaaaggatggaataatattcatattaaatgaaaatagtaattcaaagggatcaggattggttatgctaatatcagacaaaatcaatttaaaaaaatgattataagagacaaagaaaaatagtatatattaataaagcatttaatatagccaatataaaattataaaatttatatacttaatgatggatcatcaaaatatatgaagtaaaagctgataaaattgaaggaagaaaatagataattctataaaaataattggagactttaatatcccactctcaataattgatagaacaaccagacagaagataagtaaggatatagaggacttaacacaacaaactagatctaacatgtgcagaacactacacaacaacaatagcacacacatttttctcaagtgcatatatttttgaggatagatgatatgttaggccacaaatttagccactctgtcagtgtttgcttcatatgttttgaggttctattgtttggtgtggatatgtttataattggaatatatttctgacctttttctcaatgtataatatcctagtttttctcttataatagaagtatttttgtctattttgtctgacattagtatagccacaccagctctcttttggatattatttggatggaatatattttccatcttttcattttcagtatggttgcatgtttagatctaaaggaattctcttgtagacagcatgtaattgaatcgtgtttgtaaatacattctgccaatctctgccttttcattgagagtttaatttatttatattttgtgtttacttctgccattttgctatttgctttctgtatgtcttatatcttttttgtccctcatttcctccattactgccttttctgtgtgtttagttgacttttttgcatgcacagtttctattgccttctcagtgcctcttgtttatacttttagatattttatggttaccatgtagattacatttatcaacctaaatttataacaatttagtttgaattgatactaatttaactttaatagcctacaaaaaatgctacttggcgaggcgtggttgctcacacctataatctcagtattttggaaggctgagccaggcagattgcttgaaccctggagtttgagactaacctgagcaatatggtgaaacccctatctctgccaaaaaagaacatattagccagccatggtggtgtggtcctgccatgcctgtagtcccagctactcagaaggccgaggtgggaagaacacccgcacctaggtgatcgaggctgcaatgacctgtgattgtgccactgcactccatcctgggcaataggtcaagaccttgtctcaaaaaaataaatgccactatatatctttgccccacactttatgttgttgtcacaaattacttctatgtatattgtgtgaccaataagagatttataattctttttacgagtttgtctcttaaatcatgtagaaaataaaaagaagtgttagaaaccaaaaatatgatattactggctgttagatttgcctgtttggttacctttaccagaaatctttatttcttcatatggttttgagttactgcctagttttcttttatttcaacctgaaggacttcctatatgttttctcataggggtggtccagtgttaatgaattccctcaccttttgttcatctgggtgtgtcttgatagtgccatcatccttaaagtatagttttgtcaaatataaaattcttgattaacaattttttcttttagcaatttaaatgttttcccactgccttttggcctccatggtttctgatgagaatcagctgttaattttattgaggatcccatatacagaatgagttgcttttctcttgttgctttcaagattatctctttgtctttggctttcaacaatttgattacagtatgtgtcagtttgtatcactttgaatttatcatatttggaatttgttgagcttatgggatgtatagaatcatgcctttcatcaaattttggaagtattcagtcattatttcttgaaatattgtttctaccatttctctctctctcttttttcgttctaggattcccaaatttgtatgttggtccacttaatggtgtaccacaggtcccttaggctctattcacctttctctattatcttctgtttgtggttcttaggactgggtacttccagttgtcctatcttcaggtttgctgattctgacttctgcctgctcaaattttctactgaacccctgtagtgaattttttttatttcagttattgtacttttcagcttaaaaatctgtttggttcctttttaaagttaatattcctatatgaatattttaattttgttcatacattgtttactgatttcctttagttcattgctcatggtttcctttagttcttttagcatatttatgacagttgtgttaaagtctttgttgcttcctcagagatagtttctgtttattttctttttgaataagctttcttttcctgtttattttttgtgacttgtgcttttttgttgaaaactggacatttggatattataatgtggtaactctggaaatctgattatttctctttctcagagttgggtgggttttttttttaacactgtaatagcctgtttcattacttttcctatttttgcagatactgtatttcttgtctgtggttactgaagtttctgtttcttagcttgtgttcacctatggttttgacatatttccttgaattccaagagctaaaacaaacaaacaaaaaattcacctatttctgtctttacaaattttctatgctgggccgctccttcatcacttagcctgatcttagcctttgaacactgagcctagggatcagcccacagtggaaatctgtgctcttatcaggttttttctgagtatgcatcttgtcttgggcataagtgtggctctctaaattatttcatatacagatactttgaatgccctgatttcccaagcaaactcccccagatttttctcccagacctgttgcatatttcattgctaatcttttgcctcaagcatcttcgtgttgtttatttgccttgctttacgatatttttaagcaatgctcacaagttttctgccctgagaggattccaaggtaggtaaagcagaaaagagcaccttgcatcattccttcaggcagcccccagacagttagaaaatagtttgcatgtgaggtctgctatgcttcttccagaaccagagtccagtgttccacactgagagtgtagctgctatcttcaagatgtagctaagtgtacctaaggcctgatgtggtggctcacgcctgtaatcccagcactttgggaggccaaggcaggtggatggcttgagctcaggagttcgagaccagcctgggcaatatggcgaaaccctgtctctacccaaaatacaaaaattagccaggtgtggtggcacatgcctgtggtcccagctactggggaagctgaggtgggaggatcactttagcccaggaggcataggatgcagtgaggcatagactgcactccagcctgagtgacagagtgagaccccatctcaacaaaacaaaacaaaagaccactgctaagcttgagaggcagtggggcaaagacaagtaaaaacatcacaagatatcctaccattttaaagttgcctttttcttgatttggcatgttctcagctactataaaccactctttttgagagcctgatgaagttgattctgacagtttctgcttctttttaaatattcctgtagagggatgggaatggagttgtttactctgccattttcctgatattacctagaaaatccttttttttttttttttaatgacaaggggattctgtgaaactgatttgcttttttccccatgaatcctagaaaagcatgactgattttgtaatttccttctgactttggctgttaagaagctctgagatagaattatggctaccactagcagttatgtaagattttgttttctagttctacttttgtatgtatcttactttatgcttttatttcccatttgtccctctttactctttcattttctttgtttttttgtttgtttgttttgcaatgtgtgtatctctgtaaactgcatgaaattctttttgtggaagaaggtgagagacaaataagggactaggattaagattctaatattttcacctactactgggccacctttaaactgttaaagaatctaccataagtatttgttgaaattctgttgctttaacaccacaatgttgcttcagtaaataaaaaagccaagcagagcacaaaaagtacatcacaaataataattcatgattgtgaaatgaattcctgaacctgactttcaaccatgaagttcaaaggctggaaatggtaaagtcaacaggaacaaattggaagtaaaaaaagagtgcagggttcctgaaacgaataatgtaaagcaaaacttttcatggatccctaagaatatcctaatttgaacaatataaatataatttttatttgacttgttttatttgacttgttttatttgacttgtttatataaagcattgcatagtggtcaacacatgagctctgtagtcagattgcctggctttgacccttgctgtgtcacttatgaacttggtgaccttgactagttacattacctctctgtgactctgtttctgccgctttaaaaatgagaataataatagagcctaattcatagcattgttgtgagaatcatactaataatacctgtaaaggtttaacagtgcctaggctatactaatcactcaatgaaagttacttattatttaatgatgaatcatcatgcaaaagtgaagttatgtttccataactgcaaaataaaatacttgaggcatttttttaagtggagacacaaacattttaaaattctgatatagacctttttcatgggaaataattatcttagacacatgaaaatacacctaagtaggatcttgattctgccatttagtaagtggttttggcaaatttacttcacctatttgcatctgagtttcctcatctgtaaaacgagagttgaactaacaactgccttgaggatgaaatgaaagactgcaggtaaagcaccaagcagagtgtttgcacataagtgctcaaacatttcttcttattattctgaaataaagagttggcaggtttaaaatgaagaggagggggtgctcttggggagtagggtagaggaagacccttagcaataagtagagtcttattccatttgcactgttataacaaagtaccattagctgggtgcctcattaacaacagaaatttgcttattgtggttctggaggctgagaaatccaagatcgaggcactagcagattccatgtctagtgagagcctgcttcctcatggatgactgtcttctcactgtaactttacatggcagaggcggaatgaacctctctctggcctcttttataagaacactgacctaatcacctcagaaaggacccagctactaataccatcgtcttgggtgttaggattttaacataatttttttaggaggacacaaagactcaggtcatagcaactaggaaacctgagattaagatctaaaatcaataaatcagacaacacacgaatggcagggtgataacaccaagacagggagcttgaagggaagaggtggctaaactgatgccatctccactgggggaatgttgtcaaataaaatacaagatgcctgttaaatttgaactttatataaacaaaaaaacctaatatgtctgaaatgttgcacgacacatacttgtacaaaaaaagtatttgttgtttatctgaaattcaaatttaactgggcatcttgtatagttgctaaatcttgcaactctatggtggaggatgcaacagccttgcttgcagaagttggctaatgagagcacagttaaggggcccaggaccagggtccaatacctgatgtgacatcactaagtttagctttctagtaggtgtgtcaggaagccaaggatccagattcctgtgaaatactcaggaatcaccaaggaagtaggacctgggatttgggaagattctgctccaggacacagtctgcatccaggaggtgcaaggattagatctgtcttaagtaagggtgttagcagacggtaaaagcaggttggagaatgacgagccttgatagtgcttggtatgtgtgggaggaaaagagggaatggaacttggcggtatcaaccacagtaaaccatcagcacagaagatgggacaaaagcagaaatctagccctgaagactgggcacaccatgaggcagagcaggcaagtccgaattagggaatgacgtaccaacatgactagttttggtccctgggataactaaattcttggtatgcttgggataaaggaagcttggggaattcagctattgtgagggatcacccaaacccaagtttgagaatgtgaataaattctgaaccccacaaggcagtgggcagaggttattataactcttgctgatgagcttataaactggagcatatttgagcctggatgtgggcattagtggattcagctacaatcttagcagacgtgtagctgacatagattgagggatgttcaatctgagcctgtcggagattggagtcaggcagggaaggtgaacaagaatgctcatttgctctgaatgtctcatttatgaaaggtcttaagttgagactgaagcgtttatattgtcactgaaataaggcatggtttgacatttttatgaagatataactcaccgtaaatttcaccaataaaaatatacagttatgttttaagtgtataatttagtacattttcagtgttttggaaccatcatgactatctaattcttgaacattttcatacctcatacccattaagaagtcactccccattttttcctccctgcagcccctggcaaccattaatttactctctgtctctatgtacttgcctatactgtatatttcacatgaatggaatcataaacatatagtcctttgtgtctgacttttacttaacatcatattttcaaggttcatttgctttagcatgtgatcaatacttcatttgttttatggatgaataatgtttcattgtaaagacggaccacaccttatttatccactcatcaattgatgggtatttgggttcatttctactttttgggctcttaaggttaatgctgctatgaacattcacatacaagtttttctgtggatatatgtttttatttctcttgggtatatacctaggagtagaattaatgagtcatatgggtaattctatgtttaacttgttgaggaactgccaatgtttctactttttttctttcactcctggcaagctgtgagaatagttttgtttgtttcattttgagacagggtgatgctatgtttctcagcctggtcttgaacttctaggttcaaacactcctcctgcctcagcctcccaagtagttggatttacaggctcgcaccactgcacccctccactttgtaatatgtcagggttcttaaaaaatagaaataaatttgagcctttcaaccactgataagtcctatgcttaaccagtattgaccactgggatgatcttcaaggtctagtggaggtaagtgtgacaatgtaacaccacaatgcctaaataaactcttatacaatcaccatcacatcttcccataccttccctcttttatcttcatttcacagagatagggagatttaaaatgaatattcagatctttcagctacactgaattttccaggtaatgatactttcttcacaggaaggcattattattttcccatttttgcagatgggaaaccgaggctccaagaagtaaagtgccttgtccaaggtcccacatccaatgagttgttaagcctacattgaatactaggattttcaatgcctggtctaggatcctttcagtgtagtctttgcccctatgtgcctctgaaaaaggtagaagattgctgatatatttgggctcccaaactgaaatcagacagcctcaaaaatgttgaaagttgatcattaacacaagagtggaaagaaagaagttggggaggaggagagaaggcatattgtttctctctgtgagcatagtatgactgagaataattcatctgaggggaagccgttcactccccatctgtacagcattaattcactgagggctgggtctacactaggccctggagatacagaaagagaaggaacagggctgaagctagagtgaggtgagtggaggtagttgacttgagcataattttaagggaatgctgaaaatctcagtaatcaagataaacaatattttttcttaggtaacttgttatttttattatagattcacatgcagttgcagaaaaatgatacagatagatctcatgtaaattgtactctgttttccccaatagtaaccccttgcagaactatagtacaataccacagagaagatattgacattaatataatcaagatacagaacatttccaccaccacaaggaaccctcatattgcccttttatagccacacctacttccctcccactaccattccctctgtaacctctggtaaccacaaatctgtttcccatttctatgattttgtcattcccagaatgttacatgaatagaatcatatccctttagggattgacatttttttactcagcataattctctggagattcacccacagatgtatcaatagttttctttattgttgaggagtattccatggtatggatataccaatttgtttaaacattcacctgctgaagaacatataggttgttttcagttttgggctattataaataaaactactataaatatgtataggtttgttgtaaacataaattttcacttttttctggggtaaatgtccaggattgcaattactaggtcatgtggtagttgcatgtttcttttttaaaaatacaaaactgacaaaccattgtccataatggttgtaccgttgtgcatgctcacctgcaatgtattagtgactccgtttctctgtatctttgccagcatttggtattgtcaccattttttaattttagtctttctgataggttatagcgatattgcattgtggtcttaatttgcgtttcccaaatggctaatgacgttgaagaaattttcatgtagttaccatctgtataacctcttcagtgaaatgtttcttcatatcttttgacaattgtttaaattgtattaactttttactgttgaactttgagggttattaatatattttagatgctagtcttttgttgaatatgtagttttcaaatattttctcctagtgtataccttgtcttttcatcttctttcacatagaaaaaaatttcaattttgataaagtccattttatcagcttttccttttatggattatgcttttggtgtcaaattaactcccattcacaactgcttcaaagagaataaaatacctaggaatccaacttacaagggatgtgaagaacctcttcaaggagaactacaaaccactgctcaatgaaataaaagaggatacaaacaaatggaagaacattccatgctcatggatagcaagaatcaatatcgtgaaaatggccatactgcccaaggtaatttatagattcattgccatccccatcaagctaccaatgactttcttcacagaattggaaaaaactactttaaagttcatatggaaccaaagaagagcccgcattgccaagtcaatcctaagccaaaagaacaaagctggaggcatcacgctacctgacttcaaactatactacaagcctacagtaaccaaaacagcatggtactggtaccaaaacagagatatacatcaatggaacagaacagagccctcagaaataatgccgcatatctacaactatctgatctttgacaaacttgacaaaaacaataaacgaggaaaggattccttatttaataaatggtgctgggaaaactggctagccatataaagctgaaactggatcccttccttacaccttatacaaaaattaattcaagatggattgaagacttaaatgttagacctaaaaccataaaaaccctagaagaaaacctaggcaataccattcaggacataggcatgggcaaggacttcatgtctaaaacaccaaaagcaatggcaacaaaagccaaaattgacagatgggatctagttaaactaaagagcttctgcacagcaaaagaaactaccatgagagtgaacaggcaacctacagaatgggagaaaatttttgcaatctactcaagggctaatatccagaatctacaatgaattcaaatttataagaaaaaaaaaacaaacccatcaaaaagtgggcgaaggatatgaacagacacttctcaaaagaagacatttatgcagccaaaagacacatgaaaaattgctcatcatcactggccatcagagaaatgcaaatcaaaaccacaatgagataccatctcactccagttagaatggctatcattaaaaagtcaggaaacaacaggtgctggaaaagatgtggagaaataggaacacttttacactgttggtgggactgtaaactagttcaaccattgtggaagtcagtgtggtgattcctcagggttctagaactagaaataccatttgacccagccatcacattactgggtatatacccaaaggattataaatcatgctgctataaagacacatgcacacgtatgtttattgcggcactattcacaatagcaaagacttggaaccaacccaaatgtccaacaatgatagagtggattaagaaaacgtggcacatatgcaccatggaatactatgcagccataaaaaaggatgagttcatgtcctttgtagggacatggatgaagctggagaccatcattctgagcaaactaccgcaaggacagaaaaccaaacactgcatgttctcactcataggtgggagttgaacaatgagaacacatcgacacaggaaggggaaaatcacaccctggggcctgttgtggggtggggggaggggggagggatagcattaggagatatacctaatgttaaatgatgagttaatgggtgcagcataccaacatggcacatgtatacatatgtaacaaacctgcaggttgtgcacatgtaccctaaaacttaaagtataataataataaaaaaaagaattcagaggtgataattttgagatgagtccaaaaaaaaaaatcctttgcttagtcctagatccaaaaggttttctcctttttttttctaaaagttttataggtttacattttacatttaaatccatcatccattctgagttaatttttgcataagatatgaggtcttttgagtaaaatttttttttcctaacagatactcactttctccaccatcatttgttgaaaagatcatcctttcatctttgtgggaaaaaaaaaaaaaaaacccagcaaaccagtttggcatatatgtgtgagtctatgtctgggtcctgtattctattccattgatccatgtcttttccaccaccaatactacacagccttgattactgtagctatctaataaatgttgacatcaggtagaatgatttattctactttattctctttcaaaattgtttttagctatttcagttcccttgcctttctatataaattttagaactatcttgtctgtgtcggccaggcacggtggctcacacctgtaatcccagcactttgggaagctgagacgggcggatcacaaggtcaggagattgagaccatcctggctaacacagtgaaaccctgtctctactaaaaatacaaaaaaattagccgggcttggtggcgggcgcctgtagtcccagctactcgggaggctgaggcaagagaatggcgtgaacccgggaggcagagcttgcagtttgcctagatcgcgccactgcactgcagcctgggcgacagagtgagactccgtctcataaaaaaaaaaaaaaaaaaaaaagaattatcttgtctgtgtctacggaaaatatttctggattttgatatcagtttccattaaacttgtatgtcaatttggagataattgacattttgtcccagtctttatcattaggctcctgccttgttctttatgccccaatttgctgtccaggtcaccaggtcctctaaaatgaagactggcttttctctcactggacaatctgtctaccttcctccattgcttccaccttagagactacctgaagtctggtagctggaacccctatttccatggacacaccatcttggagccaactgcccactgggaccttcaaaacatggactgccttggagctctccttgttctgcatctcctacctcttgggatgcccctactaatttacgtcatactccactggcttcctgaactatggcttgccacttaatataccgtagtccagctttatacctggagcctgagtcttccctcctcactaactaactccaatgtcagcatgtagtagcagagagatgggggaatgcctggccttagattctggccccttttagcttgacctggcttgccactgctaataaagctataccaggccacatcttgaaacatggaaggcagagcatctagcttgggactggaggactaatagaccaaaaagctgtctttgacaagtaaaggataagcatgtttgtcttaatagcactttttttcttgttgcatttctttgatctttggccaagccttgcttacttttatcctgtttttctgtctttaaaataaggacaaattggaataaatcactgtttttcaaatattttttaagcaacagatcactgtattgaaaaatatcttccacaaaatccccaaatatgaaaataataccaattaagttctagttaaaaaaggagtaggggtggcttcccttcactctaaaatcttagagttctgccaaacccagtttaaaaaccatggatatagctgtcttctgagaagcctttccagctttgatgcccactaacatttatagggttaaataagctgaggaagtaagagggtcaagaggagaaatgttcagtgagcctttactcaaaatgtgatggcttagaggagtgtgggctctagcaaccagcatgcctctgcttgccataggaaaattgattcaaggtttctaacggtgcctgcaacagatctagttctgaaaacacctgtctgggaaaccctttcagattctccctggtagagtttcttaatccctcttacattatcccagagtttactattcactcctccattataacacagcgcacattgtattgtcattgcttatttacgggcccatctccaaataagctatgagcatccccaaagcaggaactattcttatttctctggatctccagcccctaggacagcaggcaaaggacatgtcttctcaaaagaagacatataaacagcaaacaagcatatgaagaaattttcaacatcagaaataatcggagaaatgcaaattaaaactactctgagatactatcttataccagtcaagatggcttttaataaaaagtcaaaaaacaacagatgttggaaaaaagggaacggtcatacactgttgatgagaatgtaaattagttcaacctctatggaaaacagtatggatatacctcaaagaactaaaaacagaactaccattcaacccagcaatcccactattgggtatctatccaaaggaaaagaagtcattataacaaaaaagacccctgtactcatatgtttattgcagcactatttacaacagcaaagtcatggaaccaaccgaagtgtctaccaacagttgattggataaagaaaatgtggtatacatacaccatggaatactatgtagccataaaagaacaaaatcatgttctttgcagcaacgtggatggagttggaggccattattgaaaccagctttgtgaacattgtgacagtgaggaaaatctgacatatgaaaactctaatagtgaaagaaatctgacctaactgccaactccatcttgcttctaacctccaagttgcccttgctcatgcctgtgcatatgccaaggtaattatgggaggaatttagtttgtagtttaacaaacaaagatgctaacagccccttcccaaaacaaatccccttcttgcttggggatcaggcctgttttgtaaaactaacaaagtagccacaagataagaaataatggctcaggattcatgcagccagtggtcacaagattgctagcctccccagttgctcctatagataacatcactgttataaaacctaagattggtgtctgaggtatttttcagaccctgcattctgatggaccagctgggccacccagagaagtaaactggctcatctggtcttgtgccccaactcccaggaactgactcagtgcaagaaaacaagctttgactccctatgaattcatccgtaatgcaaccaaacagcattccccattccctagtcctctgcccatcaaactgttcttaaaaatccctagcctctaaatttttacggaggctgattcgaataataataaactcctgtcctcttgtgtagctggctttgcatttatcgaactctttttctattgtgaaaaccttctgttctcaatgcattggcttttctgggaagtgagcaagatgaaccccttgggtgattacattatcctaagtgaactaacacaggagcagaaaatagaatatcacatgttctcacttataagtggaaactaaacaaagggtatacatggacataaaggtggagaaaatcgactctggagactcaaaaaccatggaggatgggagggaggtgcaggttgaaaaactgcctgctgggtacaatgtccaatattttggtgatgggtatgctagaagctcaacccccaccattatgcatataatatccatgtaacaaacaagcacatgtacccccaaatctaaaatttcaacaaagaaaacaaggaggttactaataaacgtgttgaagtgaaatgttgggtcaagaagacattccttgaattcctttgtgtcttcaattactctttttccctcaagaaacccaaaatcattcaaattattccccaaaaagcttatctaaatttttagaaggcaaaacttttttaagttaaatgtttgaatactattccgtagagctacaggttattttttgatctagtttatgatataagttgagatacatttttatgtgctaacatacactatatatgatttatcttattaattggaagagtagatcatgtaatcagtgtatatagtaaatttacagtcattttataggactgggaacatgattttcatatttttaaataatgtcagatgtataaatttgttatatcctcaattttatgacagattggccacatctatgatgcatttgtttggtattttcattcccaagtagataagcacaatcgttttcaagtcttgtgatttagaggataataggaacctgtctggtaggggagctaggctgccaatgatggaaaacaaggaggtaacaagaaagtttattgaagaatatccatcttaataataatagcagacacttctacagtatttattatgctgttttagccagttccgtatattaatttaattacaaccctaagagttagttacaattactatcatttccattttccatacgagaagaccaaaacccatagaggggaagttatttgcccttgagtcagatagctaaaaatagtagagaccagaggtgagctcaggcagcctgactgaagagtctgggtgcctcaccactatgcatactgccacctgtgctaggaaaggaagggctatctgggaagtcaagctgggcaattatacgtgatatatgcaaggggattttgaaggcccaggagaggacatctgccttcccactcctctcccaatctgtttacttgcagataccagatgtttcattcataggcataaggtttggtctattgtttacaatgcaaccaacccctgggtggggtactactaagatttatgtgttatttttactttcccagtctgtttcatttttattttatgagtgtcatttttcattgtacatttttatacagttgaatctgtccatcttttccttgtggttgcttatttgtcattgtggctttataagttatcatccctctaacgcttctactataaatgaagccattttgccccaaacttaggggaaataatggctacaaccttcacatcaaatgctgccctgtccattttgagatttctaaatgaagcctctgtcattgtcttctcaagcctaaatcaagacaacttatttatagttttttcatgcttctctcctgtttctattcactgaattatccccaaatttgggttctccaaatgactctaagaattagggcaagtggtgagaaggatgagggatattgacctgtaatcaatgcctattataattcaaccaatgtgctaggtgctttctcataacttatctcttttcatttaatcattaaacagctctgtgagggggacaagggccctatgagtagttctaaagtaccccagcctgggaaagatgtgcagggaacctggtaagactcagcccttttggaaactcaatcccatacttagttctggtgatataaaggaggctgttagaaacggaaggtcattggagctagacagtcagttttggtcactctcaaagaggtgagaattgaagaagaggggagggtgtggatgaaagtttactaagaaaatgcagtagatgtacactagactgcttttataataggattttttacactagggtttttcggacttgcagaggggaaaaatgggactcccctacttccactgccagatctttgttccctgaaatttgcatttgggggatctaggtcagtgacattgggtaggtgagaaagaatagaggagtgaaatttcaatgacataaagccatcaaaaacagcaagaatttcagctgaaacattgcctgagaatacctagcactgtctatgtaagcagatacaaattctggctaatcacccacaagtcccatctcctaggggaatcttcaaagttaaggcttcaaacacacccctcaacaccccagctgaagggctgaagtgatggagaacatgaaaattttctgagagagtgtgaagaatgagattacctatctcagctcctaactccctaacctagggaggtcaattaccatttctgttcttcagtttttccatatatcacatgtgagtgccttctagctctaacatcgtacggttctcttccagtctttcctgtttcagtgaatggcactgaccttattactgaagccaaaaatccaggagtcattttagatgccttatctcgccctccgtacctctccatcctatccatgagctaatcatatcagttctgtgcccaataatatgttcccaatcagcccatttttcttcatatctactattactactgtaattcaagccaccataatttctttcctggacaactgtaatagttttcccactggttttcctacttccacttttgccccaataaaatctgttctcacagcagtcagtgatgtttaaaaactagatcatgttgctcccctgcttaaaaccctcaatgtttgcctattgtaattagaataaaacccagactcatcaccatggtttacaagaccctgtttttagaataacagttcaatgacataaactgtctcctcagtctacttctgctccccttaatcagccagagccctacctacttttttttttcataggctaagcattttctgactcaggaccattgcaccggctattcgttctgcctggagcactcttcctccagatcattgtatgcccaactccttatgtctccactacaatgtcatctctgaacaggagccttccctgaccatcctaactaaaacattccccctcctgccatcattctgtcctattatcctcaattagtgtcttatgggcttatctcccccaaatattattatgtttatttttttttcttttctgtcattattgtctggctcctcctactagaatgtaaacttcctaagaactgggatcttgggtaactaatagaacatagtaggtgagagcatggcttctggaggcagactctctaaatttgaatctcagttctgccacttactagctgtgttactctgggcaagttacttaacttctctgtgcctcaacttcctcttctgtaaaataaggatgataataatatatacttcctgtgaagtttttgcaaggattaaactaacttaatacatgcaaagcactatatatccctggaacctaggagagtgcctggcatgtagtaagtgttcagtaaatatttgttggctgtttgcatgaattaatcctcgatacctcctgctgtttccctcccttcctctctcatcctgcctagttttgttcaggaagcttttccctgactccttgcccacttctcaggactaaattggttctccccttatgtgtgtgtgtcttgctcacagaacctagacttatttcaagccctgattgctaggtataactatatatgtatgcatgatctttgtaatagctggtctctctcactaaatggtaagcttggtaagggcagggcccatgtctgtcgtatctgctatgaaatcttcactgaaacctcgatggttcctgacatatcataggtgcacaataaacatttttgggctgaaaacttttggctcacttttctcttagaaatgctgattaagaaatataatgagaaatttaataagtaatttgcactactttttgaaaggcaatttggaaccaagactgttgttgcatctctgcctccttttagtttagttcactgttgaagtacaaagaaatatctgtgaattcaatattctggcctccatttttaaagtcttgatctattccctgaaagtataatcgagactgactggcttcccttttgctaatttcttgcattttaatggtattaaccccaacataccctgccttattgccttagcaataagaataatgttggccctgataaaactaagatttttttttatttctaacccctcaaatcaatcagttcttctaataaaatcatgcattagaactcactgctagcccatatcttaaatattgtttcagccattgcaaacttctgatcaattgagagctactgaacacttactatggaaaagccaccaccttggcttgcagatactgttttaagtgctgcttcagaagaaggggcagaaggctatagtttccttctcttccccactgtttctctacaacattttccttcctctcactgctagcctggattcttaaaattcagcaaggaacaggtgagacatctgttctcaaggaggtcaaggagccaaaagcaaaccagcagaagctaagaggcacattactctttctgtatttggacattttaattgttacaaatagcacaaaccttcttccaagctccaggttttcccatggcctcttctcttagattaactgctatctcccttaaatgtccatagttggaagcatgggacatgcttggccctctgcagacaccctatattggagtgcaccttctggctgaaaagtaacagaggcattcaggccccatggtagcagcagcagcttgatacaggccgcatggggccataggaagagcacaggcccttgagtcaggagtcttggttctgtttcagccaagtagggtgatgtcagacaagtcctttgcctctcttggtctcagtttcctcatctgtaaactaggatttcggtgaggcttgaaagacaagatagttcccaaattattaccaaatcagactctaaacccattaacatatttaattgaaacagatacatacccacatccagacttttaccagatgtgtgaacatagtcagtggtaaggattcttaaggtgaaggggacaatggaaaaagagagagacattaaatttaaaatctcaaaggctgttcataaattgcttcccacacatcccatacaaaccctccgcttctccccaagccagcattaatgcattataaaccactttatgtttgacatagatacatacactcgggaccccattgtagttttggttgctatatatatatattttttttttccagacacactctcttcattaatctgcaagtaacttggtccaaactgggcacaggctctagctttataacttattgtgtggacatggcaaaacaactttccctatctgagtcagttttcttccttctaaaaggggatgaatctacttgcccccttcatagtggttgtgaggatgaaatgatagattgtacatatcagactcagcacagtagccagtacatgtcaggcacttaacgcaggcttgttgcttacctcctccccttacgggacagagctggggccagttcttggctctggatccacaggctttgtgactaaccaactcaatgttctttaaataccaactagtggctgtacaagatagcaaccttcaagacaataggaaaatgtagacaccagggagaattttatggttaagaaagttattacatcttggatccaaagaagagaagggctttaatttcttccctggagaatgcttaaaatcactgtggacatccagaatgacatgagattcatgttccacaaacttctcaagctcctacaaaataccaagccctgtattcagcatgatcatgggaatgatctcatagaggcctcccaacaagcctctgaggtgggctcactaggtacatttttcagatgaggaaactgaagctcaataaaagaaagcacaaactcagagagagttctgactcacttttagttgggagtgagtcaccatcttccttttgcccaacgtccagctctctaggcctgtttgtgcacgctgagtaactgcctcttacctggtctcatgtcctctaatcattctccactttgcttccagagtccctctctaaaatattcctccatccttatcactaccgtgctttgaaacataaaataattaaacattacttggtgcagaataagcacttaaaaaatgtttattagggccaggcgcagtggctcatgcctgtaatcccagcacttttgggaggctgaggcgggtggattgcttgagctcaggagttcaagaccagtctggccaacatgatgaaactccatctctactaagaaatacaaaaattagccgggcatggtgggtgggcgcctgtaatcccagttactcgggaggctgaggcagtagaattgcttgaacccaggagaaggaggttgcagtgggccgagatctgtgccattacacgccagcttgggcgacagagtgagactgtctcataaataaataaattaattaatttaaaagtttattagataaatgtctgcctacaggattaagtccaaaccctttagtctgacatttaacgtatttcatagtctggttcctacctgccttttctaaatactacatctcccatttcttttttccacctctacacctcatataagaaacctatatttcaggcactctgaaccactcatcctttcctttctctctctattgtatcctcacctggagagcccattctcctctatggtctgacaaattcttagtcactcttgagacctatttacatcttctctgcacaggttacaccttatctattcctgtattttgacaccacactgtactgtaattaataggtaaattttcagcctcttctgttcctcaaaggcaaggatttgcttttatttatctgccttgcccggtgactcctacagtacttcttccattgactggcaaagtccgagcttaagtaattgtttgttgaatgggtaagtagctggaagtacttacccactctcctttcccccagcttttgcagcatctccctcctcccatcctcctcttccccacccccgccccaccctaaattgaatgccaaagttactggtccccaggcagcagctagcacattcaacgtctccaaagctactttccctgcagggtttctttccatccccaaggcgtaattagcgactaccgctaatcttttgcgggtgggtaggtgcgagggcccccgaagggagcgaatgggtatgtctctcatctctccaattgccttcaggaatatttttttctccattttcccacacacgggccagacgaatatccccattcctttgcactcttcacaacctttgacataattatctataacaaattgatttaaagtgcggctgcaggaagggaaacaggcatgtctcgcttggccttctgggagttgtagtcctacaggcccccgggcttcctggctggccctgaagctccggactacagctcccaggcctctccaagcccctaccgcacaggctcatagccccaagcccggaggaggtggctacattgtgtctattgtatcccttggctggtgtatttgtacatctctcgggacgtgaaattgacagtgaaaagtatggcagatgagcaagaaatcatgtgcaaattggaaagcattaaagagatcaggtaagtggcacgttgtccccctccccgcccctctccaacccttcgttgcgggagagggctaattatctattgttgggctgtttgtctagaggagctggaaaggggcccattcaccacagacttgccggagaggtgaggatgggaggggcgctgaggagagttgagagagagagagacctcttgccagatgtggctgagaaagcaaagatgaagaaacacgggtttggtaccaagacagttttattcttctcgaggtggaggtcagggctctgcattcatggacacgttttttaaaagtacttgtgtgccccaaggtgtctttggctccttgctctttaggagtcgggatttttttccagtctcttgttcaacttcagaacctggagttcgggaaaggcttttgagagccaagtctagcgcatcggggctggtggctgctgccaggggctgccaactgggggttgcagaggaatctcagcgggcggagctgggagaatggcgcgcgctcgttttcctttcactcactcgccactttcttccttcctatcccgcgcttgggagggggatgggagcaatggggactggggacgcggtcgctgcgctgatggtgggatcgcgacagctgctctgaggagctggaggtgacaggcgggctggcaaagtgggagttgccgaagtggagtccgctacacggttgctcctggagcagcttttggcaaagcgatgatattgtccttgctcagaacacaatagcgccaggcgggctgtgtgggctggcacaaggtctttcttcacctcgccttctcagcgtgagcccctgctttggcttttgctctcactctgagagtggcctgggtcaagctctctccctggagtgttttctgagaacccaaggtggaagatgtcaagtgtgtttctttaagaaataagactttgatcatgagatttaacccttagagtgctggatgagacctacacatggtgattagtggtggtaggtaaagcaccttggtttcttcttcttcttgaggggttgcatctctctttctacaggagaggtaaaggaagggaactatcatttattgagtcccttcccgcccctgtgtgccaggccctttgacctacttttgctcattcagcaagagtcctgtgagcttcctactcctcctttacagctggggaaatagaggcccagagaatttgagtgattttcccacagccacgcagcttgaaattgccacattttgttggtctgcctgcaaaggtattccttttcccactatgtcccaggtaaagtctggaaaggagaagggaatatgttgcaattttttttttttttttttttttttttggcaaaagcatcagaagctagctagaaagtgagacaccttagtacagtagaatgccagctgtcataacgatgcagctagtcagaagcttaggcttgcaaatggagagcctagacttccactctcaccaagcttcaaaggaaccaccaccccatgcccagagaaggaccagttgtgagcaaggactttaatccccagtgaaaatagacctctcccagtgaagaccatatggagaaccatgacttctacccttaccagtggtaactaggagtttctacctcaaccagctaggatggaatcagcataggcccagagagaaggccaaactttcacctctaaacagcagtaacaaacagcccttctccaaactggatgtcaagagacagtggagaaactggacttctactgtccctcttccatccaagagagtggtagaggactgctaaaacaaaagatttaaataagatccagagtatccaacttttaatcaaaaatcactttccatactaagatatccacttgaatgagaagagaaaataaacagatgccaatactgagataacacccatgttagaattatctgataaggatcttaaagcacctgtcctaaaaacatttcagtgagcagttacaatacacttgaaacaaatgataatgtagaaaatctcagaaaatgaatagaaagtctcaacaaagaaatataaaacataaagaagaacaaagtgacatttttagaactgaaaaatacagtaacataaaaaccccaaaaaactcaatggataggttcaacagtaaggtggagaagagagagggaaaaaatagcttacaaatataaaacaatagaaatcactgtggcactataacaaaagctttaacatttatgccaacaaattcccaggagaaagagggcaggattggaaaagtattgggaaaaataatgactaaaatcttcccaaattgtgcaaaagacataaacatttagattcaagaagaggagcaaacaccaacataattgacacaaagaaacacactccaaaacacattgtaatcaaccttctgaaaatgaaagaaaaaggaaacttcttcaaaacagctgaagagaaacaaaagctacaaaggaaaaaaaaaattagaatgacagatttatcatcagaaactgacgatgccctagcattttgtaagtgctgaaggaaaagaagtgacaacccataaatctatgtccaataataatatccttcagtattgaatgggtaatcaagacattctccaatgaagaaatactaaggaatttagatataccctaaaaaaagatgatagtaagctctgaaaacagaaaagaaacaataaacagtaagcaaaagcatggttaatgcagtagactttctctttcctcttgaaatttcttgtattttgataattgaagctaaatttatactgttatctagtgtggtctcagcatatgtagaggaaatatttaacacatttatattgtaaactggggaatgtaaaggggattgtaaatgtaaagagatgtaaaggggaggacatgcttctacacttcattcaagcatgtaaagtggtaatgtcagaagactattaaataaattatgtatacataatatattactgagagaaaacactgaaaatgctatacaaagaaatgtactcaaaacattataaataaatcaatatgaatttttaaaaaatgctccagtcacccacaggcaggcagggcaaagaaaatggagaaactaaaattacggagaatgaacagaaaaaaaaataaaaaggcagacttagccttcatgtatcaataattatgttcacaacaaatagtctaaataccttgcaaacattaatcaaaataaagcaggaatggccatcttaatatcaaataaaacagacttcagagcaaagaaaattcctagagatggatattacataatgaaaaatagtcaatctaccaagaagacataacaattccaaatgtgtgtgttccaaaagtgacttaaattaaactgcttttgacaattttacagtaatatacaaaggttaagccacttggtttaagaatttaaaatggagaaagtactataaatatatacttgatgttcacatatggacagataaacatgtatgagagatagaaataaggaaggagcaaagggtcaaagaaactgaagaaaggaactaacatttgtcaagcaccttttaatttaaaagctcctggctcatttactctttagtcttcccaaaggaaatctgggataggaattattacccccactttacggataaggacattgaggatcagacagattaggcaactttcccatggttacacagctaggaaagaaaaaataatatatcctcctattcacatggcatgcacatttcaatgttattaactgcccttacaaatgctgattatctgattaaccattattcacagttcttcaactgctataatcctaaatctcctgaagtataagcatagcagcatatttctgttaaagaaataatgtttgctggacagaagcaggaatgatgacagcagcatcatctaatgacctattgaagtcaagctaagagccttacacacatcaagacacgagcccagaaatatatgcattcatactcagcactcacaccaatggcagaatttgcagtgggaaaaacatcagaagcagattctcccaccacagaccattttctgcttctaactctgaacacacgcctacccctgtctttcctcccaatcccaatcacactcccacattatgttcccaacctcagcctccaaatcctacactaatctattttgcccatgttttccttggacttttaaatggtgatgaaggagcatgtagataagtggaagaagagagacaagaatggaacaaaagaagggagatagaaaagagggaaagggaggatagcagtaataaaacagagacagtgagtacaggcaccattaaatggaccagagccctacaccagctccccaagtacaaaacaatatttccttaaaatgcacatgccatccattcatgtgtattgcgtacactcacaccccgatgtacacatatccatacacaaagagctttcctcacttgaaaaaaagaaaaaccattttggaaggagatgttgagttaagtaggtactcttaaatgaatgtttctcgactgggtccttcttttctttttttctttctacacactcttttgagtaaattcctgtacttccatggcttcaaatattatcctccaaatctccaacctctataccccacccacattcatgctttagcccatacatatgacagcctactgggcttgtccgcctggaagtttcacagataaatctcagctttatatctacgtctcttcctacagcaatcaagctcctccccttaaacctttggtttaataccaccattctctgcacagttacctcagatggcaatctgaaagtcaatgttgactcccctttctctttaatgactcacctgcaatcacttagttaattctatttctatcctgaatatcttacccaatacctgccccactctccacctcccagttcactgctccatttcaggccttcattatgaattggcatggatatttgtaatgcagtatccatttccatctgaagaattacttccctgtctacagtctctcctctgtctgcaatggcatccacattgccttgagaactaccttcctaaagcatggttgttattttatttctcaaacatcttcactaacttttcattgtgtatgacaatctttttgaaaaatacaggctgcgtcccattattagctcataaaaagaatttagttggtcactagtagcatttttaaaaaaccttttttaaaataaaaaggaaattatcaacatacattgcatatgaagtagtaggtatactttggagaaggttttgtttagttttaaatatgtgtatgtgtgtattgtgtcatgaggtgaaattcatttctcacttacgtcatttcttactgtgtctctgttgaacacacatttacctatcggtgtttccatggcattcatgctgcctccccggaaatctgtcccatacccactattctgaccttatctgctactgctttttattaatcctatcctttagccatatagaagttcttactgttttatatatttccgttccaccagacctttgcctctgcagattcctcgttctagaatgccactctcccattccaagcatctaaatcctactcatttttcaaggaagacccatatgaaatgcctcgtcttctccaaaaccttctcgagttccccagtcaaaatgaattacaataccccaaccacagactccacagggagatttattatagcactcaagttatcccatctaatgatggaattttgaattgatatcctcccttccttcctcccttccttccttccttcccccctccctccctccctcccttcctctcttcctctcttcctcccttcttcctttccttccgccattggtgtggcagtcttggtaagctcctctgttacctggcttggggattgactcagaaccagtgcttactcaagaccaaggcacaggacaactggaacctctgggacttgtggatgggcaaattaagccaaacaatgctggccacaggagagactgaaaaggtgttggcatttggtattgagatgtaagaaagttatcagaatgaactgttataagaaatctactttgctgacagtagctttgtttccagttgagcaaataaatattacatggaagaatgcttagtacttaggcaatattctcaccagactggagtaagcaggaaaaactagctcctttgtgttcattcagtgacatttactgagcataaatctgggccataatcagggctgggctatcctttggtggcccatcacttaggataaataagacccatcagaaggatcttctaatcaaagtcaatagctctgatctctcccttgagttccagactcacatatctaactgcccatttaacttacacccttgcatgtatcactggcatctcaaacaggccctcaactccagccccacccctaaacatttttatttcccagtcttccccatctcagtaaatgcctcactatgctgaaatctggaagccattctttattcctctttttatgtgaccctctccatccacaccattagcatagtggttattatacttgaccatgcaggaggttacacctaaagggcttttaaatcattgattgctgagccccatttccagggtctctgattcagtagatatggagtggggcctgagaatttacatttctaacaagttcccaggcaatgctgctgctggtggtgcagggactacatgtggagaacaactgcattagtaagacctggccagttatacctatacaatataatctggaattgtccacttctcatcatcccctcaacttattaacaaataccagcacttttccatcaatctccagtaaacagtatcttttcacctaattttcccatcttcaaggcctacaggtcccagctgtcctaccctgctttttgagtgtgcattggggctgagtcacctctgaaactgggtgacagatgagcctgccaagtttgtcccagcaatggatgatccatggccctagaacttctccttctttgcacctgtcctcttccatatttgccagaaagaaatcattgaaaagaaggtatccagctgaatgttttatagtcttggctcaggagactgtctggagaacctgtggcctagcagtctgctatgatttgaatgtaccccaaatttcatgtgttgaaacataatcctaccattttgatggtattaagaggagagacctttcgggaagtaattaagtcatgaagcctctgccattatgaatggattagtgccttagaaaatgacttggaatgagtttagacccttttttgtacttctgtgattccaccatatgaagacacaacattcactccctcttgaaaatgcagcaacaaggtgccatcttggaaggagagaccaagcccctcaccagacaccaaatctgttggcacattgatcttaaacttcctagccttcggacctgggagaaataaatttttgttctttacaaattacccagtctgtggtattgtgttatagaagcacaaacagactaggacaggagctcaggaatactggtccaaaagttacctaagactgtcatcctggtgactgtagaaaccctaaagtaccctgaaaaccctgtggtttccctgtggttcacgagtcatactagctgtgctttagcctcttggaaaaatctcattaggaaattttatatataaaattgcatctttaatgatctggatggcttcctcacttgtagggccaaacattccacagatttcatctcattgaagcatccaacaattccatgcaaggctacactgagtcctactttccaggtagaatttccaaggtgccaagagattccatgaagtgcactatttcaccctgaaaattgatgactgagccaggacaagaattcaccctactggcctggtttttatggctttaaatccatcatatgatgaaagttccttgttgtgatggaaaggtgatcagatttacaacgctggattttccacttcctgaatttgtcttcttgggcaagtcactttacttctctcagcctcaaattcttcatgtgtgaaaataaagtgaaacatacctgccgatatggttcttatgaagattaaattttgatagcataaaaagtgcctaatacagttgctggaacatagtaggcaccacaaatataatagctattgttattaaataaagcctttcttaacagacggttgctttcagttcctgtcacttagatagattcttaataaatatgaaccaaatgaatgaaatccttgccacccatggtaatgtcttttcttctctgaggctactgatgctataatcactcccctggatttactacctaccattcagtagtttctcattccaaatgtaatgattgagccccgcttatggccaaagcagaatgataggtgttgtggaggttaaagagagaaatatggcatagtgccactgtctagaaagccctcgtgtatataattactctgatttcaagttgcttcatgcataaatctgtactttttagaggacccagaggaccatgactatgtgccttgtgctagtccctttcccatcctggacctttatttattcacctctgaaataaagaggatagatttcatgggtgactttgaaataatgttctgacgagcccagggaattctaaggagggttttaaagggccactgtgatagagtcaggtggtggttgaatttgaggacagattaatgactctgggggtcccacttccactttaaccataacagttatgatttgttccattttctatattggatctcaatcagttattttatttgaaggaagggatcttatcattcatccacaagaaccagcgcacttctggataaatggtgcttgcttaatacaatttttaagtctgcttgattgatggaagtttgtaaagagggaatttggtattgtgagtacatctaagcagtgactggcatgacactctttgtagattagagagaggaagggccttttatttagatttaatcttagctcaaacttctcaattgctggacagagaatggaaggctgggaattagatgcaaatcctgaagaccatagtaaaggcaatctacctcaaatgcaacaaattatttatttatttatttattattaagccattaagctccttctcatttctcctggctgccttaatcagcaaactttaaaaaaatccattccctctacgtaagccttttgacaagtcatttatttttctgggaaaacatgagcatgcttagaagttatgtttagtgggagttgtaggtttagatttaattctgggtgcagtaagaggtcattacaggataatttgagttatattttatataccataggaaacatccatttcaagtgtacaattcagcatgttttaataaatttaaagagttgtacaatcatcaccataatattttagaaaatttccatcattccaaaattagctctttgttcagtttcagttgatctttgttcttatccacagccccaggaaacctgtaatatattttctgtctaaatagagtggctttttcttgatgctgcatataaatagttatacaaatgtggccttttgggtctgccttcagtcacttagcttattgtttttgagattcattcacattgtaacatgtaacagtatttcattcctttttgttgacaaataatatcccattgcatggatatcgcacattttgggtgttcactcacaagttgaggagcatttcagttatttccactgttttggctcttatgaataatgctgctctgcacatttgtgtacaagtctttttgtggaaaaatgtttccatttctactgcttagattctcaggagtgagatttctgtttcatattgtaagtatatgtataactttttaagatacaagtgtttttgaaagtggatgtcctagtttccatcccaagagggagtgtatgagggtcccagtttctctacatcctcaacaatacttgttagtgtctgcctcaaaaaggcattatagccatcctagtggtgtgatgtgatagctcacagtagttttaacttgcatattcctaatgaccaatcttgttgagtatctcttcatgagtttatttgccacccatatatcctcttctgtgaagtgtttattcaaaccttttgttcattttttaactgggctgtttgtttactgattgtgagttttgagtgttatttacattttctggaaacacatttttaccagacacttgatttgcaaacatgttctcccagtctgggacttatcttttcattgtcttaacagtgtcttttgaattacaatgtctttttttttttttttttttttgcttctttgtttgaaacaggatatcactccgccacccaagctggagttcagcagtgccatcgtggctcactgaagccttgaattcctgggctccagaagttatcccacttcagcttccccaataactggactacaggcttgtgccaccatgcctggctaatttttcttaaatattttgtagagacagggtctcactatgttacccagggtggtcttgaactcctgggctcaagcgatcctcccgccatggcttcccaaagtgttctgattataggtgtgagacaccgcactgagccagaaacttttaatgttgatgaagaaatccaatttatcagtattttttatggattgtgaattcttgtgccatttaggagaaatgtttgcctaagtcgtattcacaaagattttctcctatattttcttccagaaattttatttttaggtttcacgtttaggtctatgatccattttcacttaatttttttgtatgttgcaaggtacgggttaaggattttcttttgcatttggatgttcagctgtttcactatcatttgtttgaaagacttgtccttacatctgtgggtttatttctgacctatctgcttcattgctttatttgtgtatctttatgccaatagtttgctgatttgattactatatctttttaataattacggaaaccaggtcatgtaggttctccaacttcattattcttcctcagaaataattttgactattctaggcgctttgaatttctatgagttttagattccccttgtcagtttctaccaaaaaccatactgggattttaataggattttgttggatctgtagattagtttgttagatttcaccagtgtgtaatgaaataatgtcctatttctgttctaggatctaacccaagataccacattgcatttttatgattccatttaacttattttatgacttattagctataatgctgttttattatttcagtggctgctttagagtttataatatacatccttaacttatcacaacctaccttcaattgagcgcataatactgcacatataatgtaagaaacatacaacactatatttctccctttctggcctctgtgctattgcattttggtactttttggtttaaactgttgattatatttttaagtaacttaattaaggaagaaaataatcatgatatttttctatgtagttaccattttcagtgctctgtattcctttgttttgatacatttccctctgctatcattttccttttgcttgaaggactccctttaacatttgtggtagtgcaagtttgctgatgatatagcattttacctttccttgtgtgaaaagttctcattttacctttgttttcaaagttgttttccctgggtaaataattctatattggcatggatttcgtccgtactttaaaagtgatacaccactgtcatcttgcttccaacattctttgatactctttgtgtaacatatcctttgtttctgactcctttactggttttgagcaatttgattatgatatagcttggtgtgatgttctttatggattttatgcttggagcttgatgaatctattggatcagtgggcgtgtagctttaatcaaatttgaaagatttttggccatttattcttcaaatatttttatcttcctctttcttcttggtcttcagttacctgtatttttaattcaatttaatttaatttgatttaatttaatttaatttaattttactgtggtaaggtcacagaacttgagatctaccctcaacaaattttatatttataatacagtattgttaactagaagcataatgttgtactgcaaatctcttgcagttatcatcctgcacaactgaaactttatacatattgaatagcagctctacgtttccccctccttcagttcctagcaactgccattctactctctgcttctaagaatttgactattttaaatacctcatatgagtggaatcatgcagtatttctccttctgtgattagcttatttcacttaggattatgtccatgttatctcatattgtaggacttccttcttttttaatgcttaataatattccattgcataaatatactacattgttaattcattcatttaggttgttttcatatcttggctattgtaattaatgccatgataaacacgggagtgcagatatctctttgagatcccgatttcaattcttttggacaaatacctagaagtaggagtgctggatttatatatttttatatatttattatacctgttggccatgtttatgttctttggaataatgtttatggaactcctttgcccagtgttcaatcgggttaatagcttttgtactattggtttgtaggatttcttatattttatacaaattaatccattatcagatatatgatttgcaaatatttcatcctttatgcagtttgccattttactctgtttattgtttcctttgctgtgcagaaacattttaatttgatgtgatcctacttggtcatttttgcttttgttgcctgtgcttttggtgtcatatccattaaatcattgccacaagcaaagtcttgaagtttttctcttatggcttcttgtaggagttttgtagtttcagaagttatgttcagtgtttaatacatttgtagttaatttctgtgtatggtataagataagggtccaatgttatacgtttgcatgtggacatagtttttcccatagcatttattgaaaggactatcatttcttgcattgtgtattcttgtaaactttgtcaaagatcaagtgactgtatgtgggtggattcatttctgggctctctgttttttcccatggcctctatgtctgtttttatggcagtaccatactgttttaattactgcagctttgtaatatattataaaatcaggggataagattgttctggctacttggagtttacatgaatgtaaaaaaaaatgccattgggatttttataaggattatattgaatctgtagattgccttgagtagtatggttaagtcttccaatccatgaacatgtatgtcttcccatatgtttgtgtctaccttaatttctttcatcaatacgttatagtttcatttattgctaagtattttgttctttttggtgctatcataagtgggattgtgtctgaatttccttttcagatagtttgttgatagtgtacagaaacacaactgactttgtatgttgattttgcatcttgtaactttactgaattcatttattaattctaacaatctttttggaattttttgggttttgtacaaataagattttgtcaactgaaaacagcaataatcttaccatttccttctcaattttggtgacttttatttcattttcttgtctaattgctctggttaggtctctaggatctatgttgaatagaaatgtcaagagtggacatccttgtctttttgctgatctttcagtgttttaccattaagtatgacttagctgtgggcttttcatatatggcttttattgtgttgaggtaatttccttctatttttagttgttgagagtttctatcaggaaagggtgttgaattttgtcaaaggctttttctgcatttattgagatgatcatgtgactgttatctttcattctgttgatgtgatatagcacattaattgacttttgcatgctgatctctcctcacatcacagggataaattccactggccgtgttgtatgatacttttaatgtgctgttaaatcagtttgctagtcttttgttgaggatttttacctgtatattcatcagagatagtgtcctctagttttcttttcttgtggaatcttcatctagctttattattagggtagtgctaggctcataaaatgagtttggaagtgtcgcctcttcacttttttggaaaagcttgaaaaggattggcattaactcttctttaagtgtctgtcagaagccaccagtgaagccagctggtcctggccttttctttgttgggaagtttttaattactgtttcaatctccttactaactacaggtctattcagattttctatttatacaggactcagtcttgccagattgtatgcttataggaatttatccattttttatgttatccaatttgttgatatgtgattcttcatagtagtcttatgatcctttctacttctttggcatcagttgtagtgtgtcatctttcatctctgatttcaattagttgattcttttctattttctcttagtctagctaaagatttgtcaattttgtttattttttcaaaaaaaaccctcttagttgcattaaaaaaatttgattctttatttggcttatttctgctctctcttcattatttccttcaaaactgaccaataaatcacatggttaatagaattattagctgatgacattaaaagttattataaatccatttcatatgttcaaaaagcttgaggaaaaactgaccaagtagaggcatggcagaaataaaaaagattcaaataaaaagtctatagatgaaaactattatgtctaagatcaaaaaatttcttagtttagaaaaagagggagaaaagattagtgaacttccagaaatagtaatagaaatcatcccaaacaaaatacatagggttaaagatttttaaaaataaacagtatcagcaaattgtgggacaacttcatttggttaaaaatacagataaccgtcatttaaaaacaaagaagaacattatgtaatgataaaacagtcaattcaccagaaatatgcaacaattataaatatatatacacccaatatcagaacactgaactatataaggaaacattgacaaactgatggtagaaatagacagaaagacaataatagtaagagacttcaataccccacttttaataatggatggaacagtcggacagaaaatcaataaaaaacagcaggcttaagaaacactacagaccaaatggaccttacagacatataaaacattaaacccaagagcaacagaatagatactcttcctaactgtacacagaacattctccaggatagaacacattaagacaattagcacatcttaacaaatgtaagaagatcaaaatcctaccaagtatcttttctgaccacagtgaaattcaacagtagaaggaaaactggaaaattcacaaatacccatcttaagggttatatttttcctgcttatttgtacatctggtaatagtaaagtgtgaatggatgccagaaatagtgaatttcatcttgttggttgctgcatgtatttgtattcctatacttagtatcagttttatccctataagtcttgctgttaagcatagttaagtggaaccaaagtagtgctttgtctagaagtcatttccccagtactaatgcaaaaccttctttgtattttaatgctttatgaattgtgaagttcttctaccttggctattggaaataggtccatgtgggctctgatcactgtcccctttgggtggttattttcctggccttatgtagttttcttatacacgtgtgctaatcaatatttaactgaataattggtggagttggatcctctgaaaattgagagagtcccctttttttcattaaaaaaaaattaaaacggtgctattgcaatagagttctctttctacataggtctacactctccaaaactcttttctgaaaaattttgataccttggcttccccagagtcatggctccatttttttcaattgaaggagactagcaggctctgactgagtttcccttccctgcagcctagaatatttatctaggcatgaagatatagccatcttagggctcatctaagcctttccatcttttggagatcactgaccttacttgcctgaagtccagtgacttaagtgctattttttcatataattttgtcagtttttttctgtttttagttatgcctgggagggtaaatcaggtccctgttactctatcttgactagaagtgaaagtcaaggttatttctcaaatatggtttcaaaagatcagattttgtcatttaagacacatattttacattcaaaaatgtaaagtcagggtgtgtcttaaaatccattggtgttttaatcatgcttaaacatgtgactgctgttggccaggatacagttgtggtggtgtcgtcagtatctgagcacatgtgaactttgccatgactattcatattgtcttctcttaaactgaattatgtccatggttgccaacatgtactgtccatagttgccaccatgtatttaggttgtcatttaaaatgtcctcaaaaagatttcaccatgattctccatcaaaatagaaagctattttgtatgaagaagaactcagaccagaaaagtctgataaaaataatctcttaaataagtctacattaggtctttcaatttgtataaaatgtaaattttgaattataagaaaacaatttgttatactgtaattggtagcattttttcttagtagtgtacaaaataatgtgtaccttacattcaaaggcatcctagattcaattaaataaaataactgattagccaggatattaataatgctaatctaagaaagtcctaaaataacagtgtttaaaacaagacagttttaattctccctcacattattgatctgggaacaaggtatttgtggtttgtggtggtgtttgatattggggacctaggctatttttatattgttgcttcactgtatacagggtttcgccctcatctatatgattcaagcccactgttgtgtacacattttatccaataggaaaatagcaatgggaatggttcttccatttatagtcacaatccagaagttgtagacatcatttctgcttccataaaattggccagaaagttgtcatatggtcacaaatagctgcaaaagggatggggtaatatagtccttatttcagacaacttcatgcccagctgaaaatcagagggtctattgctatagaaagaggggagaatgaatttggggagacaggaagtattgtgttgtttaagagagaaatgagatcagctcagggtatattctgctacaggtctccaattgggtgccacccccagtaccttcttaattctccatctttctgaatgcaaacacagatacaagagcccttatgcactgctggtaagagtatgaactgttatagccatcctgctgagcaaattggcactgcttaatcaaagtaagaatgcacattacctgggcccctgaaatccaactcctgggataaatcaccccccaccaccaccaaaaaaaaattactgagacaggtacaaggctattcacttaaatgttattttggaggtggggagattgaggcaaagtgggagtctgtccctggaagagtcaacagataaaatgtggttgatagccatatatagaagcaaggaattctggatattaacttgagattgctgtgtgaaaaccatattttggaaattggccaatataacaatttttatatacacatatatgtacatatatacacacacacaaatacacacacacacacatatacaggcatgtgccatataatgatgtttcagtgaacaatacaccacatataccatagtgtggtccctgaagattacaatggagctgaaaaactcctatcacctagtgacgtacccactgtaacatcatagtgcaatgtattactcacgtttgtgatgatactgcactgccagtcatataaaagtctagcatataaaattatctacagtacatgatacttgaaaatgataacaaatgactatgttactggtgtatgcatttactatactatactttttatcattattttagagtgtactcctcttacttattaaaaaaaaataactgtaaaacaggttcaggctggacttccaggaggtattccagaagaaggcattgttttcatattccttgaagactttccagtgggacaagatgtagagttgggagacagtgatattgacaatcctaaccctgtgtaggcctaggctaatatgtgtgtttctgtctttatttttatttttatttttttttatttttgaaacctggtctcactctctcacccgggctggagtgcaggggcatgatcatggctcattgaagccttgacatcccaggctcaaacaacccttccacctcagcctcccaagtagctaggaccacaggcatgcaccaccacacctggctaatttatatatttttttaatagagatagggtcttcctatgttgcctaggctggtctcaaactcctggcctcaagcgatcctcctgccttggcctcccaaaatgctggggttacagacttgagccactgtgcccagcctgtatctttatgtttaaccaaaaagtccaaaaagtaaaaataaataaataaatacaaacatagaaaaaacgcttatgaaataaggatataaagaaataaaatatttttgtacagctgtacagtatgtttttgtgtcaagctaagtattattgcaaaagagttgttaaaagaaaagcttcagccaaattaaatttaaaggaggttaattgagcaatgaatgattcatgaattgggcagcccttagaattacagcagatgcagagagactccagcacagccatgtagtggaagaagatttatagacaaaagggaagtgacatacagaaatcggaagtgaggtacagaaacaactggattggttacagctcagtgtttgcactatttgaacacagtttgaaccctcagcagtgtatgagtggttgaactatggctgctaggactggccaagactcagctattgttacaggcacatactcctaagttacgttttcaatcttgtctacctaataagttaggttatgctttgtcctcatggactcaaatgtagaagtacagtccttctcaggctatatttagttggctttaacaattcctcccttttggttactttctcaattttgagatgttgaccaaaactttagtcattgatgtcactatcaccattgtaaatgtacttatttggtcttgaaacccactggaaaacagtagaacagtgggttttacaaggtgggaacaaggacagagtagagggtacctccttatgctgtaacatcctgtttgcaggagaaaaacaaaatctggtctgttctaggatctatgtgtttccttaaagtcttagtttgattatgtcatatttagtatgagtgactccatgtttgtttggtttggtctgttagggcctaatgcaagagctcagtccaaaacaatggcctcccataattttgttttaaaactctacttttcgggtcaggttcttacttaggtgagggtgtgaccaaaacttagggccttagtgccactctgttaccatcattttgggtttctggtctcagcgtgtaattcataagttaccatgtgttcatggttgcatatttttttcagctcttgtcatcccagttgaagagagaccatttgatattctatagatggctgcatgcaaacatttaaaacttttgagagaatgcagcgcacaagggagactactattatgactattgggaggataacaccaacagtttgtagtatgctccttacccagggttcccataaatcaaaccacttaaaattaaatagattaaagaatgggctaaagagtctactcacttaactaagcagtctttccattaatcccctacaactgaatttttatattctacattttatgtatttctccataggcgacaagtgccagcagctgcacagatatttttccattgagccaatgctattatttagtataactttcacaagagaatttaaagtctgttgtgtagccatagcctttacagtaaaatctgctatagagcctatcatgagggatacatttttaatcattgcttcttttactccaaaccaaggaagaaagatctaacaaatgatgtcctctagaagagtaaaggcctcctcataatgttcactttaacccatgatgtgggttaagaggagtgaaccaatgttccctttctgactgattatgaggcaacgtgtgtaccgttaaagcttcttgtctacattgagccttcgtcttttatctgtcaaagtataaggttatccatgtataaggctggctgcaaaatccttcacaaataaaagtataccccataagtacacacaacagaccctcttttcacttctattcttcagaggcataagcaaggaaaaaaatagttagacaagaatctcatgatgctagagaagtcttgatctttgatcttgggaaaagctattcacatcagagatgccatcttcttctggggagaaacttcccaggttagctttactttaagggcttcactgggtgtacagttccaagagtgtggagggacccttctcagttgtgagattatgaacttaaaattcaaggtcctgaagttttgctgtagtgtggatggcaaatacagcctttctctgatgttctcagaagatccaatttttgggttctagattgtgaaggggttgattgtcctcagtcagtgatccataaaaactttctttacctggtgaaaataccctgtagcataataatctactgttataacagcaaccctcatacatgggaaaacttttatacaaccagaaaacatgcattgaaaatgacaactgaatgaaattcttatacaaaatgtttaaatggcccatcagctaaccaaatgcacctgaaggtttgattgttttcccaggaatatgggtgtgacaaaccaaatattgttcataaactattttaggaatttagaagacaccacattaatatataattaatttggatcattttgtcttttccatgatgagtcacagaatacagaacctttaataacaaaagctttaacgactcaggaaggacaaagtggctgtcctgcttctccatgagtccatgcttaattaacattagacttatgtcctcttgaataccagttatttctccaaattaggtacatagcactgataactggtgggttatcataggtaatttgacttagaccgtggagtttattcaaactgtatacctaaacaatttcagtattggctgattcagcattcaaatctggcagagtattttcttgttattccataactttctgttctacttgggttagtagttttataaaccagtccaccttttcattaaaatttcaggaattcttatccggtccaaatgatatgattttatagaaacctgtattgaagagtgattttcagggacctttcaatcctttcatgaacctcctaaaagacaccatattctaggattttgcatgcttgtgaaatttttcagaaacagcatcagcattaagcaactaactgtggaaatgacttcaaaggattatagttaaaaacacaattaaaaagaaaacttcattctttctgttgtctacaataacataataaccataataatgattaatagcaagcactcaaacatattagaaattttgaaatccaatacaatttttgagcatatatatatataattataaatatatataattatatatatatatataattatatatatatataattatatatatatatatatataattatactttaagttttagggtacatgtgtacaatgtgcaggtttgctacatatgtatacacgtgccacgtaggtgtgctgcacccattaactcgtcatttacattaggtatatctcctaatgctatatctccccaattcccccaaccccacaacaggccccggtgtatgatgttccccttcctgcgtccatgtgatctcattgttcaattcccacctatgagtgagaacatgcagtgtttggtttttcgtccttgcgatagtttgctgagaatgatggtttccagcttcatccatgtccctacaaaggacatgaactcatcattttttatggctgcatagtattccacggtgtatatatgccacattttcttaatccagtctatcattgttggacatttggcttggttccaagtctttgctattctgaacagtgccacaataaacatacgtgtgcatgtgtctttatagcagcgtgatttatagtcctttgggtatatacccagtaaggggatggctgggtcaagtggtatttctagttctagatccctgaggaatcgccacactgacttctgcaatggttgaactagtttacagtcccaccaacagtgtgaaagtgttcctatttctccacattctctccagcaccctttgttccctgactttttaatgatcgccattctggtgtgagatgctatctcattgtggttttgatttgcatttctctgatggccagtgatgatgagcactttttcatgtgacttatggctgcataaatgtcttcttttgagaagtgtctgttcatatccttcacccacttgttgaaggggttctttgttttttccttgtaaatttgtttcagttctttgcagattctggatattagccctttgtcagatgagtacattgcaaaaattttctcccattctgtaggttgcctgttcaatctgatggtagtttcctttgccgcccagaagctctttagtttacttagatcccatttgtcaatttcggcttttgttgccattgcttttggtgttttagacatgaagtccttgcccatgcctgtgtcctgaatggtattgcctaggttttcttctaaggtttttatggttttaggtctaacatttaggtctttaatccatcttgaattaatttttgtataaggtgtaaggaagggatccagtttcagctttctaatatggctagccagttttcccagcaccatttattaaatagggaatcctttccccattgcttgtttttgtcaggtttctcaaagatcagatagttgtagatatgtggcattatttctgagggttctgttctgttccattggtctatatctctgttttggtaccagtaccatgctgttttggttactgtagccttgtagtatagtttgaagtcaggtagcgtgatgcctccagctttgttcttttggcttagggttgacttggcaatgagggctcttttttggttccatatgaactttacagtagtttttttttccaattctgtgaagaaagtcattggtaacttgatggggatgacattgaatctataaattaccttgggcagtatggccattttcacgatattgattcttgctatccatgtgcatggaatgttcttccatttgtttgtatcctcctttatttcgttgagcagtggtttgtagttctccttgaagaggtccttcacatctcttgtaagttggattcctaggtattttattctctttgaagcaactgtgaaagggagttcactcatgatttggctctctgtttgtctgttattggtgtataagaatgcttgtgatttttgcacattggttttgtatcctaagactttgctgaagttgcttatcagcttgaggagattttgggctgacatgatggggtcaatattgtgaaaatggccatactgcccaaggtaatttatagattcaatgccatccccatcaagctaccaatgactttcttcacagaattggaagaaactacttgaaagttcatatggaaccaaaaaagagcctgcattgccaagtcaatcctaagccaaaagaacaaagctggaggcatcacactacctgacttcaaactatacttcaaggctacagtaaccaaaacagcatggtactggtaccaaaacagagatatagatcaatggaacagaacagagccctcagaaataacgccacatgtctacaactatctgatctttgacaaacctgagaaaaacaagcaatggggaaaggattccctatttaataaatggtgctgggaaaactggctagccatatgtagaaagctgaaactggatcccttccttataccttatacgaaaatcaattcaagatggattaaagacttaaacgttagacctaaaaccataaaaaccctagaagaaaacctaggcattaccattcaggacatacgaattggcaaggacttcatgtctaaaacaccaagagcaatggcaacaaaagccaaaattgacaaatgggatctaattaaactaaagagcttctgcacagcaaaagaaactaccatcagagtgagcaggcaacctacaaaatgggagaaaatttttgcaacctactcatctgacaaagggctaatatccagaatctacaatgaactcaaacaaatttacaagaaaaaacaaacaaccccatcaaaaaatgggcgaaggacatgaacagacacttctcaaaagaagacatttatgcagccaaaaaacgcatgaaaaaatgctcaccatcactggccatgagagaaatgcaaatcaaaaccaaattgagataccatctcacaccagttagaatggcaatcattaaaaagtcaggaaacaacaggtgctggagaggatgtggagaaataggaacacttttacactgttggtgggactgtaaactagttcaaccgttgtggaagtcagtgtggcgattcctcagggatctagaactagaaataccatttgacccagccatcccattactgggtatatacccaaaggagtataagtcatgctgctatacacatgcacacgtatgtttgttgtggcactattcacaatagcagacttggaaccaagccaaatgtccaacaatgacagactggattaagaaaatgtggcacatatataccgtggaatactatgcagccataaaaaatgatgagttcatttcctttgtagggacatggatgaaattggaaatcatcattctcagtaaactatcgcaaggacaaaaaaccaaacaccgcatgttctcactcataggtgggaattgaacaatgagaacacatggacacaggaaggggaacatcacactctggggactgttgtggggtggggagagtggggagctatggcattaggagatatacctaatgctaaatgacgagttaatgggtgcagcacaccagcatggcaaatgtatacatatgtaactaacctgcacattgtggacatgtactctaaaccttaaagtataataataataataatcaaaaataaaaaagaatccagagccatcagtgtgctgtattcaggaaacccatctcacatgtggagacacacataggcttaaaataaagggatggaggaagatctaccaagcaaatggaaaacaaaaaaggtggggattgcaatcctagtctctgataaaacagactttaaaccaaccaagatcaaaagagacaaagaaggtcatttcataatggtaaagggatcaattcaacaagaagagctaactatcctaaatatatatgcacccaatacaggagcacccagattcataaagcaagtccttagagacctagaaagagacttagactcccacacaataataatgggagactttaacatcccactgtcaacatgagacagatcaacgagacagaaagttaaaaaggatatccaggaattgaactcatctctgcaccgagcagacctaatagacatctacagaattctccaccccaagtcaacagaatatacattcttctcagcaccacaccgcacttattccaaaattgaccacatagttggaagtaaagcagtcctacacaaatgtaaaagaacagaaattataacaaactgtctctcagaccacggtgcaatcaaactagaactcaggattaagaaactcactcaaaaccgctcaactacatggaaactgaacaacctgctcctgaatgactgctaagtacataacgaaatgaaggcagaaataaagatgttctttgaaaccaacgtgaacaaagatacaacataccagaacctctgggacacatttaaagcagtgtgtagagggaaatttatatcactaaatgcccacaagagaaagtaggaaagatctaaaattgacaccctaacatcacaattaaaagaactagagaagcaaaagcaaacacattcaaaagctagcagaaggcaagaaataactaagatcagagcagaactgaaggagatagagacacaaaaaacccttcaaaaaatcagtgaatccaggagctggttttttgaaaagtacaacaaaattgatggaccgatagcaagactaataaagaagaaaagagagtagaatcaaatggatgccataaaaaatgataaaggggatatcaccaccaatcccacagaaatacaaactaccatcagagaatactaggaacatatattaatatcattcactaaaatataacctgaggaaagttaatttttttgacagtgcttcccgtgtaacttgctatgtcaaataattctgtttacctttcctctgggtgcttaagggtccctctggagcattccaagttagaggtcgcataatataattttgaagctgcaatttgattttgggaaggccatcaaatatggtaaagttttaaaacagtttgatatgatgaaatggaattctaggtactgtaagtcattcatttagccaaaatgatgactcaaaaaatttaagaaggcaaaaactgttagtcattgataggcagaaaccttagctttccaaacagtctgtctcttgtctttcccttcttttttggtagtttattcaaaaggcaaagaaaaatcttttattgtcctttactattgcatgaaaatcttgttcaagagagaaagcaaaatttcaccctggcattagtgtaccatgaatgttaaccctaattcttaagaaatcttatagacaaattgattcaatcttaatcatttggaccataaggtgagattcccataaaccttttattaccctttacaaatttttgttgaagagcagattagtgctctaagaaaaccctgttgtgcttttatttcaatgttcaagttatggaaaaaataataatacctctttaaatttagtcaatatgtttacagacaaaatttgttttacaatattaatttttacgaaccttttacaacttggtgaaacgtttacctttatcttatgtaatttaaaacaatcatttagccctttaatctaggcaaacatttacattcccatgccttcttataatattttaccaaaaatactttttattgtcttcacacaccttgcatataaaacttttttcagtagtctcaaatacatgttataatggtaactctccagaattttaatttttggtagaaaacctggcaagtaagtaattttaattatgtagtaggtttgtatccaaggaaatcagacagaagtacagataaggtgtgactctttcatcatttctgttagacttcactgcttcccaggttaacatttatgcatgtgttagccagaggaactcagttcttcagaaattaaaaattaaatttgtacctaaaatattggctttgctctcagattcccctgatgaacttagccaatgatttttcctacctaagtgtgcacaaaaaaaaatgtgaaacaaaggggtagaacgtaaaaatcctcatgaatatccagaagccaattttttttcaatttctacaatattgccatttactgccagtttttttctgacccagtcaggtgtaagagccctctaactggatccaagccagttaatcactggaacgaatccaatcctggaccaagtccggtttctatagtgacttataaaccaagtttggatgagaaattcgcccaaagaaactcaaagagctcaaaacacaaatccatgaagctccaaaacccaaaagagaacttaaccaagatctctagctcctctgatagatcaaacgacacaattgggtccttgcagttaccttgcttgttcactcagtgctcctgggggtcgttaaaagttctacttcagatgccacttctgacatcatctgttaaaagaaaaaaatcagccaaattaaatgtaaaggagtttaactgagcaatgaacaattcatgaatcagacagccatcagaatcacagcagattcagggaggccagcacagccacttcatggaagaagatttataaacaaaaaaaaaaaaaagagaagtgacatacacaaattggaagtgaggtacagaaacaactggattggtcacagctcagtgtttgcattattcacagtttgaacactcagcagcgtatcagtggttgaagtatggtttctgggattagccaaggctcagctattgttacagacacatactcctaaattaggttttcagtcttgtctacgtattaaattaggttgtggttcatccacaaggactcaaatatagaagtgcagagtctttctcagccatatttagtttgcttaacagagtaaaaatgtttttaaaaagtttaaagtttataaagtaaaagcattacaataacctaattttaatttattatggaagaaagacatttttaaagataaatttagtttagcctaggtatacagtctaactatagctggagtcttcaacatacctctatcaacatttgataaaacaagccagaaatcatcaaggatatagaaccatcaccatcaaccagcagaatctcattgacatttatagaacacttcacccagcagcaggatacacattctttgcaagtgctcatggaacatataccaaaatagatagaccatttcctgggatataaaataatccccaacaaatttaaaagaacagaaatacagaaatgtgttgtgtgacattaataaaatcaaactaaaaaccagtaaaccagaaaaaattaccagaaaaatctacacacgcttggacactaaacaacatatatctgaatgatgtgtatttcatagagagtctcaagaaaaataaaaatacactaaactgagtgagctgaaaaatatcaaaaattgtgagatgcagtaaaagcagtaatgaaaaaaattaacagcactaaatgcttacattataacagaagagatgccttaaaacaataatctaagctcccacttcaagaaactcgaggaagaagagaaaaataagatgaaggcaagcaaaaaacagaaactaataaaggtaagaacagaaatcaatgaaattgagactagaaaacaacaaagaaatgaatgaaacatttatatatttaaaacaacatatacacatttcatgcacattacctgtgctgtgaaatcccactcctgagatgaatccctggttgttttaagaatctatctatctatttatctatccaaacatatatatttcatatatataaaacaaccagggtttatccccagtgaaatttatatttaaatagacgtgtgtgtgtgtgtgtgtgtgtgtgtgtgtgtgcacgcatttaaaacaaccaaggggtttttccaagatggctgaataggaacagctctgatctgcagttcccagcaagaccaaagcaggaggtgggtgactgctgcatttccaactgaggtacccggttcctctcgttgggactggttagacagcgggtgcagcccacagagggcgagcagaatcagggtggggtgtcaccttacccaggaagtgcaaaggaccagggacctccctgttctagccaagggaagctgtgaggctgtgctatctgccccagatactacgcttttcttatggtttttgcaacctgcagactaggagattccctcatggacctgtaccaccagggccctgggattcaagcacaaaactgggtggctgtttgggtagacactgagctagctggaggaggttttttttgttttgttttgttttggttttggttttttttcccacacgccaggggcacctggaacccaagcgagagagaactgttcactcctctggaaaggcggtggaagccagaaagccaagtgatctcgcttagcaggtcccacccccacagagcccagcaagctaagatccaccagcttgaaattctcactcccagcacagcagtctgaagttgacctgggatgctcgagcttggtggggggaggggcttccaccattactgagacttgagtaggtggttttccccacacagtgtaaacaaagccaccaggaagttctgacttagcggaaaccatcatagcacagcaaagcagctgtggccagactgcctctctagattcctcctccctgggcagggcgtctcgggaaaaaaggcagcagtcccagttaggggctcatagatggaactcccatccctgggacagaacacctgggagaaggggtggctgtgggggcagcttcagcagacttaaatgttcctgcctgccagctctgaagagagcagaggatctcccatcagagtgctagagctatgctaagggatggactgccttgtcaagtgggtccctgacgcctatgcctcctgactgggagacacctcccagcaggagtcaacagacaccgcatacaggagaggtcagggtggcatctggcaggtgcccctctgggatgaagtttccagaggaaggagtaggtggcaatctttgctcttctgcagcctccactggtgatacccaggctaataggatctggagtggaccaccagcaaactccagcagactgcagaagaggggactcactgttagaaggaaaactaacaaacacaaagcaataacatcaacatcgacataaaggatgcccacacaaaaaccccatttaaaggtcattaaagtcaaagatcaaagttaaataaatacacgaagatgaggaaaaaccagtgcaaaaaagatgaaaattccaaaagctacaatgccacctctcctacaaaggatcacaactcctcgccagcaagggcacgaaactggatggagcaagagtttgacgaaatgacagaagtaggcttcagaaggtgggtaataacaaacttctctgagctaaaggagcatgttctaacccaatgcaaggaagctaagaaattttataaaagttgacaagaactgctaactagaataaccagtttagaggaaaacataaattacctgatggagctgaaaacacagcacgagaacttcatgaagcatgcgcaagaatcaatagccaaatcaatgaagcagaagaaaagatattagagattgaagaccaactttaagaaataaagcatgaagacaagattagagaaaaaaaatgaaaaggagcgaacaaagcctccaagaaatatgggactatgtgaaaagactaaatctatgattgactggtgtacctaaaagtgatggggagaatggaaccaagttggaaaacactcttcaggatattatccagaagaacttccccaacttagcaagacaggccaacattcaaattcagaaagtgcagagagcaccactaagatactcctcaagaagagcaaccctaagacacataagcgtcagattcaccaaggttgaaacaaaggaaaaaatgttaaaggcagacagagaaaaaggtcaggttaccaacaaaagaagcccatcagactaacagtggatctctctgcagaaaccctagaagcaagaagagagtgggggtcaatattcaacattcttaaagaaaaaaaattttgagattgagaccatcctggctaacatggtgaaaccccgtctctactaaaaaaatacaaaacaattagccaggcatggtggcaggcacctgtagtcccagctactcgggaggctgaggcaggagaatggcatgaacctgagaggcagcgcttgcagtgagctgagatcacgccactgcactccagcctgggcaacagagcgagactccatctcaaaaaaaaaaaaaaaaagaaaaaagaaaaaaattttaacccagaatttcatatccagctaaaataagcttcacaagcaaaggagaaagaaaatcctttacagacaagcaaatgctgagggattttgtcaccaccaggcctaccattcaagagctcctgaaggaagcaataaatatggaagggaaaaactggtaccagccactgcaaaaacgtaccaaaatacaaaaaccaatgacactaggaagaaactgcatcaactattgtgcaacaaaccagctagcatcatgattacaggatcagattcactcataacaatattaaccttaaatgtaaacaggctaaattccccaattaaaagacagagactggcaaattggataaaaaagactcaagacccatcactgttctgtattaaggagacccatctcatgtgcaaagatacacatgcgctcaaaataaagggatggatgaatatttaccaagcaaatggaaagcaaaaaaaaagcaggggctgcaatcctagtttctgataaaacagaccttaaacaacaaagatcaagaaagacgaaggatattacatgatggaaaagggatcaatgcaacaagaagagctacctatcctaaatatatatgcacccaatacaggagcaccaagattcataaagcaagttcttagagagctacaaagagactaagacttccacacaataatcatgggaaattttaacaccccactctcaatgttagacatatcaatgagatggaaaaaaatacaaggatattcaggacttgaactcagctctagcccaagcggacctaatagacatctacagaactcttcactccagatcaacagaatatacattcttctcagcaccacatagcactttttctaaaatcaaccacataaaggaagtaaaacactcagcaaatacaacagaacagacataataacaaacagtctgtctgaccacagtgtgatcaaattagaactcaggattaagaaactcattcaaaaccatacaacttcaaaagaagacatttatgcagccaacaaacatgaaaaaaagctcatcatcactggtcattagagaaatgcatatcaaaaccacaatgagataccatctcacaccacttagaatggtgatcattaaaaagtcaggaaacaaaagacgcagtagaggatgtggagaaataggaacacttttacactgttggtgggagtgtaaattagttcaacccttgtgaaagacagtgtggtgattattcaaggatctaattagaaataccatctgacccagcaatcccattactgggtatatacccaaaggattctaaatcattgtactataaagacacatgcacatgtttgcttattgcagcagtattcacaagagcaaaaacttggaaccaatgcaaatgcccatcaatgatagactggataatgaaaatgtggcattatacaccatggaatactatgcaaccagaaaaaagaaggagttcatgtcccttgcatagacattgatgaagctgaaaaccatcattctcagcaaactaacacaggaacagaaaaccaaacaccacatattctcactcataagtgggagttgaacaatgagaacatacaggcacaaggagggaaacatcacacaccaggacctgttggggggtgggggggcaaggggagagatagcatttggagaaatatgtaatgtagatgacaggttgatgggtgcagcaaaccaccttggcacaaacctgcacattctgcacatgtatcccagaaattaaagtataataaaaaaatcaatgaatctaggagctggttttgggaaagattaacaaaatagacggctagccagactaataaaaaagaaaagagaagaatcaaatagacacaataagtagtgataaaggggatatcaacactgaccccatggaaataaaaactaccatcagagaatactaaaaacacctttatgcaaataaactagaaaaatctagaagaaatggataaatttctggacacaaacacactcccaagactaaactagagggaagttgaatccctaattacaccaataacaacttctgaaaatgaggcaataattaatagcctaccaaccaaaaaaaagtccagggccaggcggattcacagccaaattctatcaaaggtaaaaagaggagatggtacaatttcttctgaaactattccaaacagtagaaaaagagggactcctccctaactcattttatgaggccagcattattctgataccaaatcctggcagagacacaacagcaacaacaataacaaagaaaatttcaggccaatattgctgattaacatcaatgagaaatactggcaaaccgaatccagcagcacatcaaaaagctcattcaccatgatcaggttggtttcatccctgggatgcaaggctagttcaacatatgcaaatcaataaacgtaatccatcacataaacagaaacaatgacaaaaacctcatgattatttcaatagatgcagaaaagacattcgataaaattcaacacctcttcatgctaaaaacattccataaactaggtattgatggaacatatctcaaaataataagagctatttatgacaaacccatagccaatatcatactgaatgggcaaaagctggaagcattccctttgaaattcagcaaaagacaagaatgacctctctcaccactcctagtcaacatagtattggaagttctggccagggcaatcaggcaagagaaggaaataatggtattcaaataggaagagaggaagtcaaattgtctctgtttgcaaatgacatgatggtatattcagaaaaccccattgtctcagcccaaagctccttaagctcataagcaactttagcaaagtctcaggatagaaaatcaatgtgcaaaaatcacaagcattcctatacaccaataatagacacacagagagccaaatcatgagtgaactcccattcacaattgctattaagagaataaaatacctaggaatacaacttacaaaggatgtgaaggactgcttcaaggagaactacaaaccactgctcaaggaaataaggacacaaacaaatggaaaaacattccatgctcatggataggaagaatcaatatcgtgaaaatgaccatactgcccaaagtaattcatagattcaatgctattcccatcaagctaccattgaatttattcacagaattaggaaaaagtactttaaatttcatgtggaaccaaaaaagagcccgtatagcaaagacagtcctaagcaaaaagaacaaagctggggatatcacgctacctgacttcaaattatactacaaggctatggtaaccaaaacaccatggtactggtaccaaaacagatatatagaccaacggaacagaacagaggcctcagaaataacaccacacatctacaaccatctgatctttcaccagtctgacaaaaacaagcaatggggaaaggattccccatttaatatgtagtgttgggaaaacaggctagccatatgcagaaaactgaaactggaccccttccttacaccttatacaaaaattaactcaggatgaattaaagacttaaatgtaagacctaaaatcataaaaaagaaaacccaggcagtaccattcaggacataggcatgggcaaagacttcatgactggaacaccaaaagcaattgcaatgaaagcaaaattgacaaatgggatctcattaaactaaagagcttctgcacagcaaaagaaactatcatcagagtgaacaggcaacctacagaatgggagaaaatttttacaatctatccatctgacaaaggtctaatatccagatcctacaaggatcttaaacaagtttactagaaaaaaccaaccccattaaaaagtgggtgaaggttatgaacagacaattctcagaagaagacatttatgtggccaacaaacatatgaagaaaagctcgtcatcactggtcattagagaaatgcaaatcaaaaccaaaatgtgatagtatctcatggcagttagaatggtgatcattaaaacgtcaggaaacaacagaagctggagaggatgtggagaaataaggaagcttttataataattgcaaaaattttctcccattctttaggttgcctgttcccactgataatagtttcttttgctgtgcagaagctctttagtttagttagatcccttttgtcaatttttgcttttggtgccattatttttggtgttttggacatgaagtctgtgcccattactatgtcctgaatggtattgcctaggttttcttctaggatttttatgattttaggtgttatgtttaagtctttcatccatcttgagtaaatctttgtataaggtgtaagtaaggggtcgagtttcagttttctgcatctggctagccagttttgccaacaccatttattaaatagggaatcctttccccattgcttgtttgtgtcaggttggtcaaagatcagatggttgtagatgtgtggtgttatttccgaggcctctgttctgttctatgtatctgttttggtaccagtagcatgcagtttcggtttctgtaaccttgtagtatagtttgaagtcaggtatcgtaacacctccagctttgttctttttgcttaggagtgtcttggctatgtgggctcttttttggttccatatgaagttaaaagtagtttttttccaattctgtgaataaagtcaatggtatcttgatggggatagcattgaatctataaattactttgggcagtatggcaatttttacgatactgattcttcctatccataagcatggaatgtttttccatttgtttgtgtcctctcttatttccttgagcagtggtttgaagttctccttgaagataaccttcacatcccttgaaagttgtattcctaggtattttattctcttagtagcaatggtgaatgggagttcactcatgatttggctctctatgtgtctattattggtgtataggaatgcttgtgatttttgcacattgattttgtatcctgagactttgctgaaattgcttatcagcttaaggagattttgagatgagacaatgaggttttctaaatatatgatcatgtcatctgcaaatagagacaatttgacttcctctctttctatttgaataccctttatttctttcatttgcctgattgtcgtggccagaaattccaatactatgtggaatagaagtggtgagagagggcatccatgtcttgtgccagttttcaaagcaaatgcttccagctgttgcccattaagtatgatattcgctgtaggtttgtcataaataggtcttattattttgagatacatttcattgatacctggtttattgagagtttttagcataaaggggtgttgaattatgtcacaggccttttctgcatctagtgagataatcatgtgacttttttgtcattggttatgtttatgtgatggattgcatttattgatttgcatatgttgaactaactttgcatcccaggtatggagccaacttgatcgtagtggataagctttttaatgtgctgctggattcagtttgccagtattttattgaggattttcacatcgatgttcatcagggatattggcctgaaatttcccttttttgttgtgtctctgccaggttttggtacccggatgatggtggcctcataaaacaagttagagagtattccctctttttctgttgtttggaatagtttcagaaggaatggtataagctgctctttgtacctctggtagaattcggctgtgaatccgtctggtcctggactttttttggttggtagtctgttaattactgcctcaatttcagaacttgttattagtctattcagagattcgacttcttcctggtttagacttgagggggtgtatttgtccaggaatttctccatttcttctagattttctagtttatttgcatagaggtgttcatagtattctctgatgatagtttgtatttctgtgggatcagtagtgatatgccctatgtcgttttttactgtgtctatttgattcttctgtcttttcttctttattagtctggctagcagactatctattttgatgacttttttcaaaaaccagctcttgaattcattgatttttttgaaggttttttcatgtctctagctccttcagttctgttctgatcttagttaattcttgtcttctgcgagcttttgaatttgtttgctcttgcttctctagttcttttcattgtgatgttagggtgtcaattttagatcttttctgctttctcttgtggggatttagtggtataaatgcccctctacacactgctttaattgtgtcccagagatcctggtacgttgtatctctgttctcattggtttcgaagaacatctttatttctgccttcatttcattaattacctagttgtcattcaggagcagattgttcagtttgcatgtagttgtgtggttttgagtgaatttcttaattctgagttctaatttaattgcactgtggtctgagagactgttatgattttcattgttttgcatttgctgaggagtgttttacttctaattatgtggtaaattttagaataagtgcaatgagttgctgagaagaatatatattcttttggtttggagtggagagttctgtagatatctattaggtcagcttggtctagagctgagttcaagtcctgaatattcttgttaattctctttttcgttgatctgtctaatattgacagtggggtgttaaagtctcccactattattgtgtgggagtctgtgtttctttgcaggtctctaagaacttgctttatgaatctgggtgttcctgtattgggtgcatatatatttagaatagttagctcctcttgttgcattgatccctctaacattatgtaatgcccttctttgtctcttttgaccaacaaacacaaccaacaggttagtttcaagtctgctttaccagagattaggattgcaaccccagcttttttttttttctttccatttgcttggtaaatattactctgtctctttattttgagcctatgtgtgtctttgcatgtgagatgggtcccctgaatacagcacactgatggatcttgactctttatccattttgccagtctgtgtcttttaactggggcatttagctcgtttacatttaaggttaatattgttatgtgtgaatatgattctgtcaatttgatgctagctggttattttgcccatttgttgcagtttcttcatagtgtcaatggtctttacaatttgttgtttttgcagtgactggtacctgttgtttctttctatgtttagtgcttccttcaggaggtcttgtaaggcaggcctggtggtgacagaatctctcagcatttgcttgtctgtaaaggattttttttctccttcacttatgaagcttagtttgggtggatatgaaattctgggtttaaaattcttttctttaaaaatgttgaatactggcccccactctcttctggcttctagggtttctgcagagagatctgctgttagtctgatgggcttccctttgtgggtaacccgacctttctctctggcttcccttaacattttttcctttgtttcaaccttggtgaatctgatgattatatgtcttggggttgctcttctcaaggagtatctttgaggtgttctctgtatttcccgaatttgaatgttggtctgtgttgctaggctagtgaagttctcctggataatatcctgaagagtgttttccctgttggttccattctacccatcactttcaggtacaccaatgaaacgtaggtttggtcttttcacatagtcccatatttcttggaggctttgtttgttcctctttattcttttttctctaatcttgtcttcacgctttatttcattaatttgatcttcaatctctgatatactttcttctgcttggtcgattccactattgattcttgtgtatgcttcacgaagttcttgtgccatggtttttatccccatcaggtcatttatgttcttctctaaactggttattctagttagcaattcctctaacctttttcaatgttcttagcttccttgcattgtgttagaacatgctcctttagctcagaggagtttgttattacccaccttccgaagcctaattctgtctgttcatcaaactcattctccatctggttttgttcccttgctgatgaggagttgtgatcctttagaggagaagaggcattctggttttcatctttgtagatttatttacctttggtttttatgttagtgaccttagaatggggtctctgagtggatgtgttattcctttatgtttgttagttttccttctaacagtcgggcccctctgctgcaggtctgctggaatttgctggaggtccactccagaccctgtttgcctgggtatcaccagcggaggctgaagaacggcaacgattgctgcctgttctttcctctggaagttttctcccagaggggcacctgccagatgccagccagagctctcctgtatgaggagtctgttggcccctactgagaggtatctcccactcaggaaacatgggggtcagggactcacttgaggaggcaatctgtcccttagcagagcttgaatgctgtgctgggaggtccactgctctcttcagagctgtcacacagtgacctttaagtctgccgaagctgtgtccaccactgccccttcccactggtgctctgtcccagggagataggggttttatctataagtccctgactggggctcctgcctttttttcagagatgccctgcccagagaggagaaatctggcagtctggccacagcaaacttgctgagctgccatgggctctacccattttgaacttccctgaggcttctttacactgtgaggggaaaactgcctactcaagcctcagaaatggcggacgcccctcctcccaccaaactcgagtgtcccagtcggtatcagactgctgctgtgctggcagagagaatttcaagccagtggatcttagtttgctgggatccatggggttggaacccactgagcaagactacttggctccctggcttcagccgctttccaggggagtgaacatttttttctcgctggcccttaaggtatgggggaaaaaaaaaaaaccctgcagctagttcagcgtctgcccaaagggccgcccagttttgtgctggaaacccagggtcctggtggtgtaggcaccgaaggggatctcctggtctgcgggttgtgaagactgtgggaaaagcacagtatttgagttatagtgcacaatgcagtccctaatggcttcccttggctgggagatggagttccccgaccccttgcacttcccagttgaggcgatgccccaccttgctttggctcgtccttcttggtctgcacccactgtccaaccagtcccaatgagatgaactgtgtacctcagttggaaatgcagaaatcacccaccttctgttttgatctcactgtgagctgcagacagagctgttcctatttggccatcttgccagcaatcaagacacaaattttctgatatcaggaatgaaatagaggatattgctgcagaccccacaggcatcaaaagaataataactatgaacaactgtgtacgtgtaaattggacaaattgcatgaaatggaccagtttatccaaacactaccacagttcacccacaatatattagagaatttgaataaccctatgtcactatttaggaaattgaatttgtaatttaacagtttccaaaaattgaatcttcaggcccagatgttacaatggagtaaaaatgttaaaaattttggagaatattccacatgtttaaggagaatcttccagtcactgcaatctgtttctcaggaagccacagtcctagcagaagggaccacaacaaggtaacaccctgtgggacaaaagaatctgaatagcaggtcttctctcccaggtctctctgctgataggatcagaggtgtccatctgacctgaatagccagaacactgggacaaggttgaggctgtgagttggatagctttcctgcttgcctggcaggggaattgaggtagcttccactcttcacccttataaaacctcagcacatctcattgagagctcctccaacacccttatcaagtctggggtcttagcctaccattatgtatgacatctcacctgccttagctacaactggtgcctatacaggaatatgtttcctcttgacctgaagcctgaatcatcaactcagcaagtataaaaatgggggaaaattaaataaacaaataaagtgtacaccatgagagaaggaaataagctttaagagatccctgccattctgaccccataagaaacagtgaacttgcccacacaccaagaacttaactactaaaaccatcatctgggaaagccagttggaaaagattctctataaataaggaactcatacagagttttcatcctaaaatcaccaagaatcaaactaggctaaaataaacattggcgtatgatccttaagaaagaaaaaaagaagttaaaaaaaaccacagtccaataaaaaataaattcaagaacaatttgattagtctacccaaatgagaaggaagcaggaaagtaattctggtaatatgacaagacagggttctaaatcatcctgaaaagatcctactagctccccagcattggatccaaaccaagaagaaatctctgaagtgccagataaagaattcataaggttgattagtaagctactcaagaagacaacagagaaaggtgaaaaccaacttaaattttaaaaaatcaggatataattaaaattttttcagaggaatagatatcataaaggaaaaaacaatgagagctactggaaatgaaagacacacttagggaaatacaaaatacagtggaaaattttaacaataagctagaacaagtagaagaaagaatttcagagcttgaagacaagactttcgaaataacccaaacagacaaatacaaataaaaaagaatgaaataaatgaacaaagtctccaaggaatatgggattatgtaaaatgaccaaacctaagaataagtggtgattctaagaaagaacagaaatctaaaagtttggaaaacttatttgagggaataattgaggaaaacttccctggccttgctagaggtctagacatccaaactgaagaagtcaaaagaactcctgggaaattcattccaaaacaatcatcattaaggcacagggtcaccaggttatctaaagtcaagattaaaaaaaacataattttaagagctgtgagataaaagataacctataaagcaaaacctatcagattaacagcagatttctcagcagaagctttacaagtcagaagggattggagtcttacctttcacctcctgaaacaaaataatgtcaccctaaaattttctatctagcaaaactaagcttcataaatgaaaggaagataaagtcttcttcaaaaacaaatcctgacagaatttgccacccccaaacaagcactacaataaatgctaaaaggagttctaaatgttgaaagaaaaccttgatatacaccaaaatataaccttcttaaagcataaatctcacagggcctataaaacagtaacacaatgaaaaaaatccaaaacatataggcaacaactacatgataagtacaacagtacctcacatttcaatactaacatcgaatgtaaatgggcctcaacgctacacttaaaagatacataatagcagaatgaattaaataaaccaccaaccaagtatgtgttgttttcaagagactcacctaatgcataaggactcatgtaagcttaaggtaaaggggtggtaaaaaatattccacacaaatggaaaccaaaagcaagcaggagtagctattcttatatcagacaaaacagactttaaagcaacaacagtttaaaaaaaaaagacaagcaaggacattgtataatgataaaaggattagtccaacaggaaaatatcaccatcctaaattatatgcacctaacactggagcacctaaatttataaaacaattggtactagacataagaaatgagataaacaacaacacaataatattggaggacttcaatactatacttacagcactagacagatcatcaagacagaaagtcaacaaagaaacagtggacttaaactataccctagaacaaacagaattaacatatatttacaaaacattatttccaacaactacagaatatgcattctttttttcagtgtatggaacattctccaagatagaccatatcataggtcacacaacaagtttctataaatttaagaaaatcaaaattatatcaagcattttctcagaccacaggggaataaaattggaaatcaacttcaaaaagaaccctcaaaactatagaaatacatggaaagtaagtaatctgctcttgaatgagctttgggtcaacaatgaaatcaagatagaaatttaaaaattatttgaaatgaatgataatagttacacagcttacaaaaacctgtgggatacagcaaaagtggtgctaagacaaaagttcatggtgttaaatgcatcaatcaaaaagtctgaaagagcacaaatggacaacccaatgtcacacctcaaggaacaagggaaacaagaacaaactaaactcaaacccagcagaagaaaagaaataacaagatcagagcaaaactcaatgaaactggaacaaacaaaaacaatgcaaaagataaatgaaacaaaaagctgattctctgaaaagataagcaaaattgatagactgttagtgagattaaccaagaaaagatccaaatgaactcaatcagaaatgagactggagatattacaactgataccatggaaatacaaaagataattgaagtgtactatgaacaccttttcacacacaaactagaatgtgtagaggatgtggacaagttcctggaaatatacaagcctcctagattaaatcaggaagaaacagaaaccctgaacagaccaataacaaaaagcaagattgaaactgtaattttaaaattgccaacaaaataagttcagaaccaggtggattcacagctgaattctatcagacattcaaataagaattggtaccaatcctactgaaaccattccaaaagacagtaaaagaagaaatcctcattaaatcattctatgaagccagtgtcaccccaatacccaaaccaagaaagaacacaaccaaaaacgctacagaccaataccctgatgaacatagattcaaaaatcctcagcaaaatactagctacccaaatccaacagcatattaaaaagataatacaccatgatcaagtcagttttatcatagggatgcaggtatagtttaacatacacaagtcaataaatgtgatacatcacataaacagaatcaaaataaaaaatcatatgattagctcaatagatgcagaaaaagcatctgataaaattatcccttttttataaaaacactcacaaaaactggcatagaagagacatacctcaagataataaaagccatctatgacatacccacaggcaacattatactgaatggggaaaaattgaaaacattccccgtgagaactggaacaagacaaggatgcctattgtcaccacttctattgaacatagtactggaagtcatagccagtgtaatcagacaagagaaagaagtaaagagcatccaaattggaaaagtggaagtcaaaatgtcactgtttgccaatgatatgatcatatgcctagaataccctaaagaataatccaaaagctccttggcctgataaacgaattcagtaaagtctcaggatacaacatcaatgtacacaaatcagtagcactgctatataccaacaatgactaagctgagaattaaatcaagaagtcaacccattttacaacagccgcaaaaataataataataagatatttagaaataaccaaggaggtgaaagatatctgcaaggaaaactacaaaacactcctaaaaaagatcatagatgacacaaacaaatggcaacatattccatgctcatggaggggtagaatcaatagtatgaaaatgaccatactgcccaaagtaatccacagattcaatgcaattctaatcaaaataccatcatcattctttacagaacaagaaaaaagcaatctaaaattcatatggaaccaaaagagagcccacatggctaaagcaagactaagaaaaaggaacaaatctggaagcatcacatttcccgacatcaaattatactacaaagctataagctaccaaaacagcatggtaatggtataaaaataggcatgaagaccaatgaaagacaatagaaaacccagaaataaggccaaatacttacggccttctgtaagtattgacaaagcatacaaaaacataaagtggggaaaggacaccctattcaataaatggtgctgggaaaactggcaagccacatgtagaagaatgaaactagatcctcacctctcaccttatacaaaaattaactcaaaatggatcaaatacttaaatctaagaactgaaactataaaaatactagaaggtagcattgggaaacttttctggacattggcttaggcaaagaattcatgactaagactccaaaatcaaacgcaactaaaacaaaaataaataaatgggacctaattaaactaaaaatcttctgtacagtgaaattatcagcagagtaaacagacagcctatagagtgggggaaaatatttgcaaactatgcatctgacaaaggactaatacccagaatctacaaggaactcaaacaaataagcaaaaacaacaaaaaaaatcccatcaaaaagtgggcaaaggggcaggtgcagtgactcacgcctgtagtcccacaactttgggagtccaaggaaggcagatcactggaggccaggagtttgagactagcctggccagtatggcgaaatcctgcctctactaaaaagaaaacacaaaaattagctggcacggtggcttatgcttgtggtcccaggtatttgggaggctgaggcatgagaattgcttgagcctgagaggtggaggttgcagtgagccgagatcatgtcactgtacctcagcctgggtgacagagtgagactgtgcttcaaaaaaaaaaaaaagaaggagaaagagaagaaaagaaggagaagaaggagaaggaggaggaggagaaggaggaggaggaagagaagaagaagaaggagaagaagaaggagaagaaaaagaagaagaagagaagaagaaaagaagaagaaaagaagaagaaggagaaggagaagaagaagaggaggaggagggggaggaggaggagaagaagaagaggaggaggaagaagaagaagaagaagaagaagaagaagaagaagaagaagaagaagaaggagaaagcaggcaaaggacatgaataggaaattctcaaaagaagatatagaaatggctaataatcatatgaaaaacccgcttaacatcactatactatactacaagtctgcagtaaccaaaacagcatggtactagtaccaaaacagatatatagaccaatggaacagaacagagtccttggatttaatgccacaaatctacaaccatctgatctttgacaaacctgacaaaaacaagtgatgtggaaaggattccctatttaataaatggtgttgggaaaactggctagccataagcagaaaaattaaacaggacaccttctttacaccttatacaaaaattaactcaagattgattacagacttaaatgtaagacctaaaaccataaaattcctagaagaaaacctaggcaataccattcaggacataggcatgggcaaagacttcatgactaaaacaccaaaagaaatggcaacaaaagccaaaattgacaaatgggatgtaattaaactaaagagcttctgcatagcgaaaaaaactatcatcagagtgaacaggcaaactacagaaaaaatttttgcaatctatccatctgacaaaagtctaatatccagaatctacaaggaacttaaacaaatttacaagaataaaagaaagaaccccatcaaaaagtgggtgaaggatatgaacagacacttctcaaaagaagacacttaagtggccgtcaaacatatgaaaaaagctcatcatcactggtcattagagaaatccaaatcgaaaccaaaatgagatactatctcacaccagttagaatggtgatcattaaaaagtctgtaaacaacagatgctgattatgtggagaaataggaatgtgtttacactgttggtggaagtgtaaattagttcaaccattgtggaagacagtgtggtgattcctcaaggatctagaaccagaaataccatttgacccagcaattccattactggatatatacccaaaggattataaatcattgtactataaagacacatgcacacatatgtttattgcaacacagttcacaatagcaaagacttggaaccaacccaaatgcccatcagtaatagactggataaagaaaacgtggcacttatacaccttggaatactatgcagccataaaaatggatgagtttatgtcctttgcagggacatggatgaagctggaaaccaccattgtcagcaaactaacacaggaacagaaaactaaacactacatgttctcactcataagtggtagttgaacaaaaagaacacatggacacagggaggggaacatcacacactggggcctgtcggggtggggggctagggtagggatagcattaggagaaatacctaatgtagataacgggttgatcggtgcagcaaaccaccatggcatatgtatacctatgtaacaaacctgcatgttctgcacatgtgtcccagaacttaaagtataataataaaaaaaagaaagaaaaatttgataaattggacttttaaaaaaaatttaaatactcttccaaagaccctttcaaggtgacaaaaaggcaagctactgcgtgggagaaaatattttcagccacatgtctgcggaaatactcaaatctagaatatataaagaaatattaaaactcaacagtgagaaaacaaatatggttgtccctcagtgtatataggggattggtcctaggcctctacctgtaccaaaatttgcacatatccatactcaatcttacagtcagccctgggcatacaaaaagtcagccctccatatatgcaggtattacatcctgtgaatactgtatttttgatccatattttgttgaaaaaaatccatgtacaagtgaatctatgcagttcaaacccatgttcttcaagggtcaatggtaatccagttagaaaatgaaccaaagacatgagcagacatttcatagaaaaggatatatggatggcaaataagtatgtggaaaggtgttcaacatcaatgggcattagggaaatgcaaattaagatcactttgaagtatcactacatatttattatgatagttaaaataaaatagttggccaggtggagggactggatcactcatattttgctggtgggcatgtgaaatgatacactctggaacagttgggcagtttattgaaaagctaaatgtgcaattatcatataacccagcaattgtactcttggatgaaaacttatggttaccataaaacttgtacatggatattcatagtggctttattcataattaccaaaaattagagtgagtctagatgtcctttaatagacattgtttgagattgccattgcatggtggtaataaagagtagaccaactttagttggttttatttttatattttaattttctacacacagcatacccccttattgtcttcaccccagggtagactgttgttactgccctgcacttgatgcaccactattgaaagatattaatggcaccatcaaagcctgcagtgacattgttgtccctccactaaagcaaggaccaggcttccctcagagaaactgactttacaaatagtaaatagaggctctttctgaaacctatcttcgtaaacatatttccctctcctaacaaggagttttggcccttctgccctttagtcagggtcttggtccttggtatttcttgccacagcaggcaatagacaaaggctcccaaagaccttggatggaggcagacattgtggctatgtaccttgtacccaaaggattaagctgccatcttgctggtggcagcccttcaccccagagagaggaaatgccactggtgctttgaggaaggctttgtgcctttgattttccatgtcaagtcagcacttaactgtgaccctggacacatgaggtgaaaaatctttggtttattttggcattaatgtctcttgcccaataacatgggtttctgtaaacagaagtaggcatggagggaggagggaggattacataaaagggactcatccaagcagggctagctgcactatgctgatttctattaaatggcaatgggagataccctcttacccctgatttcagttagtggtagttactttcatcttaatcgaattaattacaaattgggaaggcttgggtcagcttcataaaatgctgttatttatgttgacatttttatgtggctttagctaatatatgttttaattttagattcagggactacatgtgtacatttgttatatgaatatgttgcataatattgaggtttgggcttctagtgtacccatcacccaaatagtgaacattgtacccaataggtaatttttcaacctttattcccttcccattctcccactaatgattattattttaatctcagtaaccagcaatatacctggccactcatgcatgtgcacacacacaaaccctatttgctgtagtggaaaccactctggtgaaggagatatccatggtggaagagttgggcagagtggagaaagaaggaccctatcatttgttgactgcccaccatgtgccacatactctgcttggtgactttacatgtcttagctcatttaatcctcaccacataatgtgtaaagtagatgctattattattcctgtgttactgatgaggaagccaaggctgagggaagtgaagtgagatgatcagataacgtcactcttccggtgcttaaaattataaaattccccttccactgaggataaaagtcccaactcgtcccattctccaagctatgttttagggcctgtcaacctccctagttttatctaggcccctctccctcttgcagtaggtgctccagccacactgctcttcactcagttcctttaatgtgccatattcttcttctgtggggccattactcatgctattctttttgtctggactgttctcctgtgtgcccacctgcactcaccagcgaactcctattgattcttcaggtctcagcttagatttcacatcctcagttctcagggaagcctcctctgactgtcccctttaccctatagtgtccctcagactatgttaggtccctttgttgtatccttctatcacattctgcatctcctccctaccactaatatgattttacatacaaccttgtgttcaggatcgattttcttcattagatgaaacttgctgtctatatactgtcttgttctctgctctatccctagtacctagtacaatgaatgcctggcacatgataagtattcaataaataattattgactgaatatatattgaaaccctctataattaatacatagtaagtgctcaataaatatagttaaaatacagttgttattattgtccaaaagcaaatagttaatcagaggcagaaccaggatttataattgaagtctgagtctaaagcgcatgcttcttttatgatatgactttgtctgcagaaataggttcttggcccagcactgccctaactggttgtatgacacttagggtgagacactatactactctgaatcttagttttcccatcggtaaaatggttacaggagcaggcaaagttcaggtttatcttcacgtaacctagaaaaggaggagaatagaagtctagatagatggggatataagcaaataagtaattaaccaatacaaatcagtatcttccctctgcaagacagttgatgagctataacaagaacccttgatgtttttatgcccttcagcctggtaaccctgttcaaaggcaatatagagtagtggatggtatggatggtatgtaggctttggtgttagagagccctggttcaaatcccaacatccaatttactagctctgtggtactgggcaagttaccaccctgaacctcactcaattcccttctctacaaatgggataacacccaccttttaacccatttctaaggttacaaaaaaaaaaaaaatacaataacatgaaaagatgttttcttagtatagaaagagaaacttctcccaccatcctacccacctaacagttctttctgtagttctgtgccattgaaggctacctcttgaggcaagaggcacaggcaatgtcaagaaaagagagactgaagacaagcaggctgatggcagaagccagagtccagtgtgtggagttggatcacccataggatagactggggcagaggggaagatcagctactgagggagaagaaaggagactacaaatctgagtaaggggataatggctaggcagatcctgagaagcatggtagggagccagtgggaagacaacaacatgccttagagggtacccctttcaaaactttgtagccctttcccagaggcaggcttcaaattatgttattaaaggcccttgaaactgtgtttcttccaaatctttttcttatttagtcacatccatgtatgttttgaaattgtaatcttagtgtgtacactttttcagcgagtatcttatcttcaacattttctatgtcacaagtcttcagtggctgtcaaatatcctaattttgctgaaagcccagaaagtacacctctgtgtattaactttttgcttccttgaattacctccttaaaatatattcccaagtataggattcctgagccacacggtatacaattgggatttaatgaccaaaaccaggtttttctttttctaagaaagaaattacccataatatcctttccccttccttttctggaactgataaacacaccctctagagttgtgctgtctaatatgacagccagtagccacacgtggctgtttaaattttaagtttgattaaataaaattcaaaactcagttcctcagtagcactggccacatcacaagtgctcagtagccatatgtgcatagtggctattatactggacagcacagatacaaaacatttccatcactgtagtaagtttattggacagtgcttacttagagtttctcaagagatcatttttggtttcttgggtgggagttctttgtgttcaggactttcctgggcattgagaggctatttagcatctctggcccatgtccactaaatgccagtaacacatttccttgagtcaatctaacagccaaaacactccatatttgcaaatgccccataagggaacaaaattaaccccattcgagacccactgagcttttagagggaaacatctcctaactttttcttgagacaaggtcttgctctgtcacctaggttggagtgcagtagtgcaatcatagcttaagcaatcctcctgccttatcctcctgagtagttgagactactggcatgtaccaccatgtgtggctaattctttctttctttctttctttttctttttctttttcttttttttttcttttttctttttcttttttttttttgtagatataaggtctcactatgttgcccatgctggtttcaaactcctgggctcaagtgatcctcctgcctctgtcttccaaattgctgagattactggcatgagccattgcacctggccttcttttttgagatggcctcaggttggctctgcctggagagggggaagcttgtaaagatggcttagaaaaaaagtcctggctccatttctattttctcccttcttttgctggcctgtttcctgctttttgcaaattgcaggaacaagaccctgcagatggagaagatcaaggctcgtttgaaggctgagtttgaggcacttgagtcagaggaaaggcacctgaaggaatacaagcaggagatggaccttctgctacaggagaagatggcccatgtggaggaactccgactgatccacgctgacatcaatgtggtacgtggctgcctggagcctatctctaaagcctttgagaaagaggtagtggtgaatgatagggcctttccttgagatgtggcttaggcctagctcggggagcaggcatcagtgcaggctgtggtagagcagaagaattcaggagttctgagatccagccctggctctgtcactaactgactatatatcactggacaagtcccttctctctgggcctcattttccctctctgcactataagggggactcagtaccctctaaatgtactgatttgatgtgctctcattctgggattctgggagttgagagctagccttggggaaaagcagagcaggcagctgcctctggaatgtagtttaaagcactccaagctttcagtcagaccaaacaaatcatttctgcctgctaccaaagtggagcttcctcattgatatatcctttggaaactcttggaacacagaatatgaactgtctgctaaggtggtaagctcccctctttggaattattcaagcagcatcttaatggacacttgtatgagctactgtactgatgattccttcacaaggaaggaggttggcagtgctgaccagtaaggtcttttcaaacccttatcacccataaccatgaagaatatatttttaaaatttactttcaaaggaactaagtttatatttctggaaaactcatttctgtggcaatactcattttctgatgttgtcagacctaggatcataaaggaaatatgaatgaggtttggacagtaagcaattgggattttctgtgttagagatcgcagaattctagatctcataaagtgttgacagtttggctgccagctaaccaatgatacagggccagttaaatgaggaagatatttgccagaagggctaagaatataagccagtggatctcaaacttgagcatgcatcaaagccactttgagagcctaagacacatattgctagactccacccctgattttctgattttgtatgtctgaggtgaacctaagaatatgcatttctgagttcccaggtgatgctgatgctgctgatcccttggccacattttgagaatcactgatctaggagaaaagactgctggcctgggaggcggaagccctaagtctttatgcaggatttgatactaagaagtatttccccaggaaagtccctttttctctttgagcctcagttttctataaaatgggagtaaggtggactaaatgagctctgaaggacattccagctctaagatactatatttgaacaataccatttatttagcagtaaatattaatttagcccatttactgagtgctttatatgaatcctatcattacatcttcaccaagattgcatgagttaagcactagaatatcaccattataccgatgaagaaactgagacttgaccagagttacatggagagggcatgggagatcaaggacttgaatatagactgaacaagttctggagcttgtgctattattcactcagctatagatcctctctgagaaccttaggatcttttctctgtgcctatcccactctatgttccagatggaaaacactatcaaacaatctgagaatgacctaaacaagctgctagagtctacaaggaggctgcatgatgagtataagccactgaaagaacatgtggatgccctgcgcatgactctgggcctgcagaggctccctgacttgtgtgaagaagaggagaagctttccttggagtaagctacctgcccccagtccctacaacataccctccctccgacccacatacatacttacatacctacacacacacgggcaggtatacatacacaaagcctagcctgaaagtcagagtgcctagttttagtcccaggcctttcagtggcttactcactgtgtgatcttgggcaagtctctgtgccagcttgttaaaacagaaggaggattattaaactggatgaattactagatgaattagaacaactactaggtggctttttaaattctttgtgtgatattgacaatacaagactatgtctataactcttaagagatcatttcccaagtcagggtctagaaggcgatatctagaaacctctaaaaacaaaaaagactgagctttcctggtcttcaggaagtggcctgggacttacttcatctcctggctcagagttaagaactaggcttgccttgcagagagacagaatttgacctggtagaggaaatcatttcctaaaggtagagcaaggtgtctgtggagtttgtgagcttcctactcttagagatatgtcaccagaggccttaggacacttaataggaatactcaaaagagcatgagatagcagataggactgaataccctttaaggatcttgctagccctaagatttcttggtcttcttggcctatcagagctaaggacaaagaggattacccttctcatcagacattgggcctagtacccagggacaatagccttgtgcttgggaaggtgtggggaccttctagaatgagccacagctcaacccttggttgtatggcatggagtctttaagaggagcaaggttctcattgctttcagaatgatctagccagtgtctctcatctccaaagttactttgagaagcagaaagcagaatggcagacagaacctcaggagccccccatccctgagtccctggccgctgcagccgctgccgcccaacagctccaagtggctaggaagcaggatactcggcagacggccaccttcaggcagcagcccccacctatgaaggtaagtgagctgggtaatggttgtggaggaagcaaagtatcctcccatggaagggccgtggaaggctagttctgggtctttggctttatttatgctgggccttcttttaatggcctttgcttgtgacacagtggaaggggtgacatgggtgtgctgtgttggacacacacagcacaggttttgttgccccatgttcccagaggtgttagaatgcagggagattttcaggccctgctagagtgcaattctaaaagttagaaatgactcttacacaaagatgtaatgagcatgtatcataaatgagggaaccagcaggattataaagctggttccaggagcatttggaacaaatatctatatagtcaagaaaggagaggaaggctgaaacaaatttgcaaagttagatgcaaaactggtttacatcccacaggacaataaaactgtaactttatagttactttttcttccaaacagaagtaatttgcatctctactgggcaaaagccatttgcagcttatcagtgtaacatcacagagcctgggtcctaatcaattggtaaatagtcaaacaaagagacattcttctagagcaggggtcatcaaattacagcctacaggtcaaatctaatctgttccctgttttcgttaaagttttattggcccacatgcatgtctgtgtttgcaagctattgcaaacaacatgcatgcaagctattgtctatcacttctttcatgcaaaacagaattgagtagttgcagcaagtttatatgatgtaaaaagtctaaagtatttgctgtcctggcctttacagaaaatgtttgttgacccctgttctagaaaattaaatagtccttaagtgggcctgttagacaatgcttcattataatgacgaaaagatgtgtagttctcattttgccttactttctagttttgtatactttttctcaacaccattctctgaactgggttatgtccttccttcccatcttccatggcatccaagaatacttgagtctactcactgattattgctctcttctgatgggaaatcactttgctttctgggcccctggggaatcagaagtctaagttgttgcctggaagaatctgactactaactttctttttcctgtgtccctcaccaggcctgcttgtcatgtcaccagcaaattcaccggaatgcacctatatgccctctttg

SEQ ID NO: 4656 - DNA, 1523 bp, human; identical to SEQ ID NO: 3429

SEQ ID NO: 4657 - DNA, 1619 bp, human
tggaagtgcagttagggctgggaagggtctaccctcggccgccgtccaagacctaccgaggagctttccagaatctgttccagagcgtgcgcgaagtgatccagaacccgggccccaggcacccagaggccgcgagcgcagcacctcccggcgccagtttgctgctgctgcagcagcagcagcagcagcagcagcagcagcagcagcagcagcagcagcagcagcagcagcagcagcaagagactagccccaggcagcagcagcagcagcagggtgaggatggttctccccaagcccatcgtagaggccccacaggctacctggtcctggatgaggaacagcaaccttcacagccgcagtcggccctggagtgccaccccgagagaggttgcgtcccagagcctggagccgccgtggccgccagcaaggggctgccgcagcagctgccagcacctccggacgaggatgactcagctgccccatccacgttgtccctgctgggccccactttccccggcttaagcagctgctccgctgaccttaaagacatcctgagcgaggccagcaccatgcaactccttcagcaacagcagcaggaagcagtatccgaaggcagcagcagcgggagagcgagggaggcctcgggggctcccacttcctccaaggacaattacttagggggcacttcgaccatttctgacaacgccaaggagttgtgtaaggcagtgtcggtgtccatgggcctgggtgtggaggcgttggagcatctgagtccaggggaacagcttcggggggattgcatgtacgccccacttttgggagttccacccgctgtgcgtcccactccttgtgccccattggccgaatgcaaaggttctctgctagacgacagcgcaggcaagagcactgaagatactgctgagtattcccctttcaagggaggttacaccaaagggctagaaggcgagagcctaggctgctctggcagcgctgcagcagggagctccgggacacttgaactgccgtctaccctgtctctctacaagtccggagcactggacgaggcagctgcgtaccagagtcgcgactactacaactttccactggctctggccggaccgccgccccctccgccgcctccccatccccacgctcgcatcaagctggagaacccgctggactacggcagcgcctgggcggctgcggcggcgcagtgccgctatggggacctggcgagcctgcatggcgcgggtgcagcgggacccggttctgggtcaccctcagccgccgcttcctcatcctggcacactctcttcacagccgaagaaggccagttgtatggaccgtgtggtggtggtgggggtggtggcggcggcggcggcggcggcggcggcggcggcggcggcggcggcggcggcgaggcgggagctgtagccccctacggctacactcggccccctcaggggctggcgggccaggaaagcgacttcaccgcacctgatgtgtggtaccctggcggcatggtgagcagagtgccctatcccagtcccacttgtgtcaaaagcgaaatgggcccctggatggatagctactccggaccttacggggacatgcggtaa

SEQ ID NO: 4658 - DNA, 178792 bp, human
ggatggaagtgcagttagggctgggaagggtctaccctcggccgccgtccaagacctaccgaggagctttccagaatctgttccagagcgtgcgcgaagtgatccagaacccgggccccaggcacccagaggccgcgagcgcagcacctcccggcgccagtttgctgctgctgcagcagcagcagcagcagcagcagcagcagcagcagcagcagcagcagcagcagcagcagcagcagcaagagactagccccaggcagcagcagcagcagcagggtgaggatggttctccccaagcccatcgtagaggccccacaggctacctggtcctggatgaggaacagcaaccttcacagccgcagtcggccctggagtgccaccccgagagaggttgcgtcccagagcctggagccgccgtggccgccagcaaggggctgccgcagcagctgccagcacctccggacgaggatgactcagctgccccatccacgttgtccctgctgggccccactttccccggcttaagcagctgctccgctgaccttaaagacatcctgagcgaggccagcaccatgcaactccttcagcaacagcagcaggaagcagtatccgaaggcagcagcagcgggagagcgagggaggcctcgggggctcccacttcctccaaggacaattacttagggggcacttcgaccatttctgacaacgccaaggagttgtgtaaggcagtgtcggtgtccatgggcctgggtgtggaggcgttggagcatctgagtccaggggaacagcttcggggggattgcatgtacgccccacttttgggagttccacccgctgtgcgtcccactccttgtgccccattggccgaatgcaaaggttctctgctagacgacagcgcaggcaagagcactgaagatactgctgagtattcccctttcaagggaggttacaccaaagggctagaaggcgagagcctaggctgctctggcagcgctgcagcagggagctccgggacacttgaactgccgtctaccctgtctctctacaagtccggagcactggacgaggcagctgcgtaccagagtcgcgactactacaactttccactggctctggccggaccgccgccccctccgccgcctccccatccccacgctcgcatcaagctggagaacccgctggactacggcagcgcctgggcggctgcggcggcgcagtgccgctatggggacctggcgagcctgcatggcgcgggtgcagcgggacccggttctgggtcaccctcagccgccgcttcctcatcctggcacactctcttcacagccgaagaaggccagttgtatggaccgtgtggtggtggtgggggtggtggcggcggcggcggcggcggcggcggcggcggcggcggcggcggcggcggcgaggcgggagctgtagccccctacggctacactcggccccctcaggggctggcgggccaggaaagcgacttcaccgcacctgatgtgtggtaccctggcggcatggtgagcagagtgccctatcccagtcccacttgtgtcaaaagcgaaatgggcccctggatggatagctactccggaccttacggggacatgcggtaagtttttccttccagaaatgtcgcctttcggcccagggcagagtcactctgtgttctggggtatctagcggctcctacctgcgcgaacactcagattgcccctgggagagctcagcagggtaaacctagagctctcccgtggactcccggcctgccagaggtttaacctgagctctcctaatttctgctgcgtgccctgggtgctgattcctgccctcccagattcttcaactcccccaaccgccccaaattctcactacctcctggtactcgaggtcccaaacagaaatcctattgcacgggccaccttcagagataaagctcccaagccctccactcttcctttcctcctgtcctcaaagtctgagaacctcaacaggaatttgggcaatttctcctcttcaggtctgttaggatttcactttcagcctgcgcagattagagtcaaaaagaccggcccaatagcttctcagcgggtatcctccagagaggtaaagtgaaattctcggttagggaaagaaagtggtctctgggtgctgaggtctgctgtgtgaaagggtgaacttctttctcctgaagcaactggggacttgctccagggctggaggtcagtagagataatccaaaccgtcatgtttagagtaggcagaggggcaactttcttggtaaagacttcacaggatttgcactcacagtttctcaacgttggttgactatgttgaaagtagttgcttgggtcggttttctcttgtaaagtgtttattttctctgtggattataacagatccacagccccctacttcaggtttgcatcagatctataaagaggagaatattcttttaatgtacaatttaattaggcttgactctgacttacaaaactgttggaaaacatttttttgtaaagcatttcctgctatttcagtgtgctccaaaatctccactggggagggtggagtgaggttttttattatattcctttatttttaggacatgtttgcattttagaatatgtgcagttagctctaacaaattgagtaagaactcttaatgacctatgagccgtaatcttaccccaaagttttaattagcatatgagaaaagtggcaggcaattgcatcgtgcttattaaaaattattcctcaccgcagttgttgagcttcttggagaccatgctgaagattttctcccccagcaaattaagatattagtttatctgctgagggaggacagactgaattggggaattaactcctcaggtaggccaggtgctgatgtccctgtggacttttgtcttattctttgtttctatggctgttttcttttacctgtgacttctccgaaatttctttgttagccttaacatctttgtttggggacttaaatccagcaatttgccttctttcactgatgctttccttcttacaaggtagatagcacagtgttagtaaagaaagaaagaggagggtaggatttcatattatttcgtgggctgttgaagaaacagcttcttaccaggctttacattccattaggtttttaatgtttgacttacaagattttcagagggttcatttgatattgtcaaagtcttttccagttaatttagactcttcatttttgtaatgggtttatgctatgggacaaaaaaagtattcttcattttataagaacaaatttacttggtagggttaattttttttctagggctgtcactagacggtggagcccctcttctactgtaaacttttcttgggggaaaatgtctaaggtgcattttgacctgccatgatactaaacccagacactggaaccttccatcttctgcatgcctcccccacaacttacttacttaacagggaaaaaactgatggttccacatatttgctaaaaaatgtgtgccttcaaagacaaaaccaaaatttttagggaataactatagagagcaaaagttactcccatcaagtagacaacgagcttggtgattttatttcaggtcttaatgaaaaaagcttctttatgaggaaggttatcatatcttggtgcctccttgacagtccgcttaaattaatgacataaactaatgagaatttagcagttcctgcagaaagtacaagtttattttttttttctggtttgtgattgctgcactgaatatgaggagtctagttaaagggacaactggtgttcctgtcttgtgagttgacgaagactttccatttctaggatatagaaaatccttaagccggtttattgaaaattaatcaatttaatcagaatgcaatcaattccaatacaaaagttagtattttctttctttttattgaaaattaatttaatcagaatacaatcaattccaatccaaaagttgatattttcttactttctctttttttccctcattttgtagggatacaatttggtgaaaggcaagagatttcttaagccaaagcaagagtgtcttccctctctgtgttgcatgcattatgtgccatgtttgagctaaaaatctcaaaattgggcaggcttccaatgacctgttgggtccctccctttaccattcatgtgtgtgtttatgtacataattttgtggaggggtttttttaaaccttagtaacatctgcactcactctgtgttcttatacatttacagtgtttctgctgagaggagggaagatgcaaaggtggtctcttttacttaatttagcatgtggtttgaacagaaggaaaaataaaaagtgatggggcttgtgtgcaaccctgatgatattttatggagctgtctgtcttctctctgagatcaaacaggactacaactttgttaattgaccactggctcccttggcaaaagtagggcttcttatattccagcaagcagcacaataatatgacaaaaatttattcttgggagttgggttctaagagagtgcatgccagaattagagtttggggtttagagaaattatccagatgccaaaagaacattttaatttttctcttggtaatttgttctggtctccatagtaggtagtattttagtagtgctttgatattgacaagtcttgctccctttctctattagatttttcaaaataaggcattttattaattcctctttccttctcctctctcctctcagttatcaagcatttttatgactatcttacaagcaacagtttgtcttgtaaagcagaattttcctttgaaaccaagacagattatttctgcccataggcttcaggaaccaatattttggcaagaagcatcttttctttgtggtcagcaaataggtggtgagttctgtctggatcccaacaatcaacacctgaggaccaaatagccacactgggtggcaccccattcggaagtatacacaggaagtagccctcttgcttgttcacagctcaagtcagccaaagattaacactggtgagagatattttcaaagaagtttgcaggcttccaattgcagggtcattttggggtgctttcttgcctgtactaattttatctcatcaagcttccattctttgagctgtaaactttgaaataatatactggatttgctggtacgtttaattttctttgttaagtgttttcattcccatagtaatttttcatctagtgtacatatatgcatttaaaacaaaaattctttggtctccttatgcgtatatgcactgcggcttgtacacgtacaagctacttggtgggattatgtgaactggagttagaaatgtggacaattttattatgattatttttaatggtgatatcaagatcaccagtttcattcggaaccttgcataagcagggagcagaatgcggactgggtgtggcaaagcaagggcttattttatagccaaacctgaaatcacaactctgaaaaataaaaaaaaaaaaaaccaaacaaaaaaatcaagttttgtgagcttggtcagagaaggaaaaggaaatctctccctaccccccacctccaccattttctctttgtctgcagcttcctcaagtgctgcctgtccccgattttcttttattccactcctttcatgtttttgacattgaaatacagactcttctttccacttctcagggtatttttcttattacacctgtggcatgctcctaaagaatttcttttttaaaaaaaatctgtagagtagtagattagattaaccccagtatctctcccttaagactagatgacatgaggggattgcaaaatgaatagctgggtttttttttttttttttttttttaccttgaggttaaagcctggttcaacagttgctgagagagttaactagattgcttgaggacttggcaatttcataaagtattttgtcttatgctgtctctgtctctgtcttgatctctgtctctctctgtctactgtaatgttggctactttctctcagagcctgagagacagctctgagacacttcccaggtctgttcggttcagacctcagtagctggatcacaagcagtacccaatatgcatatgagggtgcgtgctgcaagtgtccggctgggctaatctgcttaagcttcataaaaattaatcatttgaaaacaaagaaagatattaaagaaattattctatctccgacttcccctatcagcattccatcaagttctgggatgttaaattcagagaaagttaaccttatcttaaacacaaagttgacttttaaacaaaattgcttataaagttctgtacagttaccagcattggttgccctttgtcgtacggaagagaattatgaaatctcatatttacatagcattcttccaaaaaaagagacggtgttttccagtttattcactgcattcgtgtaagtgtgagtaggccaggaggggtgcttagtgattacccttttgctaggtaacaaagtagaaagttagattttctatgatatttgtttaccacgtaggggaacctctctagagcaatactcccaagctttttcttcttgaaatttcccacctgacagataatactttagattgttgctcttaaggacttctctcagtagctgctacatagagatgattgtccgtgaattattgcttgcacactcatgggtgatgctactccctctctctcatggcaattcttgctgccaacctgcaggccacaccaggattgagggcagctcatctcgataaatttatagcattaaagtgctgggtcatttgagaatgttgtcaatttaggttacttagtacctaagttttattctttaaataacagctttattgagacgtaatttacaatccatacaattcactcatctaaagtgtacagtttcatgctttttagaatattcagagttgtgcaaccattattgcaatcaattttagaacattttaatcacccccaaaggaaaccctatgcacctttgtgttcatccccctatattccctcagtccttagcaaccaataatctacttctatctatggatgtgcttattctaacattttgtatgaatgaaatcatgtaatatgtggtcttttgtgactagcttctttcacataaaatatgttttcaaggtcatccatgttgaagcacatatcagtacttcactattttttatagcctaataatgttccactatatggatataccacattctatctatccatttatcaggtgatgagcattacggttgtttccaccttttggctattatgaataatactgctgtgaacattcacgtgcaagtttattgtggacatattcagtccacatattttggacattttcagttcttttggatacatacataggattgaaatctctgagtcatatgatacctctgtgtttatccttttgaagaactgtcaaactgttttctaaagtgtctgcactgttttacaatcccatcagcaacctatgggggtccatttcttccacatccttgccaacacttgttattctctgtctttttcattatagctatattagtgggtgtgaagtggtacctcattgtggcttttatttccatttccctaataacaaataatgttcagtatccatgttcttattggccatttgtatatcttcttttttgagaaatatctatttggatcctttgctcagtttttagttgggttttttattattgagttttaagatttttaaaaaatatattctggatacatgtcctttaatagattgtgatttgtagatattttttcacattctgtgagttgtcttttttactttccttttttttctttttacgttcttaatggtatctagattgaagcacaaaaatgtttttaagtttgatgaagtccaattcatctatttattttctgttttggcttatgattttggcgtcgtatctaagaagtctttgcctaatccaagatcacaaagatttacatatgtttccttctaagagttttatagttttcgctatttacatttaggtctttcatcagttttgatgtaatgtttatatatgactgaggtaggggtccaacttcattcttttgcatgtagatattcagttctcacaatattgttgttgaatctttcctcacttaactgtcttggcaccctttgtgtaaaatcagttgaccgtaaatgtgagggtttaattgtggactctcaactatattcagttgatctatatgtttattcctatgccggtaccacgttatcttgattattgtaggtttttagtgagttttgaaattaggaattttgaactcttcaactttggtcttctttttcaagattgctttggctcttgtgggtcccttgaattttcaaatgaattgggataagcttgtcaatttctacgaagaagtcagctaggattctcacaggaactatattaaatctgtaaaccaatttggggagcattgtcatctcaacaacgttaagttattttcatccataaatatgcgatgtcttcccatttatttaggtcttccttttgtcaacaatttttattgttttcagattataagttttgcagttctttttaaaatttattcctaagtgatttattttttgatactataaattgaactgtcttattgattttattttcagattattcgctgccaatgtatggaaatataattgttttgtatattgatcttgtatcctgcaaccttgctgaaaatacctgagttttgaatgcttctgggacttatggggaagagggcttctgctgctgcactgaaagttaaagcttacttcatttcatcctgtatgaaggctgcatggggacattcttctcagttttactcagctataaattcgaactggtaatcccatcccctttcgggatgaataggagagtgtttttaaatgttcatctctttagagaacagcaggaaagaagcctagtaaggtttgggtagtttataatcccttttttagaatttggatttgggaactattagcaaggcagtgagtaataataataatttctatatagaaaactaacatgtagaggtgacaaatgaaatcactagctatattaggcttatgtttaggttatcgtaagcagctaaaatcataattttatgtttttatatgttgtcctttggacaaagtaaattccagtactccttctgatgtgcatttctagatggggaaaggattcatttactctcatataatttaagcttctttttagggatgtactccatagccatgaagcaaagataaaattcatctatacacagactgaactttgtcttcattaacactctaggctaagggtcatagctaatcagctacaactgtaatgtcctgataattgtgaattaactgcagggcacccagcaaaaggtttagttataatctaatagctgtctgtagagattagcctaataaagggattttttaaaaaagaatctggccgggcatggtggctcaatcctgtaatcccagcactttgggaggccgaggtgggtggatcacctgagatcgggagtccaagaccagcctggccaacatggtgaaaccccatgtctactaaaaatacaaaaattatccaggcgttttggtgagcacccacaatcccagctacttgtgaggctgaggcaggaggatcacttaagcctaagaggcagaggttgcagtgagccgagatcatgccactgcactccaggctccgtcaaaaaaaaaaaaaaaaaagaatctatcaatcaaccacttttcattaagcacctgctatgtgcccagcatgtgctaggaagagataaggtgaaaggggacacaattcagacagaatcttcttgaggtaactgcttacgaggagcttatagccactaaaaacaaaaacaaacaaaaaccaaacaaccaaaaaccaaacagaaatgcagtatcatcatgccatgatgcctgtatgagatcctggattgtacggtatggatttcttaaaatgtagatattttaaaaaaaaagaggaatgaatcaatagaggctgaagtggtcagcaatgttacctgtggctgcttttaatccttcgtggaagtaagtaggagcatgtctaaactcaagcaatagattaaagatcttgatgtatattttaaataacagaagttagtaccactggaaagaatgaactggaggaatgggttgaaatctatttctgcttattcaatagtgcaccccagtcaagttagttgccaatttcttcttcagtttctttggctatatcattgcacttggtgggtacatgtttatgatgtctttatctgaacaagtcagcaataatatgagtaataaattaaaattgaaggtgattaatggctctgaatttgacataagagttgttttcctgccttctaagtttccattgatcctgatgaattgcacaaaccaaacaattcggggagtaagggggcacatgatgatcttataagagctttgctgtattagacaacgtaacattctgaaatggcctaccacctaacatgggctctgttctctgcaggttgagtaggttccttgcttgtggaactgtagtcccgctatttggccgctagggggactgcaagtgccccgtggcaggatttccctgggaatggtgagcctccattgatggtttcaacacacagccaaggccctatcgcaggataacttgaaccagaactgcctagcaccagacaataaataagctactatggtacttactgtttcatttgggatgttgtttctcgaagtggcaagcattttttagtaatattttgactttttaatacctttctttgcatatggagcagaaaacagtgacactggatatattcaagtagcactgtccagtttatagagaagtttcatattccattattgcatttcattcttgtttctaccttttacaagtaactagagtttggagtattataatagtattcatactattacagtactattattcccattataaaaattgtgcaaagagtggttaagttacatgtttacaatcaaacagcttcaaagtgactgatctggaatttcagtcccattctttcttctccagatcatgtgttccctgcttttatctcacagctctttttaccttatagatgggaaacatgagagtcagagaggcaaaagaaccacaagtggtatcaatactagaaatttatgaatttcttaaggcttctaggtttgttacccatccaccagactgatggatttggttgtgtgagagttctgggtgccaataaccttgccattctactttacagactgcatatattcaataaatgcttattaagcatctactatatgccaaattctgtactaggcaccaatgatgtagtggtgaacagaacagacaaaaatctcttcgtggagcagacagtttaatgagaggagacatgtagtgtacatctgagcatgaaaagtgccatgcagaataacttcacagagtgtagggtatagagattgatggtgagagggaatattttatatttgctggccagggaaaaccttactggaaaagtaaattttgagtagtgacctgaaggaaattaggaaatgagctgctatttggacatctggagttagaatattccaggcccagggaaccacaggcgcaaagggcctgaggcaggagcacacttgctgtgatggaggacaaagaggcccatatggctggtttaaataagtgaaggatggtagacaatgagatcagagttaatgaggttgcatggtaggtcttccttaggactttgaattttactcctaagcaggttgtattggacggttttgagcagggtaacatgacctgacttacattttaacaggctccctcctcttcataacatctgtcactctgatatattatacgtttgtttgtttacttactgtatgtggggggaagagactgtgggagcaaggggggaagcagggaaacaagtacactgcagtgatctgggtgagaggtgaccgtgtctcagactaaggtggtattggtggagaaggtaggaagtggctgaattctggatgagttttgatggtatagccaacagcatttactgacagattggatattcactgtgaaaaaaatagagatgaggatgattgccaagtttttggtctgagtaactggaaaaatgagattgccatttactgaaatggtgaagactgtatgtagagcaggtgcatgggcagggtagaaatcaagagtttgatttttgacttataaagtttgaattatctgatgaacatcctgatggcttcttctcagttagttctcatgcagtgccttcagctttgctgttcttcaagaaaattaaaaaggaacttagagatcgcctaggctgtaggtaccctctcccctctttccttttactttatagaggtctatagaagggtagggacttatccaaggtgaaacagtgagctggcgacagaactagggcacaaacccagttctcttgaattctgaatcagtagattttctttttttagtgtgattctgaggactcatttgggcaagagtgagttttttgttattgttttttgtttgtttctttgcccaaacctaaaaccaggtaattaaactaaatagtgaataaaactgggaaactatacaaattggttgctctccccaatcacactgaaatattattatttttactgaaccacataccaaaatatttttcctgtaaaaacacagtaagtgaacttttaaaggcaattgagcttttaacaaagctagaatctacagaggacctggacagaaatggccttaaatcctaggaaattagagttcatggaacctgggagaccatcttgtccagctagctcattttatgggtgaggtgcctgaggcaccaagatggaaagggacctggctaagctcatacagcaagctagtgcctgagcctagtcagagcctgttttaagggttagtcgtatgttgttttcttgaaaaaagttacattggaaaagtgaaaattctttggtccatactgagaacaaagaattatacataatcatatataataataatgatagcacttcctgaatgtttgctgtgtaaactttggcaccttgcatgaattgattcatttaattctcatgtcaactttaggaagcaggcctagagaggttaaggaacatgtccaagggtcacacagctaggaagtagcagaacttgtgtgcactcccaggaagtctggcttctaaccacaaggttctaactactgtgcaataccaggagcttctcagattacccttcacctttaccaacccaaatgactggtgacgtaggtgacttcattatgctctgcccctattatagtccactgatcctcaccaaataggtgggtggcctagaggttaaagtagaggcagagtgatggaaaggggtggttagaagaagttgatgactcatgatagggattggaaaacaggactacaggaattattgaaaagggcctagagatcccaaggaggttgatctccgactgctacaaacctgggcaattcaatgcctgcttaaataggagagttaagataagaaaaataaaattgccaatttttacagtcagacattgttttatttattttacatgtattaattcatttaatcctcaaaatactccatgaggtagctacaattatcatttctatgttgtagatgaagaaacaggcacagagcaattaaataacatgcacaagattagagaacaagtaagtggaagtgccaatattagaatctaggtagttcagctccacaacttatgttattttccactatatttatggaatgaggtaattttcttataacagaaagtttttaaaatgcaaaaacattgtgcctgaacttcaaacactgaacaactcatatccttaatatgcaccagtttcttttaagcactcttagaaggaaggatacttaacctaatgtcacatggtgagtaagtagcagaaccggaacttgaatttgagactccggactgccagacctctttccactctatcacttgggctcccttctaacattgacttgtctccctccattcctcctccgtattgttctgcccttcaccttttaattacctgtctccatcaacaagattggacagagaattgggagagtgagcagagtccatttccttccagagactggacaaaaggaacaaaatgttaggaaaaaatgtcagcatgtgggatttgtgggatttacactaaataagaagggacacttcccaggactgacaagatgctacctccgtccctctaggccccaatgtgttgtgcaggatcccataggaagtcatgaatgtggttgtcagataacctttttgttactgtggaaatggaagcaggctactgcaaaaatctgtctctccaggttttcttttaaagaaggtagtcttgctaaatgataactatttcagcatttatttgaaaatgggcagtgcaggagagaaagaatttttccaagcttgtcacattgggccacctctctgaagcattgtccaacttctaattagatgaggagactgcataaaccaagagttgagagtaaagatggaaacacttgatgtttggtgtttgggtgcagaaaggattccagaacatgttttgggtctctttactctgtccatccctccttccctttcatctttgtttaaaaaccacagttagcaaatgtgtagtctgtttgcaattgttcatctgaaaaatttgtttgatcagccttttgaataaaaaagaccaaattagactgagatatttcagtcaccaactatctaataatagaccaaaaattttaaccatgctcatactttcatatggtatgtagtttgctttagacattttctgggcttcagtgaggtgctagattgactcaaaatatggcaggtcagatgtgggattgagcagggtggactcttctctacccttcccaattcagagttccccatcaaagatgatctcatagtgtttgaaaaaccaagctgaaggctttgggaattagggtgctgaagggatatgctgtttcccaaagccttctcagtcattccttctccccccagttcagattcttaacacctctttccaggattagtgcagtgatcccacgtcctttctctctagctctctctgctactctctaattcctattgtatttgtgccaccagatctttccaaagtttagctccaatcttgtctgtatactgctttaaatgtctattagtctttaagctccttaagggtgggagtcctgtcttattttttccctattcttcgtgcttaatgcaaaggaagccttgctgtatagttgtgtaatgcatgattacaatttcagcttctccccattggcttatgggttaaagtccaaattatttaaatctggtgttcaagtccttttatgatctgcttatttttccagcctgaattcctggagttcccttacaaaactcttaaaacccagccaaaaggatctagtcactgtcactttaaaccatcctcactctcttgttttttgaacatgttatttttcttataatccctttgaccttgaaggctatcccaatttcaatactatccattcttctatgacagccccctacaaaatgaatattctcaacctcccaacccaaggagaagtgatctatatgacacaatatggttgaaagaatgttggcttcacttctttatctgtaaaccaggggctagaaatctctagtttataagattttgtggagaggggatcatatgtgattatggatgttaggcacaagtcaagagtgcataagaccttttggatttatcccttttttctttctccatcaatatggtacttagtcccttaaatcagaagtacttgtgttaatgtctgataacgtccttctaaatatacctctaaacatctgtctctctttagggcaaaggttggatatatctgcaaagattctctttggatataagatatccacagcacataacttaacagtggtgtacacagtaggtattccataagtatttctttatgaaatgattcagagtcaatagtagtaagtaactgccaaaaacaactgatggattgtaagttccattaacataaatacagtcagccctccatatccatggattccatatccacagatttaagcaactgcagatggaaaatatattttagagacacagtaaaaataacaattcgacagtaaaaaaatacaaataaaattatgtaaaacaactatttacataacattgtattagctattacaagtaatctagatataaatgaaatatatgggggatgtatataggttaaatacaaatatgacaccattttatatgttttagttaaggaacatgaatatttttggattttggtattcatgggagtgggggaatggaaccatgccccttcaaataccaagggactattatatgggacacagaataaaggagttgattgtcttgctctgttaaattctggtcagacacatttgcaatgtattgttcagccccagtattcatggagcatctccttttgtaaagcatggaggagctgtgagagagacatggagcagtgaacataactattgtttcaacgtacctgaaggattatcatggaataaagaagttagatgtttttctgtagtaccccaaagggcaaaagcaatgaggacagattacagttcagtaaacgaaagaggtttttttttttttttttttttttttttgagatgggagtcttcactcttgtcgcccaggctggagtgcaatggcgcaatcttggctcactgcaacctcgcctcccgggttcaagtgattctcctgccttagcctctggagtagctgggattacaggtgtataccaccactcctgggtaattttatttattatttatttatttctttatttattttagtagagacggagatttcatcatgttggccaagctggtctcaaactcctgactgcaggtgatccgcctgcctcggcctcccaaattgttgagattacaggcgtgaatcaatgtgcccagcctgaaagatattttcttagaatagcttctttcacccttcatcagaagttgtcaacatggaccatatgagttttgtttggtctatatggtgtatatgtgtgtgtgtgtgtgtgtgtgtgtgtgtgtgtgtgtgtatgtgtgtgtgtttattgaattacttgctaacattttacttcaaaattcagatttccaccatagggaatgaagatctggcaatacaggactttcattcctacatggtaatgaccagctgtaggtgaaaagcagctgatcctctggatgggccatgcactttgcagtttgcccaggcagcactgatccgctttattcatttaagttacctgcttgactcttctagtcattcgagtatgtcatccccatcagatcagagacctaagcaaatcttgggtcccttgcttactccaagggctttcactcctcgtataggaggagctaaagaaatgtacaagcagcaccacaataggatcagacctggctttcaattctagcacggccacataacatagttggatgacctcaggacagtaacataacccctctgagcctctagatcttcattatctgtagagcactcttcttatagagttattataagaatgaaataaaacaactaggataaagggcatggcacttagtaggtgctgaaatattagttcccttcttctaattcaccacaccatatctgtctatctattggctgaatcacataaatagtaaattcacattcactgaagacattcaagaagagtctggaccctttgggaaccatgtatagggcaaaggtttgaactcatagtagatgatttttacagtcactttttaacaatttaaaagcctatagatgactccaaaatgcccatttggatgatatgaggcatactttgtgtagttaaggattttaaatacataacagagaggctgaagggccttcgggaaagaagctggggtaagagtcaaagtgtagtatgttgaccgatgttcaggaataggctttggcatctgacagattttgttttaaatactggctctgggtcttactagcttccagttctgggctgcttcacctctcttgagtttcagtttcttcatttctaaaatgaagatactaatgcttcctttgttgggtttttgtgaatataagtgagataataaatgtaaatatctagcccagggcctggtgcatagtacaagcttcataaattgtacctattattattagtagtagtagtagtccagacaaacagagcttgggaaaacgctagactctggctgacatacatgggcttttccccaggccactgctgcctggcttccccttccacaaagctttgagtctccaaaatgctttggctggaatgtaagcgtgaggtcattgcagataacaggggagcatgatttgcttcggtaatgcaagttattaagttacttccctcagcccagctgaaatctcttattggttgatgtgtgcttcaaagtgtgagacagagctagtctgaggagagagggagagtgagaagattcctcttcttggccagaggtcatggtcttccacaaggaacagaatgactcaatgcaaattatgggacctctttgagtttggggcccctacatttaaactagtaactccgttgcacatattggcacccttcccccaacaaaattactgggcaggaattttcttgaatccttccgtggcctggaatgatctcccttctcatccttgtgatccacacagctggcaaatggcaggcagcagaacaaaaacaagcctcttagcatatagggagagaaagagtcacagcagtactgaatttgcttgggaacctaatgttaacaaaggaccttcctctcaacaccccaaacagattaaaacatttttttaacagcaagttgtgtctcggagcagctctttgcttgggtatatttaaagatctgctgagtcatttaagagcaggctggcatatcctaagaggcaaggactataccccagtctatgggggagtaagttgagaggtgaaatctgtttggctttctcccatggaaacaaacaaggtgatccacttccatctcccacgactctggagagcatctactaagccttcttattctatcaactttgaactcctcagtgtataatagagtaagggtgagagggaaggagcagtcgtaccagtgtcattattggtatgttcaggagttcaatttcttcctgattcagtcttggcgggatgtatttgtttgggaatttatccattttttctagatttttctagtttgtgtgcatagaggtgttcataataccttctgatagttatttttatttctgtggtgtcagtggtaataacccctgctgtctgaaattgtaatggccctgctattggtagctgagagtagcatggaagtgtcaggttgatgggttcatttaattcttttcttttcagtttcagtcacatgcattgttaccatggcatatgacagttgctagaaagtgaaataattttttttctactttattctccactgcacttctaaatttattagtggagaaattagcagttaccaactgttcattataggtacacattggggtttccttagagccaattttccccctggttttcatcttgtaaatctgtaatcctaaaaattagcaaaacctagagcttctctttggtcctggcctgtttgaaccctgttccacagaccccaatcttctttcttgtttgaggcaactatccttctctttgcccaccgccattttccttcatctacttttcccttctctagcacctcagactgtcttcccacagtggcacagcctcccactccactttcactgtgccatctccttgccatcaaaaccatcctcacagacccttctgaaaccacttctaggaagggaaatcacaatggatccatgaaggatgctttctggatgactttaaaagattggtattaagatattttatcagtggtagcaacactgacttattcaggcagccatgccccggatctataagaaatcaggtaagctaaaagttgcttgagctggcaggagacctagttctcttttttcctttccctcttgcattttgtttatcgatggttttcaaaggacttagaggctggctttgttatagttagttggtaagagaaatggtggaggaccggaaaatgggagtggaacgaatgagcatgtttgagactaagttattacaattcctaggatgtataaattgcttgaaatctaccaagtactttcagacacattatcttttttactcttcaaaatcaacttggaggtaggcacaacagggatcaaatccttagttcacagatgagtaaactgagactggaggaaattaaaggagattccaaggtaactcagacaataagcaacagaaccaggatttggtgaattttttggggggtgggaggtacagagtctcactcaggctggagtgcagtggcaaggtctcgtctcactgcaacctctgcctcctgagttcaagtgattctcgtgcctcaacctcctgagtagctgggattacagacatgtgctacaatgcctggctaatttttgtatttttagtagagatgaggttttgtcatgttgcccaggccggtcctgaattcttggtctcaagtgatccacctccattggccttccaaagtgcagggattataagcatgagccactgctcccagccccagaccattaatttttgacagtaagtccaacttttttcaagttcacagctcagatttgctattgaatgaatgagtatatatgtcatttgggaacattctttccaacttttggttgaagatttgttttatcacttgtgaaaattttttttcattcttagcaatgtcagtttagttaaatgagcatttcatttgcgaattcactaattaattattttattcatcaatacatttcctgagtaccaactttctatcaaaccctgtgctggattctgaggctacaaagagaaataagataccatctcaggcctctaaaatctcacagactggggactgacatctcagtagtaaacatatgaacagcaacttgtgaaacgccattagcaaaatctcaagttatattcttcagtgactatggccatcctaaaaatggggtgtcttttatttggggtaaatgaagatgaagccttatgagaaattgcattttaatctaatcttgtcttgctaagaacagaagtggaatgtttcagcctctgtgtgtgtatttgtgtgtgtgaaggttgagtgtgtgatgatggatggggctgcgagattgttaagtaggatctatggggggccttaaatggtcctggtgagtcccaactttctggttatgtatttgagtagagtatgggggtgacaaagattgttgtttaagagttgattttagattttttccaagtaaatggtcagctgacttggagcatcatcattccacttgctttgaaaacctgccacttaaggctccttccagtcataggttaactctttctggtcaagtattactctttttgagcatttacctgtcagtgacaggtacaatgttagatgttgtctctctgttttcttgtttaatctttactttgatcctaggtagctcttattagttccactttataggtaagaaactgaatttcagagacttgaatgacttgttcaagatcacatagtatagtaacttggtagtttgggacttgaattttgattgttcagttttttgtttgtttgtttcctggcctccctgctgttttcactattccacaccacttcagctttatttttcatagaggccattaaatgtaccctccatcagccaaagcctcttgcctcccttcaacgtaactcttctctagcgtcctcttaataatcttctgaaaaggttttacagcctttctgggtactgggacccagagtcttaatccaggctcttaagtgccttatttaactgtaatatggaaaatcaaagtcacagctaattcaggaaaaatgagtttgggatgtgaatttcctaggcaacttgtcatctcttttttacttccttagcttcataaacttacccacaatgttccctgaggactaagagtaatggagggtgatgaggaaaggctttcctcccttcctttccgagagtcctttagccaaatgccacacctcctcctgtttccctagtctccgtgcagagatggaagtgggagatagacatgggttcctttcagccctgagttcatgccagggttttctttccctctagctggactgaggtaggaggagaggttgaagtccaccaataagaccatgagtgaagaagactaaagtacttgaaagagcagcagacctacgcttaaaatactagggtttgtgtccagactttgtgggttactatctgtataattttgggcaagtcaacagttctgagtcagagttcccttatcagcagattggaagataaattctaattatatagatgaaacattaagtctagaagtaatttgtaaattcagaaagggcttatagatttaaagtgtagccgttttgattaccacaaactaaatcctatacttcagggataaaatcttctcctgttttttctaaaagcctgtgcatgtgtggtgtaaggggtgggttttcccttgtaccagcaacttagcaattgtagtaacggggctgagggcagtggcatgcttcttcattgagcaagtgtgaaaagagggttatgcattcaggggtcagcagatggcaggcagagtagcccctccaaatctccctcccataccacaaagccctcttatttattcaaacttaacattagaagctcatttcaagtaggcacgtctgtgtctgggcgtctattttccttctttgtatatagcaggcatttgtcaacttggtgaaaagcattactcttctttccatttctgaggactaattgtgcttcttcgctagacacgagttcaaaacagtgggttgaaagagggcaagtttatgccaaagaatcagaaatagtcataatttagagagaattctagaggtcagttccctttcgtatggactgggcaactgaaacccagacagggaagggaattagaccaagttcacaagcacaaacactttactggcacattcagattggaaatcgagggcttctgctcccaggtcagaactaaatgccctttctagctagggtgttctttgatctcagtgattttgactctttctactgcactctggggacagtgggttctgcggtaccaactccaattaaagtgggaatatgtaccagcccctccccttggtttttatttttcagaggcctggcagtcagagggattctgatctctatatgcaatattttcacactactgtacttattgaaatcacatttgaatcttggcaattaacaaggcagtaattggcatcaggagggtatgttagtttgcttatctgcgccgtccctcctcttcccaacccactgtgtattgcagaatgttttatcagctctgatttgccaagttgctctcttctccagtaggtgctgcgagcagagagggattcctcggaggtcatctgttccatcttcttgcctatgcaaatgcctgcctgaagctgctggaggctggctttgtaccggactttgtacagggaaccagggaaacgaatgcagagtgctcctgacattgcctgtcactttttcccatgatactctggcttcacaggtgggaggttcttcaattgaaaacttagaactcagtttctagggtagtgagtgttgtaaggtttggactgtgacctaatattacgcagccatgacattatctattaggcatctagactagcttgcttgaatatcttagcatgttgactaatttggggcagaatatagtgtgggtgggggattttgtgtgtgggggggggttgggggttgagcaattcattattattaaaatgcaaaaagcacttaattcgctatgataagattgcctttttcatgcatactggcctacctgcaagacccctagagacagtaagcagcatacatggtgtcttccagttttcagcctttgtgcaaggaacaactgtgggtttctgcacatgtgttgtggtttgatgtttgtatgtgattgtgtaccagggtatgtgtgtctgttattgtgagttcatttctgagcagttgtgacacacagagatccagaaacagtgtcttaccctgtgtgctttgctagtgggaacgtgtcttttcttttgtgctcgtatctctgtgtaatcgagtgtcttgctaagtcaatgtgcctctgtctctttttaccagttctgtctttgtgtctctgtgccttcatgtattttttcccctgagtttgcacgtctctgtctatgtggatatctctcactccaggccactgtatcactgtgtctgtattacagctgtttatttctgtcggtgtgtggatttctatgtctgttttcatcttaatttgtgtgtctaagcaagactgttttggggtgactatttcagtttatgtcatagccattctttgtgtgactgcttctaggtatgtctttttctatgcccctattgtccccatctccatgtgtctctgtgtgtatatgttctaatgtatctgcctacttatcttagtttgtatttctctgggtgtatatccctctcttgcagttctgggcctttgcagtttttggcttatgtttttgtatatatccactagaattggcttcttatcttttttgtgcatgttttagtttgtatgagtgagcatatccaactctgtctttgagaagcagaactgtctgtgtttgcagtcagttgtgttggctgtccctgtgtttgtccctgtgtgtgcatttcattgtatgtgtacgcatccatgtatctttctgcttctctgtgaccagatatttctgtgtagctgtctatgtatattggcttctgtctgtgtctgtgttgttggctctacgtctgtgcatatgcacccaccgggttcataaaaagctcacctgctctccaaggaatctaccagattattttgtgaaataactcacgtttcgtttttttacttgccagctgctatggtacttaaaagtgtgttggtacgtaggtgtgcataatttattcatgtaggatgtcaaaagagtcagttaaaaattatgcacagtgtgtctttattaacaggacacttgtgtgtagagaatccttgagaaatgagtggttagatgataaatcttttcatattaatttcatgatgtcagtgaagtaaatttgcaagatatgggctgcataagaactatgttctttttaaaactcagcatattgatggtggagaaagcatttatttgtactgcaaagtcttatttctgataagacatcacaaataagaattattgtgatgagacttatcacaaataagaattattgtgataattcttatttgtgataagaattactgggttagaaggtgttacttttctggttttgtttgggtttttgttttgaagtgttactacagatggtgtcttagggacaaagagctctgaggttgacttagaacacatggagtacagataaaaaggagaatgaaaagtaacagagagatgggcatattccttgtttgaatggagtcatccaggggctcaggatggagtgcacaggaaatggagaggtgaaggtcatagagagaagtttagcaggaccagatctttccttgtcctgggctgctgtgaccatataaggaaggcagtaaggggaggggtagggatgaggaagagaccagctctcctctttctttctgatggaaggttaccacctctatttaaaacttctgttcttttggtttctctttctttctttgattatattattttctggacttgttctgccaaagcaagaaggaaattccacatgtggctcactcatttattatacttgtttctttgcacgatattaaagacagcttgttaagtgtcactgcaaacatcatacacactgatccactgatatgggcagggggttctttatgccagttctgctctcttcccagtgtatctgtggtgcttaatgggcgcaaccatgatttttctgatgtcagtctgtgatgtcagttgtccagtgtgtatgcaggctgcttaagagtacatacagttccttcacaattatggtagtccctgagaaggaagtggtcattaataaaagactaggttcagtagaaacatgtaagttgtctaggtgttggaaattaatacagtactgtgctaagggaacatatatctagaagttaactgaattatgctcaataaaaagagtacaaatgtttcataaatattttgacctaatcctcctgtaagattaggagagggatatttccgatattcaaataatttttttaattggcaaacaccttagacatactatttacataaaattgacatgacaaaattaagtcattgtgtctgttttatgataaaacaggctcttttgatttagttagaattattgaatgtaaaataatgaaaattaaaaaaaaaacaaggaggaggaatctatcctattttataattcagaccgttgaattgagtttttcttttgttgtattgatttaaatgcagagaagtctatgatgctggattccagtcagaagataaacatttgtatgtgggctctacattgcagccaaccttgataatttcaaacctcgattttctcatctgtataatggtaataataaagcctgtctcagtagctaccaaatgattgcatatgacaaacttctcacttatttaagggaaaaaataagaaaaagaaggacaatagggtggatttttcatatagtaaaatttattcagttagggtaatattctgagattgtcttctgaagcaaaccctgcaaaccctggccattctgttttgtttaggaaagaattcatcagttctgattctgccttttctggggagggaggctgagtattggattgaagaggagtcactacttttctgagatgatatatccgtggtaaaaattattaatgctttgcacatgcaacatagagtgttcaattttgttagtcaacaaatatttaagtggcagctgttatgacctcaggggtgtagtgacttccttattgtcctttaattattaaaaaagaaatctatatcagaatatcaggtaaactcttattacatcaaatattataataaagatactttttatattctctaaacaaagtagagatctcagatgttggttcatttatcaatataatattagatttgaaaattccagtatacaaaaggaaaaggacagcttcttaaagtttatagtgattttctatgaactatcaattccgtttttttctgttttactggtatgatggaaactaaatttcgagttgtaagtagtagataattagactgcagggtaagccttgagattacttcttttcaggtaggaaactctactgtgtatttggctagttcaacctatcatgggtagtcaaaaatagttacatatacaagtcagcattttttaaattgttcagttgtgcttaagattggtcctttccaggaacaatccagctttatcaaaaaattattgcgtacatgtaaagtgttctgacattttaatgctcacaatagccgaatgacgtgggtaagaatcttcgtcttcattttatagatgaagaaatgaagacacagagacataaattaactgggccagggtcctaccactagaatgtgatagatgataatttgagctcagcacatagttatttccctataatatttgttttatgattgtatagatgtctgctgaccaaccttaatctctgctccctaagattaaccattctacaaagcagaaactggaggtcattcaaatgaaagctctacacttttagagggccattaacaatgctcaagttaaagaaaagcaatcaaagacaactaaaatactggtaccttcaaacagtacttatgaattatttaaccttagataatttggctttgagttagaaagatagagtaagatggaggaaccaattcttccctgggttgatatttatttatcttgctcttttgaagtctaggccaatcatcctatttattctgaatggcccgttaacgtttatccatttagggacagcaggtttggcacaaatggattggttttctgaggtcttatgtagagggctgcactgactgacttctgaaagtcccccctaacccttcaaatctcagggtcatctggtctcaagccttcaattatgaatacatttctattgcctttttgagtaacagcacaacactgcaagctgacccactgggtggatggaatggggctcttgccctaccaccctttggcaaacaatttgagggtggcattgtcactacctcattgtatatagggtctcttgaggcccagaatggcaaaataattttcccagtgtcacacagcgagttattgtcagagtaaatatcaattttgaatttgtagaccacgtggttttacctcatcatttctgtttgttatgaaagttttacaaataattagaagtagaaataatgattaaaataaagcataactactaaaaaatagtttattgcagcaccacctaaattcatctcaccactctaccagtagcatacatttcacaattgggttaacattgctctggatcttatagctgttgaagaagacaaaattctttccattctccagcttatattttccccatttgtaaaacataatggaagtgtacggaaaataggagttgataatttttaaggcccttgccagcacattagtacataggattcttgcaagtggtggtttacttcacttcaactatagaaggcctatgcgacaccacccatagagggtagtttgaaagaaaatgctagtgactacgtgtgtttccttcctgacatattttatagaaggtgatgagttccagcattttttcagacttggatctggctttcattccccttctcctcccaccctctaaaacaacagaggcagcaaccatttacacactttccagaagtaagtaagtaagactgtattccagaaacaccctatatcaaaatggaaatatactcaagtgccccaatgacccattgggctagtttgaacgtgtgcagtctctgtgctccccgttttagcttaagcctactccctaacctgtcatatgtcacccagccatggagcctagggcaatgactgccatcatatctgactttatggcctctcagctttcaatgactagctttgtagcagaagtttagcctctcatccccataactttggaagtagtgttgagataaagaaacgttgaattgaaggttgtgttttctagatttctttcaattgctccttaggctttagaagataaattctcctaaaagagaggtgctacaattaatccaagcaaagggaaagatgtcagtaaaactgccccttttcatagaggtgtggcaactgctgggaaggaagaaattagcctgaggccatgtgattactaataaactcaaagcggcatttttttacttctcaatatgaggttgaaactataagcttaaattgctgactttctggcagcaccaaacagtaaggaaaccacaaagataaacccaaataatagagccaattttctttttttccgggggggatgacttctaactagtgatatgaggaaggataagaaaatgtttctttgtaggacatatgatctttgctaagtgcactgaatgtatgtagaggagacaagtctgctgagggtatgagaattgggccaagatttaacacattttcaaagctccatgaagaagcctactgagcagtgggagtggagcaggttggggatagtgaagtatttgtaattcatttttaaaaaggagagggagagagaaaaggaaaaactgggccacccatcctttgaaaagaaaccttgaaagaggtccaaatatccttagaaatccttgacttcttaaaagtgatgtttgttttttccccctgacaattatagaggtcagagagtttttcttttctattacaaaacattgagagtgtgtagaaataattgtaggtagcttagccttggctgtagtcagaacttttgtactgtgactttaggatctgtatggaatcgtatgatatgcggatacaccaaaaactctatgggttatcaaaatgggatagcattaaaagaaatagtgcttttgtttagaagaagaaatgaaatgcttgtgtccagatgcttaaaggaaggcagtgcagactttcagaaactagactttaagagctgtactcagatactgagaagggctgatggctgaaggaggaacaatttaaaagaataaccgtctctcctctccctgtatattggacataaaagaatatcccattcttttcagaaatgtaatacaacagtttagcttgctagtaacttcacatgctatttcctttacctcttatatttgaggtgtctatttggagtgggctgtgtttctagctattctgtttatctggtttgtttttgttggtgtaggaaactggtataaattttatttgggtaaatatcacctcaattttcaactaaagctttatttaagtttcacatgaaaaagacaaatgaggcaaaggaagagaaaaatgcattgtcagaatcagaattatgagaaaaaaagtcaaacaaacatatttgaaatgtccagaaaacctgtgagtttttatgtatactatacaggaaagatattctgtcatctggttgccaaactatggagggtgggagacttcgaatttttgtcaaaaagtattctttcattagaaagatacatgggtgtgcttccatgtcagcaacatgactgcagaccaggaagtcctcacggagagctggaatatgggtattttggactctctggttagatgcagcttttacttcacatcctcagtggtactactgtaaattttcattttcctgtggaataccctatttggttccattgtatatagttgacaactagaattcgttcgctgttgcttgagcccaactataacttcttggcactatacctatcttctgatgtgcctgtggaagagctaccataatgaatgtgtacatggacaaaaaaaaagagagagagagagagaattaaatcatgagtttgtgccttgggagctacagtttaaacatttgctgtttttctcacttaatgaaaaatttatttgaaaataacagcacagaaaggaagaaagacaggctggcaagcatcctcctcctaatacacttatccacgtttggataccttggtctcagcctcagaggtcatatttttagtaaaatggccaccagaaataaaggattttattttccagactttggtgtttggagctggtgtgctgagagctagcagagaaagccctactcaggtagatgtaccagagcaggatggttgctggtggatatggtggaataccttttatgtggttatctcctccttgtaactcttggctgcataacccttattttcttttctatttttattctctctcttggaaaaaaaattggtggtaaattttcatgtgagccatattgtctttttaaatagttttattaatataaaatgtacgtaccataaagcatacccatttaaactgtaaatgtcaatgggtttctctctctctctctctttttttttttttttttggatgctcagagttgtgcaacaattatcaaaatcaattttggaacaatttcattgccccaaaaggaaaccctctgcccattagcagttactccccatttcccccaccccctgacccttcaaccctaggcaagcacaaatgtactttctgtctctatagatttagccattctggacatttcatgtaaacagaatcatgcaatatgtcaccctttgtatctggcttctttcacttagcatgatgtttccaaggttcatctgcattgtagcatctgccaatacttcattccttatttatggctgaataatattccattgtattaatgtatcatatttgttttttccaatcatcagttgatggacatttgggttgttttcatcctttttttagctattttaaataatgctgctatgaacgttcgtgtacaagtttttgtatgaacatctgtttttatttctccttggtatacacctaggagtggaattgctgggtaatatggtagcttaacatttaatcttttgaggaactgccagatttttccaaagcagcagaatcattttacattttgaccagaagtatatgagagttttagtttctccacatcctcaacaacactcattattgtcattgtccttttcagcttttttgataatagtaatctcaatgggtgtgaattgggaccccatcatgcttttgatttgcatttccttgaagagtaaggatattgatcatcttttcatgtgcttattggccgtttgtatattttttgatcctttgctcatttccaaattgggttatttgtctttgcattattgagttgtaagatcttacaatatattttggatgtttgtcattttagggatgatacttcacagttatatgatgttttctagcaagcatttgcgttgttctactggtgttacatatcttagctgcattagccactttgctgggtatgaatgccagcagaatctaagtgaccttggcttcactactgagaatgcaacccaagaacagaaatttgtcagaaatttagcactgaagccccccacttcccaaacttatctgggacaaggagaatctacatttaaagctctatactttgtgttgtgttttttttactttagcttggttggatttaggatcttttctttttgttttgccttatgcatacctaagcagaggcaagggaggaaagggatatgaacctggtagaaaagtaagtaagctttattcagattggcatatccatcttaatatggttcaattggctgaagaagtatctcaactaaaactctggaatactttgaagtaccagcaatatgtaccaaatgtactttttatttatgtttggtctctatgtacttgtgtgtgaaacaatgagcacaaataataccctccttgtttttaagcaatttatattggtgatttaaaaataaaataaactcaagtgggaaatcatgaaaccccatgtaaaaacaataagagcatgttttaaaatcccacagactttagtttcaaatagtggttttgctatttcttagctgtgtgtcactgtgcaagttactttgtttctctgagtctttattggtgatatatgtaaaaacccaccttctcaaattattgtgaggacaaaatgaagtaattaacataaagttcctggtgtataataagtgttcatattttgtatttgagcacagggcaactgggtttttgaaactgcacattactgttgcagtcaaatctggcatgaaattagtgcatagacagaatgggctgggaaaatgaaaggactttgaacatttatattctgctttatttaggcataagtgcttaataattattgatagtttcttctggttatctgacattttgaagatactattacctagcagaaatttcttgtaataataatctcttacacttatatactgttttgtgcctttagaagtacttaatgctctttatttcactatctgttcataaacattctctgaagcaagcatacagtcagtatgaattccatttttcagatgagacagctgaggctgaaagacatagagttacttgtctcaattcacaaagtaaagtgccagagtttgaaccagagcccaggtcttctctctcaacgtagctctttttctccttcattatatcaggcatagtagcaacgtattcttttactagctttttatcttgaatatccttttagcgacttgcctttggtgttagtgtgcctataacattgtcgttgaatatcttaatacatttagtggtcttggcaagcagttttgtcttcagaaggacactgaaatctgtggaaaggactgcagaagattgggtgggcagacacctatcactttcggggctggtagactttctattgaagcaatttgcaaggctactttgtattgtctaaaagcactacttcagaaaagggttgtgatgtcaaaataggcactttgagtgaagaaagggctgtaagcatgggtggaaaatgtggtagatgattgtcttgagttattttctttaatgtcaaacaggcagtccttggaatgctacttcaaaaagtgttgtataatgttgaagatacagttacagatttccaacacgaaactcataaatatgcaattccctgtcctcctaggcacatgaaggaaaatttatgagcttcaggtttctatgcagctattaaagcatatttaatctgctttgagctcaagctcactctcgttggctctcttcgtttcttcctcttacatgagcaaactgcctttctttttgtttaaaaatagtaagtaggtttgttttcctccaggtgtcatgaatgcaaacattgtaatttctcatctgttcagcctttttgcacaacaaaatggcagcacccaggaggttgaaagggttaaattgttccttctctgagtagtaccataagttgttagtctgctactctttctcccagttggcacatgaccctaacatccaatcgctagtggtgtggccattttttggtcttattttggcctttcctcagccaccactcatcagttctcatgcgtatttgtcagatcctgctccccaactccacagttcttagttcatcttaagcatatggctgtctgtcttttctctaaagatcctcaagggaaaaaaaaaaaagcatctccagggggaatttactgcctcatagccctgacagagatttctgaccaaaccctaacgaaaaaatttcttccctccatttgtcttttattgtttttacaggggagatatgtaacataataacaattatattgcacataataattacttctacaaataataatctgttgtcaaaaatatacacagctttggatttccttattatggcccttcattaagttgtggtttaagaatagctatgattattacttttgtgataattataatccataatatggaaacttataaaattacctttaaagtgttactattattctggccacaggatggaaagttgttcgctagttactcatttataacctgaatgtactttttactgaatctaaaggtatcatctttgcttggcaattcccatgacttgtctttctgactcttcagatctcagcttaaaagctctcccttcaaagaagccttccctgaccactctggttttttcttctttttttacctctactccttttcccattacttgctgtcatagcattctgtttgtttcctttgaagtgcctattccaatttgtcattatgaatgagtttttttgttctgttgcttattatccattttccccactagattgtcaactctgtgagggcagagaccatgatactctgttcactcctatatacattcccagcactatcagactttttggcacatagaagatactcagtaaatatttgttgaatgaataagtcataaagaagagtttatattttaactcttagttgaataatctaagccaagaattatcaacctgggttggacgtgagaatcattaatgaatctttaaaacaatgacaaggcaatctatttattaattatctccaggtctaaactttagcacgtatatacattttaaaagcccataagtgattcttacgtatagccagtgctatctgtctcttctcctgtcctttcccctcctctccttactcctctctcatagttttaggattagcatggccccacaacaaatctttaattcacatggcaatttctaggatttatcatggaaaatgagccaaattgccttcaagaagtttttacgtacctcttatatagaatgtgatgttttatatgtacctcttatagaatgtgagcttttaagaggcatatcttattgcaagaaatttcaatgttgaaaaaaatattgaatatttataaagtcaaaaatgcaaacttttatatgattttcaaacctatgaagttatatcatgttcaggccttctttccagcatgtggctctcagccctggtactgtccttaaccataaacctcatctttgccctctatagggagaggtttatggttataattactcattttaaatagtgtatattagtaatgtacactatttgtatatttgttgactgcctcctatatgccaaccactatgctagaaattttgtaatattcttcacgatattcaagatattaacatatccgcattttataaatgaggaaactgctctcaaagaggttagtttacacagccagtaagccgctaagcctagattggatggaaggtatgtgagaaaaaagcagcatccataaggttttcattctcctaccctgtacgacagaggtaatagaaattattagttaaagaaataatagaattttacaagactctaggaagggagaatgtgaaggatacagttctcagttactggaatgagtgccagagtaccagtacatggcttgccttggggtttggactacctatcttaactcctttgctcctcccaatcttgatctcatttgtttgaaagatcatctgcccaacataaaaatgcatttctaattctgtaatttaagtcagtggcaagatcagattcagttaaagtttactttcctgacagctttttagtatcatatctattttgcaaaactctagtgataaatgtatgcacatttacacatacagcatctcttctgattctgactaagatattactgggttgtgtagaagtgatgggctctttagaagaaaggtttgatatactactaatctaaggactgaattttctcatctttgtctttgccccttttgactgatgaccagagcaggagcacataacattcttttgtgctaacagtatctctgcatcacattgatcaggagaattggcatctccagagccctgggatggtaacttctctgttgattttcaggaaagattaggtgatattttctccatgggaagaggatgtttgatgtgtgttggctttagcaaaaggaagcttgtggagtcaactgtaagtagacagaattgcctttgacttaatctgtttcagtcgttgttcatactcaggtcctccagaggacctttaagcatttttattgactttgtggtctattacacgaaactaaagatactgattctcagtcatgagtctgctccaaaattgcctagggaatcaaaaataattgtaccagttcctattcctggacattatgattcatttggtctggtatgaaggccaggaatctgtatttttaaaattcactcaagcaattttcatatatagctataattgaaaatctgtggctgaacttctccactcccgtatccatcgcaatacttccccaaggtggcatttaagatgggcctagagggttatataagatttcaatattaaaacatggattaaaagtgaagacttttcacatggagataatttggaagaaaaacttgcaaaaatgtgagagcattgagaacttttctttcccaaggaaagaagtggcagcttcatttttggtcattgcaaacagcagtgccatacatgaaaggaaagtggtggtgctcatcaactttgaataactttgtacagaacccttgagactcctctctgcttataaagaaaaagtgtcaactgtaaagttgatttatttatgaaccataggctactatgaaatctctgttcccagctagaggcctgggagagtaagataactacttgtttattccacggagccacttattagctttttctatagcacatacctcaaatgaagcatttcaataaaagaaccacattctattcacatgcttcattttattctgatttatgtaaaaattcccaaactcctcaagcagtgtttctttgtaaggcaataatcttcagttctgttgcaaaggtcaggagtgatagaatgaaaatggtactagatacaacagctctttggtatttgcatggccattacattgccatggggctgcaagacttgtgagtgcttgatattttgcttgttgatgaatgagtctgtgtttgtgctaatggagtgatttgagaggtagttctccactgtcagtcaagaggttggttttgaaagctgattgccaatggtcattctgctaaccactctggttctcctttagatagagacttattcagattcaagtcttcatgtactttgtggcataaacattgtacacaccagatgtattcaacaaccataaaaaaaaacaattaggactcaagtagtatgtcagagtgtagtcactgatgatatataattctccactaccaagaagatggaagcacactgttgagtagctacatcctacatatgttggccagaatttaggaatacacatgtgatctatacattttgaggtattgtctgacccctagaaaatcctggtgaagtttttctggtgtcagtttggtcttaatgtttaggaaatgcccacagactactcctgctttctgcttattcacatagtaaacgcaaagcacaggactagtttgtcatctggatcaaggagaaatgagttagcagatataaaataaatcagaaaggaggtagttctcaaatatttactccatgaatagttgctggatgttcattaactctatagcatttgttactacttattggggatcctggaaagaaaatatattgtctatatccactgttcactgaggccctctccctacccagaaactccctgtctccatcactcactctccacattcattgacccaggggaacagttcatggatgagtgaacttgagctctatcttaaaggatggagttcgatttcaaggcaagaggtataagagaaagttcagagacaacactggctatggtctttgtgaagaaaagtgaattgaataggctcctgtggagatcttaagtaagtacttctggagataaggttgaggaaaagtaggtttgaatcttcatccagaggtagcccctaaatgtgttgagtttattgaaagagtacttgacttggattcagacagatctgcatttgactcctgttttgccatttataagaatttgagtaattattgtttctaaataagagtttattgagccaagcactcagtaaatgtttgaatgggaaaattaactgccctgtttttctattgtcagatggtcctcttcgttggataacttggtaactgttgataaccttttctcaggaatcagaaggtagaaaggttgggaaaatataagaaacaaaaaggcatattcctatttttattttcatattgtcttccaactctcccaggcttctttgtttgcaaggctgacttttataatactttttgggtagagcaggtccttctttggtttggggttaaaccgtgagtaaccttattttctaggtctcagccaactttgaagggcatgaactcacagtagcctcactaggatcacttcagcagtgagaatttatctttcttgtataaaagtgtaagagttgatggcggccaggcgcagtggctcacgactgtaatcccagcactttaggaggttgagatgggtggatcacctgaggtcaggagttcaagaccagcctgaccaacatggtgaaaccccatgtctactaaaaatacaaaaattagttgggtgtggtggcacatgcctgtaatcccagctactcaggaggctgagacagaagaattgcttgaacctggaaagcagaggttggagattgcagtgagccgagattgcaccactgcactccagcctgggtgacagagtgagactgtcaaaaaaaaaaaaaaaaaagagttgatagcaaaataactatctgtagcataaacctcagtattctttatcattcagtatcaacattattactgaaaacaataagcaatatggactgagtttctgtggggtggaaatgtgaagtggatcatagcatgatataacttgtcatttggcttcctttataaacattatcaactacctcagctctatcaatcacttggcagtccgtagtgaacattataactcaaatgactagtcaggtctgttcattgcccatgtaaaggcatatacctgaagtgagaagtctgaggtaacttagcaataagcttgcagtacagtgtttagtgaagccgaggaattcaaggatttgagtcatgccagattgctccataaccatagcctatctttgtcacaagtaagaaggtttaaaaatcaccataccattattggtcacaacgtttggagatagggaagagtttgtggatggatcatggcagtgcatggacagtgattagcccataacacaaccagtgaacactgttgtacccaaagcacataaatcaccacatatactattaatatatttatggatgacaacagacactataattttatgtcagtgctttctgctgtgaaaaacaaagaaagttaagggtaccttttttatatttgcatcatatctccagaccttttcctttatctccttcttgcaagttcttctttctttcagctgactatctgctgttcctgctatggctcccagtggcttttcaagagggtacttgttttttaagagaagacccttgaaggacagagagagcctgaatcattcaaaataatgaattactcaggatgaaatttcaataatttgcaagtgtgtggagatagatattttgaggaagcataattttctatgtacccctcaaatcgtggctggagatgacagcctcttccacctccatataagaccatttcatttccttctacttttttctccctccttcccccaaacacacaaacatacacatatcctgtgcttcagtcacacagaacttcttactatttcatttcaattctctatggctttgcatgttctgctccttctgcctagaatgctcctttccttttttcacctggaaacatcccaattcaaatgtcacctcccttatttataccaactttgtctgtaactcctttatcacacttcttcctgtgattagtcaattcacttgtctgctgttacacctctatgagagatgaaaattccttctccatctctggaactcatgcccttcgcatatagtaggcaatctgtaaatgtttgaaggttgagtgaattaatgaatgaccttcaacctttcaggcttccaattttctctctgaaaaggacagccaaatgaaaactcataattttagaagatgaggttagacggttggtaggtgcatgcagagaccagttattatttaggtattatggaagtttatagttcttgtatgttgagttcagtgtaagagtggccccaaacatagttaatgaccactccagacccagttgttatagagttggccccagctgtattgcttctatttaagactaggataagaaatgacactttcctactttttaccttattgaaagggtagaggctcactgttatcaatctcagttcacttgttgattgcactggcttgccaagtgagaatattagcacctctgcacatttctatagctctgccacttatgagatctttccttcccattgtcatatttaataatcaggatagccctataaaatatgcattctcatttcccagatgaggatactaaggctcaagtaggagaacttacttgtttagtaagatcatacagctaggaagtgggagaggcaagagttgaacccagatcttcctagctcctagtccattgttctgtctactgggtcacactggaccagccaggaggcaggaaaatcagctggggaatgtggtgccaacgtgtgatgtttgcctaaatgtgtgcatccttgctggaagccagccatgattcatgctgcataagtattcattaatgttcatttcatttatttggctatccatatgctttccagggcgaaggcaagctaggacaagggcagacaagcagccttaaagtttgggtgctttccttcgaagttgagctgcctgtttgaaaatcacactttttggtgatagaagatggttccagtacagattttatttattactgcatctacatggatagacattttccaaagcatagctgaaaatatgtgtaagtcccagaatattttctgatttagacacagactttgagcatgataaccacatttagcatgttaggaaattctgtcagaatgcttctggaaaggctacctttccagaatgaaatgaaaaaagaaaaggatggactttgaaactggctagatttgggttatacttactcatagtgtgaccctggcaaatgatttaacttctccgaatttcacttttcttattctttgaagtgaaattttaaaatgccatcttgcctgatttttgtgagaatgaaaatgagatcccacaccaggaatttagaagctactcagtaaatattgcttctctcctttccccttccccagtcctgtcccccgagacattcagtagttattcacaggcatgcattctgaagtctgcctactgctccatgttgaaatgcactgctcttgcaaggactgattatctatttttctgtcttccaaggccccctgtgttccactccaccctcccaattctgggggcttccaaagtgggcaggtacagaatgttctgtggagcatcggaggctgttactcaatatcttggccagcactctcaactgctctttgcacacactccatatgaaggcaaactccagatcttggagcccatgtgtgtgtcatgcattgtactgcttcttgtacccaaatccatctcaagggtgagtagaccaggctcagacttgtcctgggagcagatttctcaagctgcccatgtccccacactgtttgattaaaaggaggtgcttcaaactctttggctttatatagactagaatcagaatgattggtggtgcctctgttctcaaggtatcccaaagcactttgtaaggaaatatgacaagcgctgaggccatgcaggccagtacaacagccgccacccagcacttcacaattagtcatgcccagcctgggatcatcaagcctgtttttattggaagagcaagagagagagggaatgctagctggcaatttccccaggtaccctttatgaaagtgcccttggctcttccaatttcatctgaataaccagctcaggcaaattttcctctatcaaaaagcagaatgtgatagtgacaagctgatgcccggctgatgccccaggacattgactaaatagacttggcctcacaattggtttttattctctatctcctttcttcccttttgttctttttctgtgtttctttccccattgccatctgcagagtgttctcagtcagaagtcagctgtggggtggacagtttgtcattttaagatcatccctattctgtctacctttcttatccctcatatcattgcttttagagcaaggacaattctggaagtgaaactacaataacactctgggctcctttccctctagtagtactcaacacacttgtaattacatgttcaaatttgtctttcttatttctacttaggttcatgaaggcaagggacatgcctgtgttgcttactttctcttggcaggcacatacagcaagtcttcaaaaaatgcttgttaactacaaattaagtgtttaagaagtccactgttaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaagaagtccactgttagtatcttttcccctgcctagtttgtaagcaactggcctcttctatttgtaagttacctgttttcatttccatatgccccaaagcaaactttagctcacggccttacagagtgtgtatgttagtatgttaaaatgaaatcaactttcctctcccaggccttctaattgacatgaatttgggagtagacttgcattggcctttgtcctgacagccaacagagtcctcttctgttgtattcactgttgccttccatgaggatcccatggagaaagtttgtcattgatatacattttgagggcagactcaacttgagtaaacctgattgagctttccccatctgcctcccagagatcactgcctgtgctttgttaaaaagagaattataggagtcctctcaaggcagagaggcctaaaattagacatggcagccatgcctttggtgtgcatggaggttggatacaggcagccagtttcccctctgttttctcccttgcttacacagccaaggagtggagccaagcctcaaggggaggagctgtatactcgagcatgccctgtggttcctggccctgactgagggactattttatatatcccaatagagaagcgtggaagacatctaggttgccactgtcatttgaaattggaatttttaaaagagaaacctgaagacttgaagaaagctttcttttgcctccccttacagttgatttttgagcttcttaaagctacctagtccaaagtacccacactcttattcttttgtctttcctactggttttatttttttttcatcttcccaggtgtttgatgatcactaagagcttcaacattgctcaccctgaccaggtatgaagccaagagtttggtttagggcataaaagaatgtcggaactcaaggactaggttgaggtggggaagggggatgaaggcttctttttttcttgggttaagcagaaataacttagatctcagagtgaaagccttgaattatcacatatatcactggaaaagactagttctttgctatgataacaattgttcatcatctctcccctgaggatttggggtcaaggcctggctacaccttttaatgatttcagtcatgtgacttaacctctttaaacttggattttcttcatctttacaatggaaatgatgacaataatcactacctcacagatattgataataatgatatctcactaggaagagaattaagtaatatgagggataaaaaggcatttgtaaatggtaaaatgagattatgattttgaaagctattattattttcctttcactgtctattatctcaactcttctattttcttgccttttgtacagcatggataatttagatgtgactctggacagagggatggatcagatgacttcttaagttatcttccagtttaggagttcgtaaactatactttctcctttccagactatcctagtaagaaaattctcttttaagacagagtagaactctggaattcatcagttttgatgtttcttaaagtgtaatctaagatagtgctcctgtattaagttctgatgtctgaccattgttcaaataaagagtaaaatgcaaatgacaggaaattggctgcgttctgaatcctatttttatttgggataacaataagcctgtatggtcactgtgacctttgatttgctgtttctgcaacctcacacttgtctcaggattcttcttccacttctgcactttatattgggtttcttccaggcatcatattaaactttaagccaggtatgtgtatatgcatgggctgtgggcctgaaaaaaattagcccgagagagaaaaaaatttaagtagtgggctagaagtaagcatgctactagaaacagaatttgggaacacagctctgggcctagaaaagcgacctgtcaacttgttacagttaacatcaataactataggatgggtttggtggaaaattatgctgaccaacagggtgggagagaatagggtcagaatatatatcgctgtaaggttgagaaaaaaagaagtgaaaaaaaaagaaatgcatagagagaaaaaggagtttagaggtaacatgttaaagtgtgagaaataaactggagagcttgacttctcttgaatatatttttaaataaagtactcctttcaactccaaatgcagcaggcttggttcccttctcctacctccattgcggatgaaagcttaatctttaagatgggcttgggtgggtagagtacgccccttggtgagcactgtgctctctgcaaccccaataaggcccaacagggctctccaaggaggcaaaattctgatgatacatttctgtttagtggaaaatgggtagggaaaattatgtcttagaatcaattaaccaaacataaaatcctccaaggggcttggtaggatgcctagggaagagccacgagataaaaactccaggctggaagggcattgttgcagcactgtcattctccagtttctcttggagttgtcaccaccctctcctttgttctcactgctgacatcatttgtaaaataatttcttcccttaaataaacaagacatacaatcctctaaatgactaaagaacagttacctagaagaaaccttagtggaaagtattttcttcatctaacggatgattgtctttacagaggtggagtaaaggatgtgcgagggagcataatcaagctaagagatgcatgctgacttaaaaggcatgatatatgtgaaactaagataatgtgttcaagagtgatgctttgttgatgcagaaccactgaattccttactattatgtttgcctgactatcggcctcttaataaagaacttgtggtttgagtgttcattgaaattagccatattaggtttatgtggggatgtgaggatctatgtctaccaattgcagcctctgctgcaaattggaggcagaaatctgggctgaacaataggtaagagtgtcaactctacagatctctcacatgctaagcaagcacaatatagggcaatccaggtttacacaaaggattaatttgggaacaattatcctcattttcacttcctaaaaagattttgaataagatgtcttttaagtaagaagctccctgaatgcatttaaaatatgatttgattatgtacatttcagatttttctacctttctaggagtatctctgttgtataaaaacacaaaattctggaacttttgaaaggaagatgtgcctctcttcatacatttgtcattcttgaacgattgtaaaatgaagtgactgcatatcacgtcatgtgccctattgatttcttttcttgttttaggaatattcccagaaaaaaaaaaaacttttttttttttaaaatctactaagcatgctaggtaagactgaagatgaatctatttaagttatgtcaatatctatttataaagatttttgtgatattcttttcactgtagaacttcaagcatatcctaaaaggaacggttagatacctctacaaactgtggcaatgacttactgagtaattgctggcaactgatttttggtgcttcttgttttgatagtatagcagtgcgagtaggtttcagaagagcaaaactaagacaatccagggaaatgccatttgagaatttctaactttaaaaaaacaagtaaaatagtgccaagaatattatctaactaaccccaaagtctacaatgtaactcttttattttgataatgctgttctaaccctatctacttcagtcctttcccacccagctggtttaggaatcaaattcccaatgtttcatcactgttaacattactgttttactcttcactttagttcttaaatggcatagtgtcttaaattccctcagcctctttcacatttgatttctttggaaactttttaccttttcattgaagcccatatgatcttttccgaaacagacccttatctttacctccttctttggagtctttctcctacttgaatttctgaacttcttaaaatggccgctttgggttggtgtcagtaattcagtaataagttttcttttctttttttttttttctttttttttgagacagagtcttgctctgtcaccaggctgcaggctgtagtgcagtggagtgatcttggctcactgcaacctccacctcccgggttcaagcgattcccttgcctcagactcccaagtagcaagtagcagcaccatgcccagctaatgtttgtatttttagtagagtcggggtttcgccatgttggccaggatggtctcgatctcttgacctcatgatctgcccgccttgccctcccaaagtgctgggattacaggcgtgtgccagtatgcccagccagtaataagttttcttaagtgctttcttaatattctgatatttttaaaaaagatctggactattttgtcatacaggcaacagaatgttaaaccatttcataaaacaatgacaaatatacatgaatttttcatcagttataaatgcatttcctttataacattgaacatgtttttgcaactgaaataagtacggttttcatttttagaaggcacatgataaagttaaggcagtggttaattaattttttcagattaatttttcagaaaagtgactgtttctgtctattgtcttaaccccaggcatcaaaggattttaatcagaaagaaccgaggaataatttggttattttagtgcctttttttgagacaaagtcttattctgtctcccaggctggagtacagtagtgcgctcatggcttactacagcctcgatctcctggttcaagtgatcctccaacttcactttcccagctaactgggaccacaagtgggcaccacactctctgcaatttattttaatttttcatagaaatggggtctcactatgttgccctggctggtctcagaatcctaggttcaagcaatccttccacctcagcctcctaaagtgctgtgatttcaggcataagccactacactcaccctattttagagctttgtcaagctttggaaagaaaaccatttataatataatagataaattatggatatttgaggcagtttttatcatagtatacatggtaaaccacagcccccctttataatatttgtatttaataaaaatgaaaatattacttttatcttaaacatgttttaacaaagcaagcatatgtagattagcactaattaaaacaaaaacctttgtaatgatagctgttttttatatgattacaaaaaatttactatacaaatttttatcctaatcagtgtgaaaaactgcaaatattagcttatagggctagtcttcagagtcctcttcctacctactactgctaataagccaatgaaaaactctctgatgtgtgtggtggctcaggcctgtaatcccagcactttgggaggccaaggtgggtggatcacttgcactcaggagtttaagaccagcctgggcaacatggtgaaaccctgtctctactaaaaatacaaaaaattagctaggcgttgtggtacgcacctgtagtcccagctactcaggaggctgaggtgggaggatcacttgagcccaggaggttgaggttgcagtgagccaagatcacaggactgcactccagcctgagctacaaagtgaaaccttgtcaaaaagaaagaaagaagagagagagagagagacaggctcctccgctttttcagttcctaaataattttccaatctagaatgcaaaagattctgaaggaagacagttaccatttcagatcggcagaagttgtggctttaatctagactcgaatatgttttacatcaaagggttgcctcaacagtgctcaaacctgcctctctgaaaacatgctgagcacgaaggttacttgaagtcttagcttgagtacttaagagagtgctatggagggattgttgatgagagctgtgtcacagctaatttttctttagtaattaaaggtttataaaaatcttacactgtatattgacaaatttagcaacaaaatgagcttgagaaaaaaatcaaggcctgccatggcatctttgcttttttttcttaaaaaaaaaactttttagaaagattatgcgactgtattatctgtaactactgcaatggtgtaaatcctgatggtataatttgctttttaaagctatctttacttcagtataacttagattaaatttattttaaatttaaatgatatttttctctttgtttattattttataatgtttcccatagaattcacaaaattcattagaaagatttttttttacttccttaggtcattaagattctgatttgtcaatggatttcacataaaccctgtctttccaaaaatatacaaaaaaaaaaaaaatagccaggcgtgatggtgcgtgcctatagtcccagctactcagaaggccgagttgggaggattgcttgaacccaggaagttatggctgcagtgagctatggtcacaccactgcactccagcctgggcaacaaagtgagaccccatctccaataaataaataaacaaataagtaaataattttcaccttgaaaagcttataaatgtatgaaatcacaatgagggtcgctgatatagtttggatgtgtgtccctgcccaaatttggttttgaattgtaatccccagtgttggagatggggcctggagggaggtgattggatcatgagggcagttttttcatgaatggctcagcaccatccccttggtgctgttgtggtgatagtaagttctcatgagatctggttgtatagcacctccccccttgctctcttgttcctgctttcaccatgtgacatgcctgctcccccttcaccttctgccataattttaagttgcctgaggcctcaccagaagccgaacagatgccggcaccatgctttctgcacagcttgcaaagccatgagccaattaaacctcttttttttttttttataaattacccagtctcaagtattctttatagcaaggcaagaatggacttacacagtctcttttgtatcagggagagggtcttcttggtgactccacttcttttctttgtttatgtatccttccagatgatgtatttatttcctttgtttttcaattgatatttactcttaaattaaactaattatttaaaaaagcattttaaagtctcattttagattattttgactatctgatttttaaaatggtttaaaaaatctatcttggcctccatatgcaatcaaataagaaacacattttaagcatattatttaccttgtggattctgccttcctcagtgtgttcagtctgtgtatattcatttctcccacactgtaagaagctagtcagatgtataattggattatcatgctacataatcttagcacactcattttaagcatacatagactagtgagcaccactcattacatgtcatttctctagagaaactagttgggccatggctgcaggactctcacttgaaaagacatgtgtggtgatgttttctcaggcagttaagcaataaagtgtaccctgatttgcactgaaaataaagattcctttaaagggagcagttctagttatctctctctttaggtaccatatgctgaacgtttttctatgcactaaaacagcaactaggttttatactctgccttacagcctacttcacacccatttcacagggagaggaacagagaggtaagtgatttgccccaaattacataactaggaagttatttgctcagtgtggaaacttgttcagaaggtcatttcattgaaatgtaggaagagtttctggcacttctcttgagcaggagtcaaaaacctttttttgcactagcccagatagtaaacattttaggctttgtgggccatatgatctctgtcaaaactcctctacttcgttgttgtagtgcaaaagcagctatacacaatcctgaaatgaatgggtgtggccgtgttccagtacaaccttacagaaaaggcaataggctggatttggctctgagactgtagtttgctgacctcagctcttgaactgagctctttaactgacctcagctcttgaactatggtacaagatcccatggtcctgtttggtacctccatttgccctccttttcactctctgggagcatagctaagttcaaaattgaattaggtacttgtagtaagagcatacttataatcctgggatcttcatgttgccagatattaacctcttgaagtttttcaccacaacctgggcacttttctgatttgctcacttctagccccacctttgggccccttcataagcaaacatgcaggttttccagagagctgtatgctactgaatgcagaaaatttggctcatactggcctatggactatctgctcactgccctgataactattttccaagggagtgggtgccctacctttcctacatgaagttttttgctagtcttgccctaaaaattctaggtatcccttgcttttaggataaatatgtttcactgggaccagctggaaaacgaaaaatagaattatccaactaccactttaaaattggacaaagacttttgttgttgttgttggagggggtggtaaacatcattttagcagaccaaatatacttttggtgaaaggcagcctgttgcaaagacacaacacttggacaagattttgaagccctggttgcctttactactgacttaactacagtatttgcggacttgagcaagttgcttcccttctgtgagcctcaggttattcatctttgaaatgagtataatacctgtgattataattacttatctggattctgcagagaattgaaggagataatgggtgtaaaagtactttagcgcccagcactgctccttatgaaaatgaggaaataattgagatgagtgagccattgaggcaacagtacaaaaagtgctgaaaactcactgcttaaataagcacctcttactgcttttgtggcactttgtagcaatgtttttttttttttttttgagacggagtcttgctgtcttgcccaggctggagttcagtggcacgatctcggctcactgcaacctccgcctcacaggttcaagcattctctgacttcagcctcctgaatagctggattagaggtgcgtgccaccacgcccagctaatttttgtatttttagtagagacggggtttcaccatgttgatcaggttggtctcgaactcctgacctcatgatctgcccgccttggcctcccaaaatgctaggattacagatgtgagccaccgcaccccacctcagcaatgtgtttttattctgactagaaaagtaatgtttggttttgtttggctctttgcttaatatacccataataagggtacctatttgcctttggaccattagttcaaatattattttattaatatggaattactgggctccagaagccatagtcttcttagctgctccctatccccactctcacctcaatttttttttttcacttttgtttttcttctcagggaaaggtttgaggcaaagaatgtcttcttatgatccaaaaccaagcatggtggtgatttattcaccaagagattcctaagtacctgtgtgatggacatggtagaatctttgtcctgagggagctatctagatccattccttctgatatgcagccagtagccacttgtggtaatggagcaatagaaacaacactagttcaagtggaaacgtgagatgagaagtaggaggtggagagaactaaccagaagagggtacccaaataaaccagaaatatgtatgtgttagagaaggggcctattgagcgggtggcagtggcatgtgtggcattacttgctcctgtattctctgctttttacttagttgtggctttggtggtatagtctcaaatctaagttacgtaggtaatattgttatgtatcatgttttggcaatgtagactaaatacttgctcataagagtacaggacaatgaggatagtttggttttgtttactgcatggaaaatgcaggatgtttagtaaatagattcatggcgtagtgagttcactactaaaatcagactctgagaatgggtttgatttaaatggctagtttagaagactgaatttaggccacttgattgagaaaggccattttgggtaattataaaccaccaacattgtgttttgaatgttaaagcttatatttgtcttccagttaccagaatgtaagcttcttgaggagggagagaggagttttcttaatctctgaacctgcacctttcttctgtgcctagcccagtgcctggcaccaaacaggtgctcaatcaatgttgattctatgctaccaacaaaaatgagtccatgatgtttactattcaacaaatgaatacaattttagagtaaatttttactgcttacactacatgtagattttctttttagagatttcgcaatgctgatttatttcaaaataagcttgaagctaagcgacaaagctgaatgatgatttgttttttatttatttttaaatccaaacttacaattttacatgtcattgccagaaaaatcattaaataaattatgatatgcgcatatggaatactttgcaaccattaaatcaaccattaaatactatgcaaccattaaatcaaccattaaatatgttggtatatgcaaatgtgcatataccaacatattatatagttgagtaagaaaagctagtttcaaatgagtatgttaatatcatctgactcttgcaaaaggaaaaccatacatttgaatgtacatatatgcatatgtttatatgtgcatagaaaaagctatgaggggatatacctcaagttgctaaaagtggctccacctggagagggacatggaaaggagttggctaaaaactgaggtttgttatggtatacacccctgcacagtttgattttttaaaaacaatgattataaattacttttattatttataaaaatattatttaaaattttggtactaaaaacagagctccatcaacaggtcaatggataaagaaaatgtggtacatatatacaaccgagtactattcgtcataaaaaaatgagaccctgtcatttttgcaacaaaatggatggaactggaaattattatattaagtgaaataaggcaggcacagaaaggcaaacattgcatgttctcatttaatctgtggaatctaaaaatcaaaacaattgaactaatggatatagaaagtagaaggatggtaaccaaaggctagaaaggatagttggtggggcaggggagggtgaggtgagcatgtttaatgggcacaaaaaaatagaaacaatgaataagacctattatgtgatagcacaataaggtgactatagttaataataatttaattgtacattttaaaataactaaagaggtataataggattgattgtaacacaaagaataaatgcttgagggatgtatacctcattctctataatgtgattagtacacattgcatgcttctatcaaaaattttcatataccccataaatatatacatccattgtgtactcacaaaattaaaaaaaactgtgcattaaagaaaaacaaaaataaaaaccatagttcaagttataaacaaaataaaggtaatttggaggaaaactgtcttcagttatattggatatttgggggacatttttgtatgttagttagcaaagatcacttgaaaaagaagattcttccttctatgattcaagggagcctagcaaaaaataaatgaaatgaaataaaataatacaaagagaaaagattattccataaattctgcttacttatttctggcaaacttgttgacagcacatgtgaccttttggtaaaaagacatttttatatttttagttaagtttcaaatataaattgtttgtgtttttaaaataaattaaatggatgatttcagccagatcattatgaaaacacatgagatattgggttatgcaatgactaacagtgtgtaccttttcttgatatttattcataaactggggaataaaagtacattttggcccatttactccttaaataattttatgtctcccaaggagagttgtaagttgcttgatagtaaatgctatgtattttgtaccttagtgtatatattatgggatttcagcgttagaagagctcttaaatgccgtgttcatagtccaacctgtcttctgatgcttgaaatccccttgcagtaggaaatgcaaagtagagagcagacactcaataatgtagttagtgaattatttagaaagaggcattttgagcccataatgtatgataggtacttctacatttattattttattctttgcagacctgcagaaaactgtaagaaaaaagtttatttcagattcatgtgtttatttgattaatctcttcataggtttcatttttcagctcctgtcagaaaatacagattcttataaggttcaccttttacccataagaataatagtataaaggggataatgtgaaatacaatcacttcacagactgtttcaattaaataagagctcgtagataattcagtccaccacaccccattttacagatgttgaaattgaagcccccaccaaaaggaaaagacttgttcaaagtcacacagcaagtcagtggtgaacctaattaggccccctgccttccattttagtgagattcctgtgctgatagtcatacccatatcaaatcctctttggcagttatagcttgcccacagtaatgtgtcctgaaaaatatgacaattaattaagttggagacagaaccataacctctttataaaaattttctggaaagtttacatgacagtaagtaatatataattagaaaggataattcttatttcatatttatctttttgtttcagaataataaactaagctatctctactcagtccattttaatacaaaaatatttttacccggactgagtttttatgctttttaggaactttgtatctgcctcacttagttaaaatcctagctgcactaatcacttactgtggtgggcagaattctagaatgaccctgaataccttgtccttgtatgattccttcctctttaagtaaggataaaaactgtgaatatgatatcactcccttgattaggctttgttatatggcacagttaactttaagaaaggaccaatcacacaagccatttgaaagcagagggtttgggtattttttaactggtggcagaaagccacgcagagatttgaacattgaggggaatttgaatttgatgtgccagtactaacttgaagatagaggaggctgcatggaaagtggcctttaggagtgatccctggctgacagccagtaagaaaatgagggcctcagacctacagccataaagaattctgtcagtgaacttgaacttggaagtggattcttcctctagaacttccatataagagtccagcctgattgacaccttgattttggacttgtgagaccctgagcagagaatccagttgacttctgacctaaaaaaaaagtcagataataaatgagtattgttttaaactgctaattttgtgataatttgttatgcagcaataaaaaactaatatatttaccatgcaaggcaaggcatttatcctctcatgattcagtttctttttacctgacataatggaattaatttatactgctgtgaagttgtagttgagaaacatgacttctaaagtaatagaggacatgtattattaattttagtagtattaatagtaatgatactgattctcccaggcctatacaaatcctttgatacacaaatgaatagtaaaggaacataaattgtctctaggtagactttcccacaatgcaattttaggatacagaggtcatatgcctgttattctactgtggcagagaaaatatggagcctggaaaactgttcatttgcatcacatacatcttgggagctcactctgaacctggtaccataataagctctgtagacagtataaagaggaaaggaatcagacatggtgtctgacctcaagtgtctcataacgtagtagaagaggtaaaatatgggtcacactaactctactgcaaagtaggaagtgcttgtcgccttgagattgacaaaatttggtaagagttcagaggagattgtctgtgaactgggccttgaagaatagttaggatttgaataggagaaggtgaagaaggaaggcattccagctagggagaagagcacaaacaaaagcatagataaccttgaacatcatcatatgggataattcaatagttcagtataatggaagtataagatgcataaaaataagtgtagtaggaaacaagtttaaaagtatagattggggttagtcatacaaggccttgaatttcaggctaaggagtttagacattaacatttgtttttgaacaaaggggtgaactgatcacatctgtgatttagaaagaaaattctagcaatagtgtagataagggttgatggtaaagtttggaaggtggtgaggcagaggctggagacagggagcacatttaggatagaaagatgataaagagatgatttagaagagttgttttggaaaaggagaagacagaaaatgttttagaggtgtcatagagataaaattggcatggcatggtgcaaggaggtaaagcccaatagctttgtaaggtgctgagatagattgaaatcacagagttaggaagttttagagtcaggattagtaccaagacagcttggctctagatctcatacttaacacttacagtataattctgagagggtgggtaacagcaatagtcagaggaaagaacccttttatacatgatggtacaggaacaacactggcttccaaccccacagctgctctttaacagaaggtcagaagctggggagaaatatgtgtgtgtgtgtgtgtgtgtgtgtgtgtgtgtgtgtgtgtgtgtgtatgtgccatttctgggactaaggatgggaagtagattagttgaggccactgcagtggggtctgcaagttgctagcactcacccgttccaagaggccttaaaggtgttgatctgttccctgggcatcaccacattccacaaattaatgttcctctgagagaatagggtgattcaatttcactgtgcccgaaggttacttttggggttcatgtttgttctaagtctatgctaatgatctgccaactgtctgtttgtcactttctctaacccttagcatgtataaactgatctgttgggaaatgtgtagcatttataggatggtaggatttgtaacatgcgatcacaggactgtttatatagagtccctgggaaggggagagaagagtatttctgttacaaatgtggattctttggcccctcctcaaacttactgaggttcaagaattgacatttataataagcacatatccattttcaataaacatgaaagtttcataccctcttttaatgtttgaaatcctcaaataaattagtcattggtgccagagtatcaaataattatggtacagaatgtatttctctgaatgacaccttctcccagagattctgatatatattcctctgcactcaccctgtttgataattaccagtatatggaccatttacctgaagaataagagtagggtttcctactgttgttgaaaatttgcttgactcttaacaacttgtgtgtgactgtaacaagatcacacagggtaaacaatattagcttattcaaccactggctgaagaaatttaggaaagtgaacacatttttctttacatttctctttgttctgtgagccttttatgctggaatagttttcactgcaggctgttattgtctgcctccagaggagggagttgacctagcagtggtaactggagagtgttttttgaaacctctttccaaggttagttgccaatggcatctttggaacagtgtccttcacttttgtccctcagggaccagtgtgagaatgggaactttatgatctggagctggttaagtgaagtccaaaaataattaagaaagtgtttccttccctgggaatgagttcagtaggaatctcaatgtattgtagagcactaaggactcagcctcaggcatttgcaaaggattcttccagttgcctgtgttacagaggacacagttggcatttccttttggtgttgaggggagatgtgtacatggttgtgagatgactcaccctttttgcttagatagttccactttcattgtggacagactctttggagggccagtttggcatgcacgtgtgtgttcattccatcctggagcattctttatgagaaagccatttgttgagtggtttgccattttgttttacagccactctgtgggctatgaaatggtcatccggccgctttatttgtccctaaaaaaagcagtttttccctttcttatcttcatggctgccaagcagcagaaagagtaactcagggaagccatgtgatagccttttatctgtctgttcagaaactgatgatgtattggatttgataattcatcaaatctgaggtttactggtttgtatttgcctcaaaatgggcatataatattttgtcaggtaacataatagacagatcattggcattgctttattgaagtgaattaattcaataagcctgtaagtgcctgacatgtgccaggcactgtgctaggcattctgttaacagatgagacaaatctctgtcttttaggtgttttcagtcgaacaggggagacaaatatatgagcaaattgctattttttttaaatttcatagtgtacatgagtataaggtgctgaatatgtgattgattctgagggaaaagagagataagggaaagttctcagagaaagtcaagctgagggaagaaaagcaccccagacagagggactagcatagagctatgctagtacattgagtttaagggaatggcacatacttcactgttgcttcagcagacagcaggcctgttaggttacaaagggccttggatgacatgctgaggggttttaaaattttatttaaattttaattgacaaaatataattgtatatttctgtgaggtacaatgtgacgttatgatatatgtatgcaatgtagaatgattaaatcaagctaatttgtatatctaccacctcacatacttattttttggttagaacatttaaaatttattctcttaacaactttgaaatagacaacacattattatcaactgtagtcaccatgttgtgcagatctcaaaaacttctaacaaaaactttttaccctttgaagatattgaactgttttatgaacacaatcttagaaggatttaaaaaataatttgctattcaccaagtacttcttacgtacactgtgcatgaaatgattattactttttctaatattagttttcttgattgaggcttggcaattattagtttgtatgcctttagaaggatcataagcagaggtttatcccagtaggatttgcattttagaatgatgactttgggagtaaaatacagagaagtgaaaccagagatagtgggatcattctggagtctgttgcctacactgaacagtagttgagcgaaaaaggatgggcagaatgtgttggttctgggtattgcaaattcatggcacttgagtgaaaaagtttaagccttctattggctctttgtgaatatcttcaacatgcatgactacaaatagaacacatggttttgttgttattgttgttgtgtttttgtttttttttttatttgagatggagttttgctcttcttgcccagactggagtgcaatggcacgaatttggctcaccacaacctccgcctcccaggttcaagcgattctcctgcctcagcctcctgagtagctgggattagaatcatgcgccaccacacccggctaattttgtatttttagtagaaacagggtttctccatgttggtcaggctgtcttgaactcccgacctcagatgatcctcccacctcggcctcccaaagtactgagattacgggcatgagccaccgcgcccggcccacacggtatttttgaaagaacagtgagcttggattagaacactagtgtccaggccctgctgctactacataagtaattatgaatccatagccatcttgttgctcttcttctctgagccttggtttctttagctataaaatgggaagttgaaactttctagctacttctttgagttatgagtaacaagttaggtaatacacttaaaagagaatgtgctatacaaatactggttcttaagacagctgttgttaatgtactgagtattatgcttacctcacagggttattgtgagcatcaaatgggataatggatttgtaagcattttgtttaaagtgtgattcaaatgttaagaattagtaaaaatagtaaaagaacaattcattctccatccagatgttctgtccccactgtgacttatgtgctcattcagagttgtacagaaaaacctccacttaattttcacaagctggagttccacatgtaacagaatcatatgggaccaaaaaattctctgtattggcttcttccctgccgtattttggctctgggaccaacaagacacccattttgcatgagctgcctgccaccaactttgcgctcacatctagttctgttgcccatgtgcaagctgaatttgggcccgggcccccagatctaacatgaaactcaagtttccttctgttcaaactgtccaggcataatagtcttaaagtccgatgcccagcagagccgtagatttttcactggccaaaaatcaacatgaaaccagatgtatctgtaaatctagtttcataacactttgtagtcaatggaaatacagtagcaggcagaccagaccagagtttactatttgcagtggaattaataaccacatggaaactttgcctttggtatctgcgagatggaagataaaggtgcgaattcaaagcagttcccaccttaccctctaaattccaacataaagaggccttgaatgtccttctatcttattgtatatttcattaacagaagtatgttcctagctacttagtcattctatctctattctcctttgttttaacttcagtggtgccagcttaagatgctctggctttcagctttcatggagcacgtcatgtttttaaacttatctttagggacagaaatgttaggaagatcctagttcctcatctctttgctcctgacaaggaaatttagaattgcctaaagaaaggatgtattggccaacctaataataaatcagtattagtgaatctaaagcatatttgaaaaatttgtaacatgagttgaaattcagacctgcaatgaagtgtttttaaaagatttaaaatcgaaataatataaaagaatgttaaaaacaagtaaaacatatcactagttaatcactctaccaaaattcatttttatgtttgcatatttaaccatttttattttctatatttgtccatgaacatgtgtttttatatattgtttatattaaacatggttttaatcatggcttatttcttttatgttttacttcttttcctttgacataaaatattgtattttttaaattttaattgcttcttggcatacccttccaatattggtggctatatagattgaagttaaaactaattacaatcagagaaaattaacaattcatcccttcaatctcattagtcacaagttaaatactcaatagccacatctatctagttgctactgttttgaatagtacagatataagacattttcatcaacacagaaaattcacttggaaagcattgccctggagtaaatgtgccagactgtactatatcatttttctcttgttggacatctaagttatttcttattttttaaatattttatataacttgacggtgaatatacctatgtacatagctatttgctttggctgaattatttcttagaatcaatttcaaaagtggagttattaggtcaaagagcatgagaagattttttggaacctgcagtgtattgccatagtcctctcaaaaaagtttatgtcaacttaaagtacttctagcagcatatgattgtactaatttcgctgcaatctcaacaacactggacattataagtttttattctaccctattttccattaaaagatagcttatgcttgattgactttgcattttattttattattaataatgatgtggtttccttttttctagattttatttttatttaaggcatcctttgattttaacctgattttttttctctaaaaattattctaagaaaagacaaaggtgatacgaaatatatcctgagtttttatttttttcttgcatgggatttgtatatttgcacctttgcccatttatactatgatttcttagtgtcttccctggcaattttaatgaagacttcatgtatatcaatttttccacaaatataatctttctaaaaatatgttttttccacaatataattcagacgtattctccgaaatgttggaaaaacttaagtaggcatcaaagcatttgaagatttgtttaaaggttgtttttataccagttttaaattgtaatttaagggtcataaaataggtgaaaattaaatcatttttcagtaagggggcaagaccacttaactcttggaaaatacaggaaacgtagatttctagaggccaagaaggaggtagggattattttgtaactgcccccaaccttctaacctgtaatgaaacaaacactgaaggcccttaaacatttttaggcttaattggctgtccttgtacttagggcacatctaaaaatcctgaggcaaccactcaagagaacatgcttttgttaattcaaagggagctgtcctacgagtgtccagaatcctctgtagtcttgggcctggtgcttgagagacccaaaggaaaggtcaatggaattacagcttagtgttagagctttcatgcatcacactaattaattaatgtcataaaggtctctctcctgttatgggaaaaagcagcaaataggaacttctggtagggtgcttaaagttggtttgatattttttattagcatttttaactaatacaagtaatacatgcttatggtagaatgataaaactgaaaaaaaaggtatgaaaatttagaagttctcctactcatgacctcaccccttctttcactcccagtttcactcctcagagggtaaccacagtgactagcttcttgtgtttggttcctgagattttctatgtatatatattgttagatatatgcatggtatgttttcaaaattcctgttacactataattactgttctacaacttaattttttcacttaattaatagaccttatatatgcttttccatatcggtatatatagatctatataagttttcttaaaggttgcacaactttcaattgtatggctgtcttgtaatttactttttgtttcccttactaatggatatttcatgtttccctaactcttttgatattaagagtagtgctgcaattaacatccttgagaggcagtatatatggtgtttaagatgaatggttctggagccagactactttggattgaatattggtgccaccaattccttgctgtatgaccttaggcaagttgcttaatttctttgcctcagtgtccttgtgtgaaaaaatggaggcaataatggtcactatccagtagggcttttatgaggatttagtaagttaataatgcactttaagaacttagttatttttagattaagtagtgaaggactatataattgttagtataattgtatacctttattatcatacttttgcatgtatagcaataagacaaattcttagatgtttaaccattggacataaggaatgtacgcattttaagtactggtagatattaccttttccctgccaaaaattgcaaatattggatattaactttttaaatcttagtaaatctgataagtataaataacagtttatcatcattttaagttgcctatcttaattttgtgtgaaaatgattatcttttcacatgtttttttggccatttatgtttctttccatgtgaactaactgttcctggccattgcctatttgttgttgctgttactatatggcttttcatctgtttcttattggtttatggagctctttgtatatacaggaatttagcctctatttatatgtgtgacaaatactttttccaatttatctttaaaatttgtttatgttttcctattcatcagtctaaaattatgtagttaaattcatcattgttttttcttatgactttagagtttggagatcatgcttcaaaggtctttctaggtggggatgatttaaatcatgtactggaagtatttttgccaaaaagactcacgaattatggatgttagagctaaaagggaccttagagatttcctagttcaaccaccttttcttcatacctttttaatttttctctgcagatgaaaagaagtttagtcctaaagaaagaaaagagtctaaaggttctccagtaagctaatggcaaaaatgtagactggaacttctagctcctgatgtgtatttcagtgatcattcaatttaaccagatggtttcacaaaaagagctttctactaaaaaataaaatacatacttaagcaactcagagaattttttttttatttttcagattaattttcacttagagattcatcagcatatgtactatacatgtacaaatcacctgtgtgttttggatatttagttaaacaaatgtgcaaatattttaaccaaaggagcatattcatttgtgttttattttcttaatggttttcgttatgaatgtgaaatgtgtatttaccttaacagaaattaagtatatttttggtctgacatatatgagaactgaaaagcattggcttggctgctaactgcattctcatctttctttctctgctttggcaaagtctgggattaaatctaataccttttaaactgtttgggacttcagccagagtgacctgtcttgaattcagaactgcgcagatcattccccattctaaggccctctcatgcctcctcattgcctgtaggatgagatccaagtaccttagcatagcttatgcactgtagtcacttgacctctagcacctatgcagtcttccagtcttatttacacattcctttgcacatgctgtttccccgtgtggggcaacttttttcttgcctgtctgcctgcctaagccaacttaaataaacatcatttctgtaacttctgtgaagccttttccaatctctccactccaagacgaaggtgtttctataggcatgacttctggaatggcagatcaaggatctggtggaccctctactcagtgaaacaaccgtttaactagtaaaaatgatcaatcaaccatttaaaatcttcagaaaatatcctaagggcacatagcaaaaagagaaacatttattcaagaaaagctattaagcctcagtaaaaacagcaagagtctatggcatttgagtcatgacctgttcctaatccttcccttatctccattcttcaggcaagtgcaaccaagaagatggaggcttcctctctctcaaaatcttactccatagttataatttcacccacaatggggcagaccacaagcatctcttttttttcccccagccctatattacagaatcactgttctaggaaggcatagcttagaggattggagattccttccacacccactttctacgtatgagggctttgccccagggatggtaagtcaagaatacagggatcctgcttgtgcctgcctcagctcatatataaggtaaagcttccacactaggaaaggcaaattaagaggactagggaatataccgttatccccagggtccacttgtagaacaggggtgtcattctgggagaagcaggtcactgccccacttgtggaacaggggagtcactcgtcactgtccctggttcaaattctattgcagtgacagaggttctgtcccagggaaaggcaggttgttaggatggagaactccacagttctccctgaggtgactgactttatttggaacagagcatgaagaagttcatgcctaagggcactgtcaaaaataatggagatcttggtggtgagcaattaagagtggattggtagctccatgatactagtaacaacaagcaaaacagcagaccagcatggaggataccagagaaccagacaaaggaatcactaagaagagcccttgtggaattgcactcactgctgggtgtgtggaaagttatgcatgtgtgctttactgtaccctctcaaaagcaacctaaacaggatgtggggtaggctctaaagcattcctcaagccacacatggatccatcagtaaaatgtggagggcttaaggataaaaaggcttaagtacaatctctggccctacattttctaaatgttatgccaccctgaccaaggggcaactcctacaaagccaggcaaaataataaaatcatatttgtctctagtggaatggataactatgcctaaaactgtgccctttgaaaagcaactagagagataatttctgaagtgtttgtccctacctgaatgtgtggcaaaattctaaactccctgaagtgtgaaagtggtttccaagccacatgcacatccagtagtggtaaagggtgaaaatctaactggctaagagggcttcatagcaacattaaccaaaaagtggtttatgtagtctttgcctgcttcataattccctaggcattctatgctattctgtactcagaaggcttaaagtcaggttagggaaaggaggcctatgaggttactgtgcagaggcagtgctgggaaataaatgaagttaaataaatttaggccatcgtggtttaaagaatggattgtggagataagaaggataaaggaaacccagagtcaagaaaaataaaacttttcattggtgccatgccaacccatatccgagcctgaggcaaaaggaaaaatgtgctccctgatatacacttatacaaaatatcaactaattttatttgttggactgaatagaaaaagtcaacaaaaattaaaaataaaaaaatcatgactatatttttaataagtggtttatgtaaacccagagttgaccaatgggatgccagtctcaaccataaaaacaaacaaaacattgtgagtaacaacaccagaagtctcaaagtgtcagggaaaccaatttcacagaagcagttcagccaagtcactaaacaaacaaacgactaagcaaaaaacaagaatgagtctcagaaagggtcaagtcagtatccagagttgttacaatatagtatctaaaatattgttttgaactaaaaattttgaggcatgcaaagaatgaggaaagtatgactcatacatggtattatatgaaaaaatcaacaaaaaactatccatgaggaaacaaagatgttgaaattcactagggaaagactttaaaaaccagctatttaaatatattcaaagaactgaaggaactatgtctaaaatactaaaataaagtataataacaatttcttgtcaagtagagaatgccaataaagagatagaagttataaaaaaagaaaaaaatggaaaatctggagttgaaaattataataactgaaatgaaaaattcactagaaaaggtcacaagaagatataacttggcagaagaaacaatcagcaaattagaacatagatcaatatagattattcattttgaagggtagaaagaaaaaaagaatgaagaaaactgaagattcccaaagaaatgtaggacatcttaaagacacatcattaggagaagaaaagaagggaaagaaaagagcagaaagaatattttttaaaaaatggataaaatcttccaaaatttaatgaaaaacatcaacctacacatcaaagaaaatttttttaaaacttcaagcaggaaaatgtaacgatattgatacttagatacatcatagtcaaaatattggagtcaaatataaagagaaaattttgaaattagcaagagaaaaatgaaatggaaccacaataagattaacagctgattctcatcagaaataacagagagcagaaggcagtgcaatcccatattctaaacgttgaaagaataaaaaaactgtcagtcaagaatcatatattcaacaaaactatctttaaaggtaaaaatgaaatgaagacattcctaggtaaacaaaggctgagagaatttttcattagctgacatgccttgcaagaaatactaaaagcttcctagacagtagctttaatctgcatgaaaaaaaattccaataaagggaaatttgtaaataataaaaatacatcattatatattcttttccacttaacttatttaaaatcaatttcttaaagcactatctgtaaaattgtattgttatttgacaataaaatgtaaaagaggggagtgggaattaagctaaattggagtaaggaaatggtatcacatggtaaattgaatttacagaaagaaatgaaaaaattaagtggcaaatatgaagagtaacattaaaaacttctataaattaattgtggcctcctttcttcccttagcttctgtaaaagacataagactattaaaaatgacaataattataaacacattgttttattagtaataaacatagacaaattatctacaacaattattattatacaaggagagggaatggagctgtagaggagtaaagtttttataacctactggaactaagtcagtataaatatgatgtcgattctgttaatttgagatatatgttagaagccccaaagtaatcactgagaaaatgatgcaaaaatacagttttaaaaagttaaaaacatagtttagcttatgtgtgcctagtactccattattatttttttattatattttaagttctggggtacatgtgcagaatgtgcaggtttgttacataggcatacatgtgccatggtggtttgctgcacccatcaatccgtcatatacattaggtatttctcctaatactatccctccccctgtcccctaaccccctcaacaggccctggtgtgtgatgttcccctccctgtgtccatgtgttctcattgttcaactcccacttatgagtgagaacatgcggtgtttcgttttctgttcttgtgttagtttgctgagaatgatggtttccagcttcatccatgtccttgcagaggacatgaactcatcctttttatggctgcatagtagtccatcgtgtatatgtgccacattttctttctgcttgttcccaggagaaagtggctgaagattccagagagaagctgaatgcagtttaattctttttgccataaacacgacaacccattttcctgcaagctgtgttagtttgctctcttcttggttcattcattcatttattcatagcttccataaatatttaacaaacactaattaggggccaagccatgtgctaggcacaggggataaaactgtgaacaaaacaagccccagctactcttaaggaactgatagacaaatggaccagcaaacacgctggtcctgttttgaaggcaaagcgcctggtgctcctgatctcatgagcacagagcatttagcctaagtctcatcctcctaaggcctcagaaataaggccttattttaataagtgcaagtcagtcatttgaagactaaatcatagaatcctagaaaactagtaccgggagcaaggcaaaagaatgggatgagcatgaaacatatattcagaagttgtggtgtgtaggtatataagccaagctcttttcttcacttgcttgctaagtcacttagcttttctgcctttttgtttgctctgtctggaaatggagttaatgaaatatatctacatgatagggatattgagacgattaaataagatgctgctgtcacccagtatgcccttaccctgctgtacttagaagtatatgaaattcattttctaaatttttgtatgagtgtttcatgcatgcccaccaccatggaagctaccttaagacagtgagggactttgtttaacttgtttgtactacatcctcagtctaatggtgtctggcttatggtaggcaccaaatataattttattgacagaaaggatgataatgaatgtgaaggcatttttaagtttatgaagtgttgtgcatattgttgttaattttaagctgttacgttaaagaacccctaatccaactctcttgagttttatagatatcatagaagatatatcttcccttgacatagaagcttcccttgaaggttcccttgactcatgtatttgcctcacagtgattgtgcagatcccacaagataaatttatgtgaatgtgctttatgtgcttgaagtgctccacaaatatgggttttataagatgagaaaatagagtcagggagaaaggtgactgatccaaggtcatgcaaagagttagtgtcagaatttataatggaatttcaggctcccaactcccactccagtatactaaggcagattccagagaagaaacagtggagagcaggcactgatgagggacaaagaaaagcaggctccgtctggctgcaacttgtctcttcatggcaaaaagaaactaggaaagtgctatgccagagacgacatgataactttgcagaatggaaagagcttgtttaccacattgaatactttatctgtgtttatctaacgacagttccaccagctctttaccacttgacttttgcctaattcaaaaatataccaactatgaaacattttccttctcagtttttattctagattacattttgttcaactttatcttaatgtgtagtgtagaaagagtaaggtaagagtatagcaagtggttattttccatttctactgaggacagagaaataatctaagggatttgtattagagatgaagaagtgcatggccaggacatgagagatactgtgatagaatggatattgtgaagtctttggtagtttttgaggggaaaaaagagaaggttttctttgtctgatatagtttagcaacgtcttaatttaggattcaaaagttgttcagggtccatcttggccttcaaattaagatgccctttgagagataacattgttgttttcaaactctgttctgtgacttaagaatgagaggagaaggaagaaaagaggagaaaatttgagggaaaagtgcccaagcagcgtcaaggctagacactggaaatttatcaatgaaagccacatggtggatgggaatcagatatgtgcatcaattatttgtgttccaatccatatagaagtaccgtataatgcaccaagctaataggtgctttgaaagaagaccatacaagtggagatgtgttcctattctatctagggatagagtcaggaagggcttcattgaataagtggtagcctcttgggctgagacctgagttatgagatgatgtggcaaaggagacagatggctgggggcaaggtggggtcattgaaattggaggcagtagcaatataagcaaagctacaggggcatgaaaaagcaaggttagattagtgaattgcaacagggtggtactgctggaaggtcacatggaaaagattgtgaaggtattgagataagaagctagaaataagctttgaatgccatcctagtactttgaatttgcatgctgtaagccaagtggttttcacttggtcatttaataaaattacagattctcaggtctcacctgtaacttcagattcagaagagtctgctaactgaaggtggaatcagtgttccatattgctaattagctcctcagaggattctaatatatcagtgagttatgaccactgctgtaagccataggtagttattgaaagctgctatggagaggagccacagaagcagatgttttagataggattcctctggggtcctgtgtaatttatggactggagaggatcagacaggaagcagaaagacttgaataagacagttgcagttattttggaggcaaagattctctctctctctctctgtgtgtgtgtgtgtgtgtgtaattgtaggaactatttaggcagtaaaattaacagatattagtcactgattgactgagtggatggcagtgataggtggggtgcgttgagggaagtgtattacattaagtccaggatgactcatggttttctaagttgagtcattggggattgccatccaatgtgagaaactatatagtcttatcatagttgatcttggaggtagacttgaattaaaatcttgaagccatcaattgctgtatgtgggtcttgggcagaacacttaaggtttctggacctcagttatttcttctgtaaaatgaggaaaataatgcatacctcatgcatttgttgtaaagactaaatgaggttaaagtatgtagagtgtagtttagtaactgggacgtatagtggtccagtaaacatcagctgttattattgtgctatatgttgtgatgtgtactggagtgagatggggtaggggattttttagtctctgccaatgactcctctccccatgatcaaaatcagaaaatcagtctcttatgtgttgaggagtgagacacttctcccaagtgtttaaggctaataccttgccttgttttgccttgggccagacctcactacacatctgtttaagagatcagggtaagctctgttcttggtgagtatctcaatggggctgtttttctagttcttgtagtttctttgggccaacatgaaatgtctaaccttggcttcttggttgtggattctcgtcaacatttcactgctacccaagttgtgtctgcttacatgatgctatcttccttcttttgggtttctgaagccctcagacacttggctgaacatttttcacatttcttaagctatatcatctgtgttttccctgccacagacaaagtcacaaaaggactttaagataggttttggttttttttttccccagggtttttatacattttgggtaagggcaagtggtaaatgctgcttttctgccttaaccagtagtgtctgacagaggaggtagcatgatgattgcagagctcactggactgaaagtcagatgctttacccgcctagactctagtaccaaggggaagatggagtgagatggggtaaatggggagaaattaccatttattttgagtgtgccaggccttttctcatgtattgtctaatgcatttgtcacaattctctttgggtttgaaatgtgattttcttcattttatagataaggaaacttatgggaagggaggttaggttcatcttgtgcccaactttacatggctagtgatcaataatagtgagattcaaactcagatttctctgccccaaagcctttgctttttcctcttttgacactgtaactaatgagaagatgtatttaactctgagtctcatttgcctcaactgtaaaatggagctctgtaactcttgctctgtatgacagtaaatctcctcagaccagacttatgataggggataaggatatttgtatctttgggcccctaatgtattgaaagtgcttctaagtgcctggcacatagaagggcactcaataaatatttaccacattttccagaaagagggtagctccataatgggtgagatacattttggtggctactgtagtgtttaatgcttttaccatctgttaaaatgattttggagtatagctagataactgatgatggttgttatatagattttttcataggttgcctgttccaaattctatgccgtggaagaagttaaatatccagaatttgacaggaaatattattctacaacagatccctggcgtaagaatgataacacctgtgttctagtctcagacttgcctctgaataactgtttctcctggtcaattctctgtctctatctaggcttgaaatttcccccaaatgatgaaggagttggactagtttagtggggttcagcctcgagtggccattaaaattatttggggatctttgaaaaaaattagatgcccagatttttgtcgttgttgttgttgtttttgtttgtttgttttttaattatactttaagttctgggatacatgtgcagaacatgcaggtttgttacataggtatacacgtgccatggtggtttgctgcacccatcaacccgtcatctacattaggtatttctcctaatgctatccctccctagtcccctaaccccagacaggccctggtgtgtgatgttcccctccctgtgtctatgtgctctcattgttcagctcccccttatgagtgagaacgtgcagtgtttggttttctgttcctgtgttagtttgctgagaatgatggtttccagtttcatccatgttctttcaaaggacatgaacccatccttttttatggtggcctgatattccatggtgtattgaactgctcactccagttcaattaaatcagaatacagaatgttgagaggagcatcagtattttaagaaggccccctagtgaagttcaatgtgcagccaagggtgagaaacactggactagatgattgataagggccatccaactttgatagtcaacaagagacaatgctatagagtatggtggacagagcatgggctttagagttagccaggtatgcattcagaccctggctctgttacttactagttgtgtgatcttgaagaaatcaaaatggagatacactatgtacctggcagtaatagttgtggggattaagcaccttcaccagagcttaggacataataagcccccagtaaatagcttctttaatatcagaagttcagatggaagatgtgagaaaaatattggttcagtaagatttaacaggtaaattaaaatcaagtatttgaaaacattttcctgtttctttagcaatggattccagaaacataatgtggaaatagctctcagtccttagatttgatgacattgcagaaagaaatctggctagtcgtcccatggctgattggctatgatggctagaaagccattggaaaaaaaaaattggctcacagaagacagcagatgtggcttgggaaatgcaaggacatgactgtaataaggatttgtctatccagccccatttatgagagtgattccaggagaaaaggacagatttgtattgtcagtgggatacgctgttaaaaaacacttttgctactaccactccagctgtcttggcatgtttgttggtgatgtaagctacagaaaatggaaatcaccaatagggctatagcaacctgatgcatagtgacaagtaattgttctattcatggttatgtgttgtacagagcacttgctgcatgtcaggtttgagacttgagtatgcattagggccatggacacccccatcttatctttaagtagatttcaaagtaaatatttgatgaatatgtaaaatatttagtttggtcagtcatagggctgagaacatggtggcagttacctcctagtatctgcaagcaaaaaaagttttttcttcctatagcaattgccatctcagccacttttgcagcatttctttttgctacactttgcattaaccatttgtgcacttgtcttagcctcaaacaggccatgaaagctccttgaggataggggctatgtctttttcatctttatatatgcatcatttagcagagctgtccctttataatgtactaattactgaatgaagggatgcatagatgaataaatgaatgaaaagtaggagtgacctgtcttctctctttcttcacgatggggactagtgtgtgtatataaggggataatttttgtgtcacataaaatataaccttacttagaaggcaagacttccagaatggtggaatgagaaccacccccccgcccccataaatccgccctttcatgaaagcagtgaaaacgctagcaaacgttgtgaaaattaacttttccagaactctggaaaggaaacagaggcttccaacaatctgagaagaatgtattcaagaaaaacttcggtaagctctctgatcacagtggaaataataaacaattagtaatagaaggatagttgggaaattcaccatttgtgggatataaacagtggatcaaagaagaaatcataagggaaatgagaaaatactttgagattaatgaaaatgaaaatacattgttccaaaacttacaggatacagccaagctaaagcagtacttaaagggaaatttgtaactgcgaaggcctatatcaacaaagacaaatgatctcaaatcaagaacctaaccttccaccttagactaggaaaggaacagcaaactacaaagaaagcaggaagaaagactaataaagactaaaagggaaataaatgaaataatagagtagaaaaacactagaatcaatgaaattaaacattgattctttgaagagatcaacaaaactgaaaaaaactttagtcagattgaataagaaaaaaagagagaaaattcaaattatcaaaatgagcaatgaaaatggggccatcactacctaccttaaaaagaattttcaaaggattaaaagaaaatgccattgcattagttcattctcacacaactataaaaaagctacctgagatggggtagtttatgaagaaaagcgctttaattgactcacagttccacagtctgtacagcaggcatggatcatgaggccttaggaaatttacatcaggtgaaaggctaaggggcatggaagacatgtcttcacacggcagcaggagagagagcaaagagggaagtgccacacacttttaaaccatcagctctcatgacaactcactcactatcatgagaacagcaaggggaaaatctgccctcatgatccaattacttcctaccaggtcccttccccaacactggaaattacaattcaacgtgcgatttggatggtgtgacacagagcaaaaccatatcaaccatactgtatgccaaaaaattagatgacctagatgaaatggacaaatactcagaaaaacacaaactatctaaagtgaccagtgaagaaacagaaaatctgagtagtcctgtaacaagtcctgtaacaaaactggattagtaattaagaaacttcccacaaagaaaagcccaggttcagtcttcactggtgaatactatcaaatatttaaggaagatttaatccttcacaaattatttcaaaacttggaagaggctggaaccctttccaactaattctgcaaagtcagcattaccctgatgccaaaaccaaagatatgacacaaaaataaaactgcaggctaatatcacatttgaatatagataactttctaaaaatctcaacaaaatgctagcaaacagaattcagcaacaaataaaaagggttataaagggtgaccaagtaggatttatctctggaatgtaaattaacattcaaaaacctaagaataggaggaaactttcttaactttgtaatggacatctctgaaaaacacacagctaacatcatactaaatagggaaagattgaaatttttccttgtaagatcaggaacaagacaaggatgactgttctcaccatttcaatttaccattgtattgtagattcaagtcaaggcaattaggcaaaaaaaaaaaaaaaaaaaaaaaaaaaaaagaaagaggtaaaaggcacccatattggaaaggaagaggtgaaaatatctatattcacagatgacatgatcttatacaaagaaaaccttaaggaatccatgataaactattaaaacgagtaaacgagttcagcaaggtttcagaatacaagattaatgtgcaaaaatcaattgtatttctgtacactagcaatgagcaatctgaaaatgagattaagaaaacagttcactcacaatataatcaaaataccagaatacttaaaaataaatttaacaaaagaagcgtaagacttgtatgctgcaaaccacaaaacactgtggaaagtaattaaaaatctaaataaatagaaaaacatcccttgttcatgtactagaggactcaatattgtcaagatggaaatactccccaaagattgaaggaaatccctatcaaaatactggctgttttcttagcagaaaatgaaaatctgaccctaaaattaatatttaaatacatggaacctaggataaccaaaataatattgagaaagaaaaacaaagtcggcgtacccatgcttcctgattccaaaccttattacaaagcagtggtaatcaagagtgtatggtattggcataaggacaaacagatcaataaatggaatactattgagaatccaaaagttaactcttacatttaagaccaattgactttcaaaagtgttgctaagacatttcaatgaggaaagaatagtcttttcaataaattgtactggaaaaattggatatccacatgaaaataaaagattttggaccacttcaaacctgcaaaaaaaataaaatgatctcatggtgtatcatggatctaaatgctatagagctaagatgataaatctcagaagaaaatatcaaagtaaatctttatgaccttgaagtaggcaatggttttttggctataacaccaaaagcacaagcaataagagaaaaaaaatttttttaaaaaaacccttgattattttattaaaattttgttgtgggtacaaagtaggtgtgtatatttatggggtatatgagatattttgatacaggcatacaatgttcaatgatcatattaggataaatgaagtatccagtacctcaagcatttatcatttgtgttacaaacaatccaattatactcttttagttatttttaaatgtacagtacattattattgtagtcattcccttgtgctatcaaatactatatgttattcattctatctaactatattattgtacccattaaccatccccactcccctgcctcccagctacacttcgtagcatctggtaaccatgatttcctcttatctccatgagttcagtagtttcagctcatggagatagacagaactaattttattagctcccacaaattagctcccatgtcagaacatgtaaagtttgtctttctgtgccaggtttatttcacataacataacgaactctagttccaaccatgttggtgcaaatgacaggctctctcttttttttttttttttttttttttgagatggagtctggctgtctcccaggctggactgcagtggtgcaatctcagctcactgcaagctccgcctcccaggttcatgccattctcctgcctcagcctcctgagtagctgggactacaggcacccgccaccatgcccgactaattttatatatatatatatatatatatatttattattattatactttaagttttagggtacatgtgcacaatgtgcaggttagttacatatgtatacatgtgccatgcaggtgcgctgcacccactaactcatcatctagcattaggtatatctcccaatgctatccctcccccctcccccaccccacaacattccccagagtgtgatgttccccttcctctgtccatgtgttctcattgttcaattcccacctatgagtgagaacatgcggtgtttggttttttgttcttgcgatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaataatgccgcaatgaacatacgtgtgcatgtgtctttatagcagcatgatttatagtcctttgggtatatacccagtaatgggatggctggttcaaatggtatttctagttctagatccctgaggaatcaccacactgacttccacaagggttgaactagtttacagtcccaccaacagtgtcaaagtgttcctatttctccacatcctctccagcacctgttgtttcctgactttttaatgattgccattctaactggcgtgagatgatatctcattgtggttttgatttgcatttctctgatggccagtgatggtgagcattttttcatgtgttttttgggtgcataaatgtcttctttttagaagtgtctgttcatatccttcgcccactttttgatggggtcgtttgtttttttcttgtaaatttgtttgagttcattgtagattctggatattagccctttgtcagatgagtacgttgcgaaaattttctctcattttgtaggttgcctgttcaatctgatggtagtttcttttgctgtgcagaagctctttagttgaattagatcccatttgtcaattttgacttttggtgttttagacatgcttttggtgttttagacatgaagtccttgcccatgcctatgtcctgaatggtaatgcctaggttttcttctagggtttttatggttttaggtctaacgtttaagtctttaatccatctcgaattgatttttgtataaggtgtaaggaagggatccagtttcagctttctacatatggctagccagtttttccagcaccatttattaaatagggaatccttgccccattgcttatttttgtcaggtttgtcaaagatcagatagttgtagatatgcggcattatttctgagggctctgttctgtttcattgatctatatctctcttttggtaccagtaccatgctgttttgattactgtagccttgtagtatagttagaagtcagggagtgtgatgcctccagctttgttcttttggcttaggattgacttggggatgtgggctcttttttggttccatatgaactttaaagtagttttttccaattctgtgaagaaagtcatcagtagcttgatggggatggcattgaatctataaattaccttgggcagtatggccattttcacgatattgattcttcctacccatgagcatggaatgttcttccatttgtttgtatcctcttttatttccttgagcagtggtttgtagttctccttgaagaggtccttcacatcccttgaaagttggattcctaggtattttattctctttgaagcaattgtgaatgggagttcactcatgatttggctctctgtttgtctgttattggtgtataagaatgctgtgatttttgtacattgattttgtatcctgagactttgctgaagttgcttatcagcttaaggagattttgggctgagacaacggggttttctagatatacaatcatgtcatctgcaaacagggacaatttgacttcctcttttcctaattgaataccctttatttccttcttctgcctaattgccctggccagaacttccaacactatgttgaataggagtggtgagagagggcatccctgtcttgtgccagttttcaaagagaatgcttccagtttttgaccattcagtatgttattggctgtgggtttgtcatagatagctcttattattttaaaatacggcccatcaatacctaatttattgagagtttttagcatgaagcgttattgaattttgtcaaaggccttttctgcatctattgagataatcatgtggtttttgtctttggttctgtttatatgctggattacatttattgatttgcgtatattgaaccagccttgcatcccaaggatgaagcccacttgatcatggtggataagctttttgatgtgctgctggattccgtttgccagtattttattgaggatttttgcatcaatgttcatcaagcatattggtctaaaattctcttttttggttgtgtctctgcccgtctttggtatcaggatgatgctggcctcataaaatgagttagggaggattccctctttttctattgattggaatagtttcagaaggaatggtaccagttcctccttgtacctctgatagaattcggctgtgaatccatctggtcctggactctttttggttggtaagctattgattattgccacaatttcagatcctgttattggtctattcagagattcaacttcttcctggtttagtcttgggagggtgtatgtgtcaaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcagtctatcaattttgttgatcctttcaaaaaaccacctcctggattcattaattttttgaagggttttttgtgtctctatttcctttagttctgctctgattttagttatttcttgccttctgctagcttttgaatgtgtttgctcttgcttttctagttcttttaattgtgatgttagggtgtcaattttggatctttcctgctttctcttgcgggcatttagtgctataaatttccctctacacactgctttgaatgtgtcccagagattctggtatgttgtgtctttgttctctttggtttcaaagaacatctttatttctgccttcatttcgttatgtacccagtagtcattcaggagcaggttgttcagtttccatgtagttgagcggttttgagtgagattcttaatactgagttctagtttgattgcacggtggtctgagagatagtttgttataatttctgttcttttacatttgctgaggagagctttacttccaactatgtggtcaattttggaataggtgtggtgtggtgctgaaaaaaatgtatattctgttgatttggggtagagagttctgtagatgtctattaggtctgcttggtgcagagctgagttcaattcctgggtatccttgttaactttctgtctcgttgatctgtctaatgttgacagtggggtgttaaagtctcccattattaatgtgtgagagtctaagtctctttgtaggtcactaaggacttgctttatgaatctgggtgctcctgtattgggtgcatatatatttaggatacttagctcttcttgttgaattgatccctttaccattatgtaatggccttctttgtctcttttgatctttgttggtttaaagtctgttttatcagagactagaattgtaacccctgccttttttttgttttccatttgcttggtagatcttcctccatccttttattttgagcctatgtgtgtctctgcatatgagatgggtttcctgaatacagcacactgatgggtcttgactctttatccaatttgccagtctgtgtcttttaattggagcatttagtccatttacatttaaagttaatattgttatgtgtgaattttatcctgtcattatgattttagctggttattttgctcgttagttgatgcagtttcttcctagtctcgatggtctttacattttggcatgattttgcagcggctggtaccggtcgttcctttccatgtttagtgcttccttcaggacctcttttagggcaggcctggtggtgacaaaatctctcggcatttgcttgtctgtaaaggattttatttctccttcacttatgaagcttagtttggctggatatgaaattctgggttgaaaattcttttctttatgaatgttgaatattggcccctactctcttctggcttgtaaagtttctgccgagagatctgctgttagtctgatgggcttccctttgagggtaacctgacctttctctctggctgcccttaacattttttccttcatttcaacttttttgaatctgacaattatgtgtcttggagttgctcttctcaaggagtatctttgtggcattctctgtatttcctgaatctgaatgttggcctgccttgctagactggggaggttctcctggataatatcctgcagagtgttttccaacttggttccattctccccgtcactttcaggtacaccaatcagacatagatttggtcttttcccatagtcccatatttcttggaggctttgctcgtttctttttattcttttttctctaaagttcccttctcacttcatttcattcatttcatcttccatcgctgataccctttcttccagttgatcgcattggctcctgaggtttctgcattcttcacgtagttctcgagccttagttttcagctccatcagctcctttaagcacttctctgtattggttattctagttatacattcttctaaatttttttcaaagttttcaacttctttgcctttggtttgaatgtcctcccatagcttggagtaatttgattgtctgaagccttcttctctcatctcatcaaagtcattctctgtccagctttgttccgttgctggtgaggaactgcgttcctttggaggaggagaggcgctctgctttttagtgtttccagtttttctgctctgtttttccccatctttgtggttttatctacttttggtgtttgatgatggtgatgtacagatgggtttttggtgtggatgtcctttctgttttttagttttccttctaagagacaggaccctcagctgcaggtctgttggagtacccggccgtgtgaggtgtcagtctgcccctgctggggggtgcctcccagttaggctgctcaggggtcaggggtcagggacccacttgaggaggcagtctgcccattctcagatctccagctgcgtgctgggagaaccactgctctcttcaaagctgtccaacagggacatttaagtctgcagaggttactgctgtctttttgtttgtctatgccctgcccccagaggtgaagcctatagaggcaggcaggcctccttgagctgtggtgggctccacccagttcgagcttcccagctgctttgtttacctaagcaagcctgggcaatggcaggtgcccctcccccagcctcgctgccaccttgcagtttgatctcagactgctgtgctagcaataagcaagactccatgggcgtaggaccctctgagccatgtgcgggatataatctcctggtgcgccgttttttaagcccgtcagaaaaacgcagtatttgggtgggagtgacccaattttccaggtgccgtctgtcacccctttctttgactaggaatgggaactccctgaccccttgcgcttcccgagtgaggcaatgcctcgccctgcttcggctcacacacggtgcgctgcacccactgacctgcgcccactgtctggcactccctagtgagatgagcccgctacctcagatggaaatgcagaaatcacccgtcttctgcttcgctcatgctgggagctgtagacctgagctgttcctattcggccatcttggctccagaaaaaaaaattgttaaattggacttcatcaaatttgaaatttttgtgctgcaaatgataccatcaagaaagtgaaaatctcacccacagaatgagagaaagtatttgcaaatcatatatctgataagggtattgaatttagaatatataaagaactcttgcaactcaatataaaaagacaacccaattttaaaatgggcaaagtatttgaatagaaatttcttgatagaagatatacaaatttaaaaatgctcaacatcattagtcattagggaaatgcagatcaaaaccaaattgagataccggtttacacctattaagatggctatagaataaaagaacaaataacaagtattggctttaatgtggaggagccagaacccttatatattgctggtaaaatgtaaagtcatgcagccctttgaaatacagtctgcaagtctttaaaaaattactatttgttatttggtttttcttcacttttaatttaggttcagaggtacatatgcaggtttgctatatagctaaattgtgtgtcacaggagtttagtgtacacattatttcatcacccaggtaataagcatggtacccaataggtagtttttctatcctcaccctcctcctaccctccaccatcaagtaggccctggtgcctcttgttcttttctttgtgttcatatgtactcaatatttagcttccacttatcagtgagaacatgtggtatttggttttctgttcctgctttagtttgcttaggatactggcctccagattcatccacgttgctgcaaaggacatgatctcattctttttgcatagtatactatggtgtacatgtatcaaaaatgttactgtttgacctagtaattctattccaaggtaaatactcaagagaaatgaaaacatgtccacacaaatacttgtacacaaatgttcattgcagcattatttataatagccaaagagtggacgacaaatgtcttccaaatgtgggctccaaatgtccaccaactgataaatggaaaaacaaaatgtggtatatccatgccatggtttatctgtcaataataagaaatgaagtactcatacatgctccaacatggatgaaccttgaaaacattatgctaggtgaaaaaagcaactcacaaaagactacactgtatgattttatttgtattaaatgtccataaaagaaaaatatttagagatagaaaggaaattagtttttccagggtctgggaggagacagtatgaggagtggctgctaatgggtacaggatttctttttggagtgatataattgctctaaaattagtttgcagtaatagatgtgagtatgctaaaatgggtgaattttatagtatgtgaaatataactcagtaagcccattaaaaacaacctaattaaattaaaaccaagctataacagaaatattatatggctttggcagtttagaatagtgggaaaatatggagtaagggtggggaaatagtcccaagtataattctggttttgtcactactagtgtatggacttggacaagtcatttgctttctctaagtatcagtttgcatatatgcaaaatagaggtaatgatacctacctcagtggtaccttttcaaaaccttgttcttcctcatctctcctctaccactttctcataatattattacagtaataaccatttattaagcactgtgtccgcagtggtgtggggctgctttacctccacaacttcactgaatcctcactgcagtcttgtgggatctttatttctttgcccattttacatgtaaataaattgaagtcaaatgagttgttcaaggtccttctgttagcaagtggcagagatggacatgaaaactagatcttctacctatgtgtctttccacttcaactaaagaatttattaaagagaattgaaaagctatgaactaaatttcggtaatacttttaatagtaaacattgctgccctcgtgaatgaacacacactaaatttcaaatctcacggtggcagggaataaagatgctacctatcttaagccattacttcaccaacttctccaccaaaatattccttgtaaccacaaataagtaagcacaatagatctataaggagagaataattgtgaactctgattttatcttaaaaagtcatgtagggatgtcatgttccacaatgtgattaataaaatatattttgttactaaacacaaggaaaaatattatgttccataaagatgtttggtggttgcctcgacctcttttagtttgaaaagtaggtatgtatgagaaagatatgtgtttacatgtttacccttgccttctctctgtctcttcccctctctctccctccctccccaacccctatgccctacacccccgcaacccccacatgtatttacctttctctaaaagctctgcatagccaagaaaagtgctcttttttatttttaggatattagatatttcattttcttatggtaagacaaaagattaaggcaaccaagacttacaatgtgcctaccatgtggcaggcacagaggcaagggcttttacatgttatttaatgtaattgtaattctcacaaaagccgtctagagttgaaaatatttccaactctaaatgaggcaaatggagcacagagagccttaattatttcacccaaagttcagtggtagaggcaggattccaacccaggtctggtgggctccaaatccttgttgggttgccattcctcttgctaacaaataaaactggtctgtgacttttgcatttcaccccgcttccacagtcactggtgggacttacttaagttaatcagattcttcaaagtatccccaagtcctcctttgaaaagaaagttgggggacaggaggaggagcagaggagaggagataaaaaggaaaggagtcagggagagagagagagagagagaaacctggtgatctcagctgggtgccaaggtttcctaagcccaagttccccatggttgagcctgtattgtcaggccaacagcttctagtaatccacttttatttaattaatagtgaaactgttgaagaattgcaagtggtgttctggttcagaaaccttccgttctatggggcactgcttttgcttcagattcataaaaccaaatgctctgcctcaagataataagtgaacgtgtaaccctcgggaggtaagaaaaaacacaatgtcacgtgcaaattctgcacttgttctcaaagcaaacctctcctgtgtttgcaattaggatgttatctaggagcatattcaaaacttttgaggtttttattttagtttttctttcattatgtgctgttttagtaatatcaaagaatacatgtaatatataatttatatgtcataacaataaaattaatgttgatgagcccagattaaagaatcaacaacattaacatcatgattgcatcaaccctattagaatggaagctctgtgaaggcatggatttttgtccattttgttcactgctatatccccaggacctagaggagtgtcagccacataataggagcttagtcaatattttaaaaataagagcataaatctacttatatcctctttcctcttaccatcactcccagcctcccctcagaggtaaccactatcctatatttgggctttattattcccttgcattttgataagttttcacatgtatattcccaaataatatattgcttgcttttgcttctttttaaactttatataatggaatcatattgtatgtatcctattgtgaattatgtcttttacacaacattagtatttgagattcaactatgtgtagctcgattccattccttttcattgctgattgtagtttattggatatgtgtgccataaattatttttctcctgtcagttaatgtttatcatttatgctttaataaacaaaactgctatgactgttcctgcatgtgcctcctagtacatatgtgaccaactttctctaggatataagcctgagagagggactgcagttggaatttacatttccaaagcccaaagtttagctcatgagtcagagctgcaatgtgccctttgtccacactaggtcaggatcagtgggagtgctacccaaaatattttgctagctggggagtcagggagaagcagagactgacctagtgaggccaggaggcactatctcaggtctctagtcaaaatgggttgcaattagtaaaagtccagattctgaatccccttcactatttatcttcctcttcctcctttacagttatttttgttcaaggtgcactttattaaactcatgcctaacaaacaaaactctaatgaatattttgtctttcattgattgtaaattcaattaattagattgcttgaaaaaattttaactgtattttcactttagtatggatgaaaatttcgatttctttaaaaaacattttttaataataacacaacataaagtctaccctcataacaaaatttaagggcacaacaccatattgttttttttttattttattattattatactttaagttttagggtacatgtgcacaacgtgcaggtttgttgcatatgtatacatgtgccatgttggtgtgctgcacccattaactcgtcatttagcattaggtatatctcctaatgctatccctcccccctccccccaccccacaacagtccccagtgtgtgatgttccccttcctgtgtccatgtgttctcaatgttcagttcccacctatgagtgagaacatgtggtgtttggttttttgtccttgccatagtttgctgaggatgatggtttccagcttcatccatgtccctacaaaggacatgaactcatccttttttatggctgcatagtattccacggtgtatatgtgccacattttcttaatccagtctatcattgttggacatttgggttggttccaagtctttgctattgtgaatagtgccgcaataaacatacgtgtgcatgacaacaccatattgttaactgtaggcacaatgttgtacagcagacgtctagaactttttcttcaggcttaactgaaactttatagccattgaacagcaacactccatttccgtttcttaaaggtcctttacaaaatgagctttctgcgtgtttccattttgtttatctgataacttttttttctttttttattatactttaagttctggggtacatgtgcagaatgtacaggtttgttacataggtacacacatgccagggtgtttggctgcacctatcaacctgtcatctacattagatatttctcctaatgctattccctcccttgcccctcacccctcactggccccagtgtgtgatgttccctagcctgtgtccaagtgttctcattgttcaactcccacttttgagtgagaacatgcagtgtttgattttcttttcttgtgttagtttgctgagaatgatggtttccagcttcatccatgtccctgcaaaggacatgaactcttccttttatatggctgcacaatattccatggtgtatatgtgccacaatttctttatccaatctatcattgatgggcatttcagttgttccaagtctttgctattgtgaatagtgccacagtagacataagtgtgcatgtgtctttatggtagaatgatttataatcctttgtttatatacccagtaatagaaatgcttggtcaaatggtatttctagttctagatccttgaggaattgccacactgtcttccacaatggttgaactaatttacactcccaccaacaatgtaaaagcgttcctatttcttcacatcctctccagcacctgttgtttcctgactttttaatgatcacgattctaactggcgtgagatggtatttcattgtggttttgatttgcatttctctaatgaccagtgatgatgagctttttttcatgtttgttgaccgcataaatgtcttcttttgagaagtgcctgttcatttccttcacccactttttgatggggttgtttgtctttttcttgtaaatttgtttaagttcattgcacattctggatattaattaacctttcgtcagatggatagactgcagaaattttctcccattctgtaggttgcttgttcactctgatgatcgtttcttttgctgtgcagaagctcttgagtttaattagatcacatttgtcaatcttggctcttgttgccattgcttttggtgttttagtcatgtagtctttgcccatgcctatgtcctgaatggtattgcctaggttttcttctagggttttcatggttttaggtcttacgtgactcatcttgatttaatttttgtgtaaggtgtaaggaaggggtccagtttcagttttctgcatatggctagctagttttcccaacaccatttattaaatagggaatcctttccccattgcttgtctttgtcaggtttgtcaaagattagatggttgtagatgtgtggtattatttctgagacctctgttctgttccattggtctatatatctgttttggtaccagtaccgtgctattttggttactgtagccttgtagtatagtttgaagtcaggtagcatgatgcctccagctttgtgcttttggcttagaattgccttggctatgcaggctctttattggttccatatgaaatttaaagtagtttttttataattctgcgaagaaagtcattggcagcttgatggggttagtattgaatctgtaaaacactttgggcagtttggccattttcatgataatgattcttcctatccatgagcatggaatggttttccatttatttttgtcttctcttatttccttgagcagtggtttgtaattctccttgaagaggtccttcacatcccttgtaagttggattcctacatattttattctgtttgtagcaattgtgaatgggagttcactcatgatttggctctctgtttgtctgttattggtgtataggaatgcttgtgattttcgcacactgattttgtatcctgagactttgctgaagttgcttgtcagcttaaggtgattttgggctgagagaatggggttttctgaatatacattcatgtcatctgcaaacagagacaatttgacttcctgttttcctatttgaatatcctttattgctttctctttcctgattgccctggccagaacttccaatactatgttgaataggggtggtgagagacggcatccttgtcttgttctggttttcaaagggagtgcttccagtttttgaccattcagtatgatattgggtgtgggtttgtcataaatagctcttattattttgagatatattccatcaatacctagtttattgagagtttgagcatgaagcagtgttgtattttgtcgaaggccttttctgcatctattgagataatcatatggttttgtcattggttctgttgatgtgatggattatgtttattgatttgtgtatgttgaaccagccttgcatcccaggggtgaagcggacttgatcgtggtggataagctttttgatgtgctgctggattgggtttgccagtatttttttattgaggatttttgcactgatgttcatcagggttattggcctgacgttttctttttttgttgtgtctctgccaggttttggtatcaggatgatgctggcccataaaatgagttagggaggattccttctttttctgttgtttggaatagtttcggaaggaatggtaccagctcctctttgtacatctggtagaattcatctgtgaatccttctggttctggactttttttggttggtaggctattaattacttcctcaatttcagaacttgttatagttctattcaggtatttgacttcctgctttaggcttgggagggtatatgcgttcaggaatttatctatttcttctagattttctattttatttgccccagaggtgtttatagtattctctgatggtaatttgtatttctgtgggatccgtggtgatatcccctttatcattttttattgcatctgtgattcttctctcttttcttctttagtagtctggctagtggtctatctacaaaatagactgtttatctgatatttattttgtaattatctaataataaccatcattatcatcatcagcattatcattatcatctcctttacccatacatacatttgtgtctttcaaataataatcccatctttgaagtgcatcctcatctttagcagtctgcactctgctttcttatatcatttattatcttattttataattatttatttccagtccttcttctctaacagatagtagtttcttagggccaaggaaatatctcgatcaccactatatccccagcacctaaccctgtgcctggtccatagggccagatgctaagagttgagttgaaccattgtacctaatcttaaccttcattagcacaacatggtttgtcagtggttaagaatctacactttggagtcagactcacccaggatggaatcctggcattgccacttattattaatagatgcgtgatcttgaacaagtttacttaattgttctgagcatcagtttcctcttctgcaatatagggatgatacacagctacctggtaggttgttgggaaaattaaatgggatgatatgtatgaaatggcctggcatatagagtgcctaaatacatgttcttctgattctatttggacagtttgtgttagtaacagaagtcaaaaaggtggagaaaggagaaaggtacttgtgaaaattttctatttcttctccatgtttcattcaggactgaggaagggggcacagtttttacccaaggaaatgacatttttagccaaaagaaatgatcttagcatttagctgaattatatattggaagtaagctccttccatgtggaacttatggccttgctagccttggtttgttggaagtgctcttgctggctttctagttagggtagggaaaggaaggcttgtggggaatgaagataggccatgatatcaagccactgggtttgcaaatcagtagaattttttattgctttctgttgtacttgggacttgaataaaggctgatatttgtgtcttgctggtaaagtgcttgtaaagtgagtgaaagttttctttgctcttgtcctgacatagctgttcacttggggttgaggggaggataacctttcatgttttttttttttcttcattctgatgactgtgctgaacattcaaaccaaaaggccattggtggaaagtaaaggtgagtggtgagaagacaatagggtaatggaaactgtgttggacttgtaatcaaattgtcctgcacttcccctctccaagtcttaacgtttttcatctgtacagtggatattaaaatgagaaaataagcttgtcttcacagagttttcgttaggtgttgacacaacaaacaggctcccattagggctcattttccttcattccttagtaaggaagaagtgcttataaaatatagcagttgtgctcttgtgaatgatagcatgggcagttgtcatctccctgaagcagatgtaacccagaatgtcacttgagttttgtttaatgcttaggcataagacataggaatgacaaaagctgacctttgggtagtgagaacaatgttccattttgttcaaacttgaattttttactataggagactgagaattaaccttccatgaaggttttaggattggctttctggcccttctccttcatatccacctgaaagagcttgggcgcagaagttcttgcagaaaggcagttagacaaggtgacttctgaagctccagtggccaagtattttgatggtagcctaaaagatgtccagaatcattgtacatcattttttcaacagaagcttcaggcatagggattatgcttggtactttatgttgtggaatggaatctggcggatgtccatgtgatctatagaaacacctaaggaaagtgaagaaatgagggaaaaaaaagaacaagacttttatgataatactaatcacgatccttgtgtatttattccaatggcattttatccattatctgatttatattaccactcacagcagcagctcaataggatgggagatattatctctattttatagatgagatttgaggctcacgaagctaaagcaaggaacatcaaatcactttgatatttggtctggttttgttataggtctccctttggatgaggtaaagttacaaacctgggttcatatcatttaattagtctgaaaatgttgcctggacaccaccttcagttagatatcttaacctcaggcttcctgccttcattgctcccgcatatagacatagactatgagattggctaatcccagagaacttccctaatcccttggcaagatccaaaaaggctcagtcacaccctacaaccatcatctttaggagaagtctcagaaaattcagcttcacactaactaacttgagcaatgaataatagtcatttatgcctgcaggttaatgctgaagacctgagacttcacttgcctatttctgccattcagtgacatgtgttgcattggttttttgtgtctttccagtttggagactgccagggaccatgttttgcccattgactattactttccaccccagaagacctgcctgatctgtggagatgaagcttctgggtgtcactatggagctctcacatgtggaagctgcaaggtcttcttcaaaagagccgctgaaggtaaagggtcttgcacatgcacttctctttccctttctcctttaccttccagagagagacactaacctttcagggcccaggattttatcatctcagaaatagagtcattggcaaggccctatcaaataacttaggagcctaaggaagcaaatttttgtacttgctagttccctggtttcagcagccttgtttgtacaggcaatttaggcagtgaaggtggtcccagctggggcttggggctcagtgggtcctagaaatgaaagaaaaattaatgatttgaaaagatttaatttcctcccttcttgttttctactctgctggctagtaaaggaaaaatttgtccttattagagaggttagaagtggagaaaccccaactgagtccccagcctgttccttgggatgaatatgagactgttccttagcaaaggcttcctggcctcggccccagaaagggagtgttctcactcttcagcagactatcagtctctgcacctgctccctcctgttgtggcctccttgggacctgtctttgcattaatagttcctaggtaggtaagaactcagagtgaagaaacacatttattctcctctccagagacctgatctcaaagcctgtccattagtccctaaccttaatctaaggtagcatcttatatctggctaaattggctcaagccctagctccttagttttatttagcttagaacaactcatgtctgctcaacctctagaggcgctcagcccacattctgcagtagaaactcccattttcaggcctcttatatacggtaatgtctccttcctctaaccacccagggcttaagcttcctgcttatccacttcaccctgtattgagggctttcttctcaaagagacattgatgaggagcccctagagagagatgctgtgctctgggaccagaccccttgttaaacaccagtattcacctctgccccaactttccccaaagaggtacttcctgccaaggcctttctctttcctctcactggctggaagtgttgagttccacttcagaaccagaacagagaacctttccttctataagagctataaaccttgagaacagtcttaaaacataggtatgtaggccacaccattcaccacgaatgtactgatactcatcagaatatggaagaagcaccagagagtttgaagcatctagagaaaaggtagaaagagaatgccctttaactgacctcctcagtgatagccaatcacaatgatgagtgttgattcatcattttggctaggtggcagaaatatctataaaacagaagctgccatgttgttttcttccagtcctcagggcctacaagaaggcagctatcatttggtattactgaaaacatgccccatgttcagctcatacccccaaattacccattgctactgtttatgctgggctaatatgaagcccagggccctaatgtctaggtctaggcagtaaggcctagagcagtgcctaaagagcctgagagcagtgccttcctttcttcagagtactcatgaaaggatggctgtcagaaaaggaaatgaggatgggttccagagacttcagaccaccccaacttccccagtgagaccctggcacctccccataccctctcacctagcgggccctgtctatagagcagagaatgaaacagagcactcatctagaggtagtgtgtcagcaagcccaggcactgcaccacagtaatagcagccatatcagatgggaaaggagttcaagtgaacaaacaagcaaattcaatagtcagatagattagattatacttgatgcttcctctgagttttacaaatatgggtcactaaattgttattttcagaaaacaggggaaatgctcaatcacattgtgaaagggaagattttgctgtcatatcatacatcccacatgggagctttctgcagaagttagagctgaaggagggaggcaggcagaagggcaactggcagggctgcctgggaggagctctgcaatgaggtggatcctgtgccatttgagaacagggaagaaaagaaatgaggttttggggagggaatcacccaactcacagaacacacagaaatccagcaaggtttcaaaacgctctacaccttagagtctgttaagttagggaaactctgtgagctcatagggccaaatgcacttgcctgcttgaaatatgaaaaatcagcaatggattccttgaaaaacaatgaaaagggaaccttctgagccccttggttattttgacatatggaccatagatttcagtcctgagccctttgaaggtaggagaaggtggtttagaaaacacacacacacacgcacacaaacacacaccagaatgaagcaaaaaaaaaattactggtgttttctttctcctcccatctgtgaagctgttggattgattttactgccatcattatccctgtttgaaggcagggggctgtcttattacccaaagaggacatttattgatttggttttctttttccatttttacaatgcatctttatcgcccatatggcctttctggaggtggttttcagtctggcttgttgaaacatcaaattatacctgtcttagagaaaatagaaacaaaaatctttctcttccttacttgcttgttgtagtcagttaactcggactgagtattcagagtcttgattatcacttaattcatagtttcataaatctctggaatgggcataggtacaggacttaaaagcctggcatctcagacagaaatatgtttttagctttggtggtttataacagatgggacttttaggctgtcattggtgcagggctcagcacagagtcagttgtaatctggacaggttttgttgttgaggaagagtgggaagagggagtcctacattttctccttgtcagtaatgttggagaattggggtgagggtgaggctgggcagggagggtctgcatagaaaaaagggtgcggtgagaaaaaataatgctactaagccatgagggtaaaatgaccaaattctggttgagagaaacttggtcaaagtgtgtatggggagagaaagttggtcaaagtctgtgtctgagtgcttggtgggatgaactctgggttagaaacaggcatggagggaaatagttggtttatggagtgggtaggatgagtggggtggtgaaagggaaggcattttggatgctaagagaccaggaagtcaaagcaaggcaatacacataaacagaggtaagggctcagagaggttttagttgtgtagacttggataagaaattttcccttttggacctcagttttccttgtttgtaaaacaacggacttgaactagatattttaaaatgtgcttccagcttagacattttgtgaccgttctacaaattacaaacataatcatcatcatttcagcaaactcacatgtatttatacctgcataagtttttggtcttgctttcctagaaggtgactaatcccagatcctaatcaattaaagaagcaatcttcagatggggatagagccagctgagagagtgtactatggatggagtgagttaaaactcaggactcagattttctccttgtgatcattgctgggtaacttcctttcttttctattttctcatctggaaaatcaggatatgaatccccatctctacctcattatgtttcaaagagggttaattaatccatcatgtgcattatgtgctcaagaatttactatttttcagacattttctagtaaaacattgaagattatatgtccatttgttttgtacacatggagtgctgtttggtacacatcataaaattgaaactgtagtttacattctgaactcaaagaattacaccatcctcactgatgtttacaataggtcccaatttagtttctttagcaaattttatgtaagtatggctttgattctctctctcactccaggtttttgttagggaagaaatgcaagtgaaccctcattgaactctttctgtcctttaaatccattctttcccacctcaactcatgtggaattgaatgttgcctctagtttggagtctagcagagagtttttggtgcatatcagtgtccccttcactccctgacttttcaagtaacatttcccagaggcaaattaactctgctaagaggatctgcttgcagcttcaacagagccttcatcaggtatctttggccaaggagttgactgatcctgactttgcgagtcctagagatcttttcacaaagctcctctcatgtttctgcctctgattttcttaaatgtcacagacagactttagatttaggggttggttaactttttttgtaaagggccatgtagtaaatattttaggctttgtagatcatatggtctctgtgtcaactactcaactctgcctttgtaggatgaaagcagccatagacaatactggaactaatgggagtagctgtgttccaataaaactttatgggcactgaaatttgaatttcacttaattttcacatgtcgtttaatattatttttcttttttaccatttaaaaatttagaaatcattcttagctctttgggcctcacaaaaacagatggtagagtggatttggtttatgggctgcagtttgttgacctgtgctttagctaatcacttctgtacttataaatctgcataggttttatgtttttccatctcttggtatcttagtaggccagtcaaagtttgaacaacttgttagcacagaatacctggcctagtggcttcttggtcctgagcttatttactaaacaagagaaaaaataaataagtctagaaatgctagaagaggatacttttttgttttaatgatctagtagatcactcctccttgcaatacccagaggagaaactgaaaatatttcaaacattttctagacttctgtgttgtaaatttgtggataactatgaactatatatgaatgaacttttctggatgacacatatattccagatggtaaaaaggaagggctttggggactctctggtaccaagtgtcatggaaaaactgtgtgtctcatagaaagtagatcccaggaggccagcagagttgtggatctgccatatattacctcatgattctgtcttcgcacactcaccggcttaattctgggcctccccataacacgactagaccacaggcttgcagaagaaataatttagctctgtaactcattgaagttggtgcccacccaagtctctgtcagtgcccaattcgggagccatgccaagaatttgccattgctgcttcatggtggccttgtgcctgcttatttatagcctgtgcattttatgaaacagggattaataagaagttgccatagcacttgcaccattatgtaaatatctgtaatgcttacataacttttgtcacttgcaagaccttttgagtccattgccttctgctaccatgccttaccaatttcctagtcccttattattatttttcaattcattatatttaacttctgtgatacacgttcagaatatgcaggtttcttatataggtatacacgtgccgtggtggtgtgctgcaaccaacaacccgtcatctacattaggtatttctcctaatgctatccctccactagcccaccaccccctaataagccccagtgtgtgatgttcccctccctgtgtccatgtgttctcattgttcaactcccacttatgagtgagaacatgcagtgtttggttttctgttcctgtgtttgttttctgagaatgatggtttccagcttcatccgtgtccctgcaaaggacatgaactcatccttttttatgactgcatagtattccatggtgtatatgtgccacattttctttatccagtatatcattgatgggcatttcggttggttccaagtctgtgctattgtgaatagtgctgcaataaacatacgtatgcatgcgtctttatagaagaatgacttataatcctttgggtatatacccagtaatgggatggctgggtcaaatggcatttcaggttctagatccttgaggaatctccacactgtcttccacaatggttgaactgatttacacccccaccaacaatgtaaaagtgttcctatttctccatattctctccagcatctgttgtttcctgactttttaatgatcgccattctaactggcattgacatggtatctcactgtggttttgatttgcatttccctaatgaccagtgatgataagctttttttcatatgtttgttggccgcataaatgtcttcttttgagaagtgtctgttcatatccttcacccactttctggtgtggttggttatttttttcttgtaaatttgtttaagttccttgtagattctggatattagccctttgtcagatggatagattgcgaaaattttctctcattctgtaggttggttgttcactctgatgatagtttcttttgctgtgcagaagctctttagtttaattagatttcatttgtcaattttggcttttgttgccattgcttttggtgttttagccatgaagactttgcccattcacaattgctacaaagagaataaaatacctaggaatacaactcacaagggatgtgaaggacctcttcaaggagaactacaaaccactgctcaaggcaataagagaggacacaaacaaaaggagaaacattccatgctcatggataggaacaatcaatatcgtgaaaattgccatactgcccaaagtaaattatagattcaatgctatccccattaagctaccattgactttcttcacagaattagaaaatactactttaaatttcatatggaaccaaaaagagcccatatacccaagacaattctaagcaaaaagaataaagctggaggtatcaagctacctgacttcaaactatactacaaggctacagtaacccttatcaattttttatgtgcctctccatattctgcagtcagaagcttcttcagtcctttcagggaattgctgggtgactatcaaactctggtagttcatttttgcagttggctgctgttgtgaggataagagttagactcactttctcttcagagatagaaattatgtattaattctctgggttctagacccacagcaaggagcatactgctcctcaaaataactgaattctgcgagaagccatcattgtaaaacaacaatatcttcagttatagtagccatgtgtgcaacttctggaaactgttattcagattttcatgttccttccctgtctcttcatagctaggcagctgctttcagccttgtacagatgctagtgagctttctacctacaaacctgcagaaaattgaactgagatttggaggtgaaagactcttgataaagggaacaaggtttagaattctcagtccctttgctcccaggctgtgttgtgactactgaggcactccagtgaaatcactattcctcctatctagactaatgcctgtctctgcagagcacctcataagaacaggcctggtagtaatatcctcatgcattcagtcagtaaatatttacagagtgcttactacatatagggtattgggctgacatatgcaagatacagggcctgcttccaggaggttatagcttattgatcataaatgtggcattttttttttttgagacggagtcttgctctgtctgtcacccaggctggagtgcagtggcacgatctcggctcactgcaacctccacctcccaggttcatgtgattttcctgcctcaccctcctgagcagctgagactacaggggctcatcaccacacccagcttttttttttttttctgtatttttagtagagacagggtttcaccatattggccaggctggtctcgaactcctgacctcgtgatccacccacctcagcctcccaaagtgctgggattacaggcgtgaaaatgtggcaatctttaaagctcttcagtggatgaaaggccaccctatctgctgtccttttgaacttcgcaactttcttggtacagagtgagaggttattctcttggttttccatataagtaaactgaggctttgccagttcatcaacaggtagtaaataatatatttggaatttgaacccaagtcttctggggtcaaaggcagcattcactctgctctgtcacagcagctcctcaaataagccaacatagaaaccaagtactatgcctaggcaacaagaaaggcagcaatgaagagcaacagcagagtcaaatatgagagaaggaagttaagaaagatgttaagtactgtggggagtaactgagaaaccaccaagtatcgctaacatcacagggaacttgtcttcctaagaaaattccaagcacttaaaaccgctggtagttcatcagcaactctcttcattagatgtgcgagggacatgtgggccatagtccttctactaacttatattcttcaggggaaagttctgattctgatgagacccagcatggtagctcttaattcactgttgtcacacgactatagaacaggaagcacaacttaacacctgtgctcatgagaattttgctccttatgaccaagctaaagaaagagcttagacaggatgtgtggctataaatgtagattaatggttccttggctctttggtttgagccttctcagcagagcatcccacggagtgttttccatggggccacgagcaagagaaatccacttccctcctcctcaatgtcagaaaatagagaatattgtctttcaggatagaattaaaaagtcatagaggcagcaacttgttttcctatattagggttttaaaattctgtttttccttcctctcctgggtcagatcattgtgtggatggaccttgatttcattgtggtatctgtatgtggaccctgaagaccatggacttctaacaattccttaagttacataagcacattcctacaggtcacaagctcatttacttacaggatggttgatttggtcacaggttatttcatgaaaatacttaaaagatttgcagtgttcaaaactgcagtatctttaaacactaaaacttgaaggaagggaatttagaaatcaaaaaatctggtcaaaccatttcatggaaaaggaaagtgaggctcagagagaggaaattactttcctgggtttgtatagcctataaatggcagaaatgagagcctccctgccatttctagttttctgtctgagagactctcctgcctaatagctaattagcagagtcacagaggtcattaccttgcaattctcaagaattatgtgaggcagcatagtaagcatttatggcccttggttcctagaaggagcttagtccctgatagtcatctctgcctttgccattgtgtgagactgtcttctgtaactgtatgtcttcctccctagtaagttaatgagtaataaaggtattctatagtgagaggactctgtaagacatttcttggtgtgaggattgttccaaggttgttttgtgtgtatgtgcatgtataaacttttttagggagcatattcatagcttttacatggatctcagaggctctataacccagagaagattacagaataccagtcttgtctttggtaaggattttatagacccatcctgactacagtgatatccaacatggctatgtaatgactggcactttccccacataacatatatttattccacactcagtgcctactgtgtacatgagacctataccgggcactgggataagagacatgaaataacagctaaaattgtttattgagcagtcagtatgcattagatgctttgtagtcattttcttattcaatctgtataccctcaatttacaaatgaggaaactgaggcacagaagagttgagtgatttgcccaaagtcatacaaatagtcagtggctatgtgatgaatagttaccaacataaaagagtgagattactgctgtactaaaagtaggtacataatcccctgagcagacagtatgagagaatgatttattttacctggaaagtttaggaaggcttcacagaggagttaagggttgatctgggtcttgagggatggataagagtttgccagatacaaaaaggtaggaagagaacttcaggaggagggaacaggctgagcaaagacacggcgatgtgaaagtgggaggcttgtttggggaacattatggaatctggaggttattgtggggaatctcatcagatgcagcaagctgtttgacaggccttcagttggctctttgtaccttgctccctccgcatgctgagctgtccatagctgccctaggctggtgtctgggattttcggaagaaggttactatccaggtagtgtaacaagatgcagtgcaaaagcaccagattggggctctggctctgctgctgacttaccacctggccttaagcatgtctagttccctctttgtacattaaaatctccattggaacagtaacatggttgtattaaatgatcttgaagattttacctgcacgttttgcacatgtaccctaaaacttaaagtataataaaaaaattaaaataaaaaataaaaatataacaatataaatctttaacaataattttagtagtaaatctctacaattttacagataatccagatgcatccattggccaatggttcactttgtatgcataatatttgggaaacaggcagacccaatttcaatccttagttgtaagacttaatacatatgtgatctcgagcaaatcacttttgtatgcctctataaggataataatagctcacagaattattttaagaactaaatgatgtgtaataaagctactggtactcagtaagttttgtatccttttcctagagtgagtcttggtcataggcatgcgtatacttgcagcgtccctgggtaggccgaaagagcaaataagagatggtatctatggtattccccaggtaaaggaggccttgggttggcataagatttcacttctctttagagttacttaattagggaccagaaaggccatcagcatttgtatgagaatataacaaaggtcaatctcttcctctttactttttacctcccagtacactgtgagtaacattccccagccagcccagccagcacgtgttcattgcctctcttgacttccagactttggacttgaaggtgtcagagctctctgtgtatctttgtccccaacaagataagtctgacctccccagcaaattcaagtcctaagccactgtccaggagaaaagctagcaaggtcataaattattctccatattttccagccattggtttcccttgtccagccagaggtgtgtctcaaagtatgctgaggccagattcaatagaaacctgagccagcacctgtgtaaataatttttaaagctccttttcctgaagctggatgaatatttttaaaaactaagctggattgtcttttatctagcatgccgtctcctacattcctagtgctatggacctcttggaggaatgtggtttggttatagtggtattgtcttgtctgttgtgggggagggagacatttctttcagaagcaaggtaatactttggtctggtctatgactctattttgtttaaaatgaaactatggcagtatagtggtattcattctgcttcccataggttaactttacatccctctgtcttcacccactcttcagttctgattcttttaaaagcagccaaccaaaaccagcaagtacatactgcttatctctgacttccaccagaatcaacttcagatcttgtccaaagctccatctgaagagaggggaataacacccagccaagagccctcagggcccatcagtaagtagacatcctgtccttgaggttccttaactctgctcagcttcagaatacagaaggggttggttcttcatttgtgttgtttataactaaaagcctcctactccccacttttttgcatagcttcttctgccatcccacctgtgtagcctcttcaactcccccaaaactcctctgtagcccatgtcacttggaaagagttttctttgtctcttttgcaacttgacaatgactagccagcaagtttaagttcaaattattgttccatgggagcagagatagatataggaaacaaaaaaaagggatatggaggtatagagtgatttcccacctacctagtgagcactactgagatattcaagtactctctacccaagaattctattgatataaaggtaaaaaacttgatcttaggtctaatatccgttagtagtgtgaccttgggaaaatgataccacccccaaaggcttagttttcttaactgtaaaataggcatacagatgaccacccccagaggattcataaggataacatgagataaggcaacttgaaatttcctagcatagtgatagactttcgaaaataaaatgaatcaaacactgataacagtacttcctagtacacaaatgagaaatcagtccctcatcaaattacagcacattttcaatgctccaattatgtcactgtagaaatgctaatgtggattaaataatttgtctgttgctatttatacggataatttgatagtagttatttttggacatggatagctttgaagccttacagatgagtccatccccaagtacccaaaactaaagaaagttggctagagtgatgacaaggtggcagcacagagctccctgcgttctgggccctgtcccctagctagagagaactccaggctataagcatttgtattctcatagtccaatggcagggaagaagggctggaggtgagtagttttcactcatttattttttcaacaagcatgtatggtatcaggccttgtatgcatccagagacaaatgtgaactagccgtgtcctcaaggagattccagtctggtgggcctgccttccaaggtcagttgcagctttagcactataaagagcacctacctgcggcagatacaatgtgatgggacatgacagagaaaaaatctataagcagagcctccccattcccaggcattgaaacaatcctaaccaagactggcatagtacaatgagcctgtccctatcagcaggtttggaagccttaacaacaacaacaaaaacaataataatggtgatgataatcatagagcctaatgttaccaaacattttccatgtgttaagtactatactaagtgcatacttaatcctcacaacaatgctataagatagtagatactcttactactaccctgattttacaaatgtggaaactgaggcacagaagactaagagaacaggaatacacctaattcacctcagttcaacaaacatcaagcatctgttttatgtcaggcctcgtgctggatggcagggagagagagatgagtaaagcatagtttcagtccagtgggagcaaatgacagcacacagtggggcaggtatattgcagcccttctgcttgatgctaagaactcagtgtcagtgatgaatgaaacacagtcattctctcaaagatcttaaagcttagtaggagatatctgtgtggaaacaaaaattaaatactgctgtgataagtgtcataagagataagtggaaaatgagagagagagatcactgtagcaattgattggtttaaatcaaagcccccaaaaaaatgttattgagaattataaaacaactaattgatttaaatcaaagcccaaacagaagtgtttgctaattttatttcaatttggttgataatttggttgaaatgaatttatttcattttttattccatccttacaatggaagattagtgcttgtttcccacccaaggataccaggatatttcaggggctgtattacaatatagttaaattattcctttatctcaaagcacatccacactttcccctatccttacctttactcagggtatctcttctgcctcaggtgctttttctccacatttccatattcttaagtcctaccttccttcagggcctcactcaaatgcctcctcctccatgaagcattcacccgactgaaaggtaccccgccctctcctgtactccacatcacttcatgggtgtctccacttcctgctttatctttcagtaatacacttacagttctctttcctccactagactgagctcttcagaggaagactcacttggctgaaaccatgattttactttaaacacattgaaaacctctactggagtgcattgtgtctggtgggcttcaaccttaattcttaagtatgtgaaaacacatcacctatctggaggtttacactttctgctaatgactttatttttaagcccaccaccctaacacaacaaatacttaaaacttgtcttcatttcctttaggtctggccctcatgcatgcatataatttatagagtcactgttttgctcggttgtcctcatgcctctatattattggaggtttagattgtttccatatactcaggttgtattcatgtcctttttttctttttaaatttccttagcatccatttccaccattggaaattcagggtcaaaacaggggtttgggattggagcatgtctatcacagataaccaatcatgtgttatgacttaagaatttatgaaagggccctctacctgaagatatcttgctactgatgctgtctcacagtgtctgaaactcccatcatatgtggaattgttttggaaggctttgcctcctgggacacattcagccataatcaagaaatagtattgagcattagactgtcagtatgtccattagcaagactgtggaggaatggaatcaccaatattatattttataggggatacagaatacaagagaagttctgaagagaaaattcttatgtagaataggaaggcttagatacagcatgaaagctgcaggctttgaggagccagaggtcaaatgaaagcattgagtatttgtttagatgaaagaacagaaagggaaaaagaagcagaggaagggatagtagagagaaatgtataagttttatccatttaacttgtaattgtgtttggctatgggcacaatagaagcagtgagatcactttattttattttattctttatagacagggtcttgctatgttgcccaggctgcagtgtgcagctcttcacaagtgtgatcatagcgtactacaccctcaaactcctggactcaagcaatcctcccatctcagcctcctgagtagctgggactacaagtgcacaccaccacgcccagtgagatcacttgaaactagggagagatgtgtgagttctgggcaaccagtagttggctttacatagaactgtaggggtcaaggccaaaggggacgtcctgttccaagtcaccttctttggacattagaaaaccacgaggggtttggaaatcagaaaaccagcagaggcaggaaaactcagggcagcatgggagattcagtatatacaaaaaggttcacaccagtaatcaaacagaattttaactgctgatgtggagtagaggcagctttgtctgctgtgtgataaccaaacctttacgaatagtaggtgtatatggggaattggagggagataggtggctgtgtttagtaattggttgacttcactgagatggtttggggattgtggcttccagatgatcagattttcttttttaggtagagactccaacatcattacagaactataaattacatgtggaaaagaaaggcctcctatgttagaatagaaaataaaatgctgtggggttgagggacagaggtgctgtctaggaagtcagatagcgttttccagttctgtccctcagagttccttgtcctcattgagactcaatttctcttacttttttttttatactttaagttttagggtacatgtgcacaacatgcaggtttgttacatatgtatacatgtgccatgttggtgtgctgcacccattaactcatcatttaacattaggtatatctcctaatgctatccttcccctctcccctctccccaccacaggccctagtgtgtgatgttccccttcctgtgtccatgtgttctcattgttcaattctcacctgtgagtgagaacatgcggtgtttggttttttgtccttgtgatagtttgctgagaatgatggtttccagcttcatccatgtccctacaaaggacatgaactcttcattttttatggctgcgtagtattccatggtatatatgtgccacattttcttaatccagtttatcattgatggacatttgggttggttccaaggctttgctattgtgaatagtgccatgataaacatacgtgtgcatgtgtctttatagcagcatgatttataatccttagggtatatacccagtaatgggatggctgggtcaaatggtatttctagttctagatccctgaggaatcgccacactgacttccacaatggttcaactagtttacagtcccaccaacagtgtaaaagggttcctatttctccacgtcctctccagcacctgttgtttcctgactttttaatgatcaccattctaattggtgtgagatggtatctcgtggttttgatttgcatttctctgatggccagtgatgatgagcattttttcatgtgtctgttggctgtgtaaatgtcttctttgagacgtgtctgttcatatcctttgcccactttttgatagggttgtttgtttttttcttgtaaatttgtttgagttctttgtagattctggatattaccctttgtcagatgagtagattgcaaaagttttctcccattctgtaggttgcctgttcactctgatggtagtttcttttgctatgcagaagttctttagttgaattagatcccatttgtcaattttggcttttgttgccattgcttttggtgttttagacatgaagtccttgcccatgcctatgtcctgaatggtattgcgtaggttttcttctagggtttttatggttttaggtctaacatgtaagtctttaatccatcttgaattaattttagtataaggtgtaaggaagggatccagtttcagctgtctacatatggctagccagttttcccaacaccatttattaaatagggaatcctttccccatttcttgtttttgtcaggtttgtcaaagatcagatggttgtatatatgcggcattatttctcagggctctgttctgttccattggtctatatctctgttttggtaccagtaccatgctgttttggctactgtagccttgtagtatagtttgaagtcagatagcgtgatgcctccagctctgttcttttggcttagggttgacttggcgattcaggctcttttttggttccatatgaactttaaagtagttttttccatttctgtgaagaaagtcatgggtagcttgatgaggatggcattgaatctataaattaccttgggcagtatggccattttcacaatattgattcttcctacccatgagcatggaatgttcttccatttgtttgtatcttcttttatttcattgagcagtggtttgtagttctccttgaagaggtccttcaagtcccttgtaagttggattcctaggtattttattctcttagaagcaattgcaaatgggagttcactcatgatttggctctctgttttctgttattggtgcataagaatgcttgtgatttttgcacattgattttgtatcctgagactttgctgaagttgcttatcagcttaaggagattttgggttgagacgatggggttttctaggtatacaatcatgtcatctgcaaacagagacaatttgacttcctcttttcctaattgaatgccctttatttccttctcctgcctgattgccctggccagaacttccaacagtatgttgaataggagtggtgagagagggcatccctgtcttgtgccagttttcaaagggaatgcttccagtttttgcccattcagtatgatattggctgtgggtttgtcatagatagctcttattattttgagatacgtcccatcaataactaatttattgagagtttttagcatgaagcgctgttgaattttgttaaaggccttttctgcatctattgagataatcatgtggtttttgtcgttggttctgtttatatgctggattatgtttattgatttgcgtatattgaaccagccttgcatcccagggatgaagcccacttgatcatagtggatacgctttttgctggtattttattgaggatttttgcatcaatgtttatcagggatatcggtctaaaattctcttttttgttgtgtctctgcctggctttggtatcaggatgatgttggcctcctaaaatgagttagggaggattccctctttttctatttattggaatagtttcagaaggaagggtaccagctcctccttgtacctctggtaggattcagctgtgaatccatctggttctggactttttttgattggtaagctattagttatatcctcaatttcagagcctgttattggtctattcagagattcaacttcttcctggtttagtcttgggatggtgtatgtgtcgaggaatttatccatttcttctagattttctagtttatttgcatacaggtgtttatagtatgctctgatggtagtttgtacttctgtgggatcggtgattatatcccctttatcattttttattgcgtctatttgattcttctcccttttcttctttattagtcttgctagtggtctatcaattttgttgatcttttcaaaaaaccagttcctggattcattgattttttgaagggttttttacatctctatttccttcagttctgctctgatcttagttatttcttgccttctgctagcttttgaatgtgtttgcccttgcttctctagttcttttaattgtgatgttagggtttcaattttggatctttcctgctttctcttgtgggcatttagtgctataaatttccctctccacactgctttgaatgtgtcccagagattctggtatgttgtgtctttgttctcattggtttcaaagaacatctttatttctgccttcatttcattatgtacctagtagtcattaaggagtaggttgttcagtttccatgtagttgagcggttttgagtgagtttcttaatcctgagttctagtttgattgcactgtagtctgagagacagtttgttataatttctgttcttttacatttgctgaggagtgctttacttccaactatgtggtcaattttggaataggtgtggtgtggtgctgaaaagaatgtatattctgttgatttggggtggagagttctgtagatgtctgttaggtctgcttgacagtggagtgttaaagtctcccattattattgtgtgggagtctaagtctctttgtaggtctctaaggacttgctttatgaatctgggtgctcctgtattggttgcatatatatttaggatagttagctcttcttgttgaattgatccctttaccattatgtaatggccttctttgtctcttttgatctttgttggtttaaagtctgttttatctgagactaggattgcaatccctgcctttttgtgttttccgtttgcttgataaatcttcttccatccctttattttgagcctatgtgtgtctctgcatgttagacgggtttcctgaatacagcacactgatgggtcttgtctctttatccaatttgccagtctgtgtcttttaattggagcatttagcccatttacatttaaggttaatattgttatgtgtgaatttgatcctgtcattatgatgttagctggttattttgctcgttagttgatgcagtttcttcctagcctcgacggtctttacaatttggtatgtttttgcagtggctggtaccggttgttcctttccatgtttagtgcttccttcaggagctcctgcagtgcaggcctggtggtgacaaaatttctcagcatttgcttgtctgtaaaggattttatttctccttcacctatgaaggttagtttggctggatatgaaattctggttttaaaattcttttctttaagaatgttgaatattggcccccactctcttctggcttgtagagtttctgctgagagatcagctcttaatctgatgggcttccctttgtggggaacctgacctgtttctctggctgcctttaacattttttccttcatttcaactttggtgaatctgacaattatgtgtcttggagttgctcttctcaaggagtatctttgtggtgttctctgtatttcctgaatttgaatattggcctgccttgctagattggggaagttgtcctggataatatcctacagagtgttttccaacttggttccattctccccatcactttcaggtacaccaatcagacatagatttggtcttttcacatagtcccatatttcttggaggctttgttcatttctttttattctttttcctctgaacttctcgcttcatttcattcatttgatcttcaatcactgataccctttcttccagttgatctaatcggctactgaggcttgtgcatttgtcacgtagttctcgtgctgtgtttttcagctccatcaggtcctttaaggacttctctgcattggttattctagttagccatttgtctaattttttttcaaggtttttaacttctttgccatgcgttcgaacttcctcctttagctcagagtagtttgattgtctgaagccttcttctctcaactcgtcaaagtcattctccatccagctttgttccattgctggtgaggagctgcattcctttggaggaagaaaggcactctgatttttagagtttccggtttttctgctctgttttttccccatctttgtggttttatctccctttggtctttgaagatggtgatgtacagatgagcgtttggtgtggatgtcctttctgtttgttagttttccttctgtcaggaccctcagctgcaggtctgttggagtttgctgcaggtccactccagaccctgtttgcctggttatcagcagcagaggctgcagaacagtggatattggtgaacagaaaatgttgctggttgatcattcctctggaagttttgtctcagaggaatacccggatgtgtgaggtgtcagtctgcccctacttgggggtgcctcccagttaggctactcggggttcagggaaccacttgaggaggcagtctgtccgttctcagatctccagctgcatactgggagaaccactactctcttcaaagctgtcagacagggacatttaagtctgcagaggtttctgctgccttttgttcggctatgccctgcccccagaggtggagtctacagaggcaggcaggcctccttgagctgtggtgggctccacccagttcgagcttcccagctgctttgtttacctactcaagcttcagcaatggcgggcacccctcccccagcctcgctgctgccttgcagtttggtctcagactgctatactagcaatgagcgaggctctgtgggcgtaggaccctctgagccaggcacaggatataatctcctggtgtgccgtttgtgaagaccattgaaaaagtgcagtattatggtgggagtgacccgattttccaggtgccatctgtcacccctttctttgactaggaaagggaattctctgatcccttgtgcttcctgggtgaggcgatgtctcgccctgctttggctcatgctcggtgcgctgcacccactgtcctgcacccaccatttgacactcccctgtgagatgaacccggtacctcagttggaaatgcagaaatcacccatcttctgtgttgctcacgctgggagctgtagactggagctgttcctattcggccatcttcacaaaaatcttactttggtttctagtgttaccacccactgttctttctcatctcaaccctgagtataagtacagatcacattccttgggttcttagaaaataatagaaatgaactctcattcatcaaaatgcccattagtaaatactgagggagaacaaactagaaatccagtatagaaaataaaaataggattatattccttggaatctcagaaaaaaacaatgaagagctttctttgggcattagacactttcccataaggtggctgactctcttttagtcatgtcagcttggcccaatcttcacttggtagcccttctttcttcttcattaatccatctcctatgctcctatggggtcctagagaaatgcccatcatgtacacacacatctaataacacaaagatcactctcgactagcaagcccttttatgatggtgtgagcatttgacacccttgttgctagtaacatcagtgagtgacctgacccatttttggaacagaatatgatcagtatgttgcctcaaggaggccctcactgttctaggaaatataattccagagtttgctgactcacaccatggaatatatgcataaaatggatcctgcagataagcctttctctgactagtttcagacatttttttctgggtaattttaaagttattttttatttttgtgggtacaaagtaggtgtatatatgtatgaggtacctgaggcattttgatacaagcatacagtgtataataatcaccagagttaatggggtatccctcaccacaagcatttatcctttctttgtgatacaaacaatccaattatattcttttagttattttaagatgtataataaattattgttgactgcagtcaccctgttgagctatcaaatactagatcttattcattctaactatacttttgtacccagtagccatcccacttcctcccctcccactacccttcccagcctctgataaccatcattccactctctatctctatgagctcaattgttttaagttttagctcccacaaatatgtgagaaaatgccaagtttgtctttctgtgcctggcttatttcacataatataatgtcctctagttccatccatgttattgcaaatgacaggatctctttcttttttatggcttaatagtactttattgtatgtatgtaccacattttcttcatccatttgtctgttgatagacaagagttgcttccaaatattgactattgtgaatagtgctgcaataaacgtgggaatgcagatctctttgatatactgattttctttctttagggtgtatacccagcagtgggattgctgggtcatatgatagctctatttttagtattttgtggaacctcaaatctattctacataatggttttactgacttacatatccaccaacagtgtatgaggatactcttttctccacatcctcaccagcattcattactgcctgttctttggatgaaagccattttaactgtggtgaaatgagatctcattgttgttttgatgtgcacttctctgatgatcagtgaggttgaggaccttgtcatatatctgtttgtcatttgtatgttttattttgagagatgtctacccagatcttttgcccattttttaatcagattgttagattttttttttcctacagagtgcttgagctctttatatgccctagttactagtccctggtcagatgggtagtttgcaaatagttgctctcattctgtgggttgtctcttcactttgttgatcgaatcacttgctgtgcagaaggtttttaacttgatgtgacctcatttgtccatttttagttgcctgtgctggtgcggtattactcaagaaatttttgcccagattaatgttctggagagtttccccaatgttttcttgaagtagtttcatggattgatgtcttagatttaagtctttaatatgttttgattttatttttgtatttgctgagagatagggctctagtttccttctgcatatggatatccagtttttctagcaccttttgttaaagagactattcattctctaatatacgttcttggcacctttgttgaaaataagttcactgtagatgtatggacttgtttctgggttctctgttctgttccattggtctatgtgtctgcttttatgtgaataccatgttgttttggttgcaaaagctctgtagtataatttgaaatcaggtaatgtgattcttccagttttgctctgttctttttcctcaagatagctttgcctatcctgggtctcttgtggttctatataaattttaggattattttttctatttatgtcaagaatgtcattgatattttgatataaattgcgttgaatctgtagatagcttcaggtagtgtggacattttaacaatatcaattcttgaaatccacgaacatggaatatccttctattatttggatgtcttcttcaatttcttatattaatttttttttagttttcattgtagagatatttcatttatttgactaagtttattgctaggtattttattttatttttacctattgacaatgggattgctttcttgatttcttttttagattgttcactgttggcatacagaaatgctactgatttttatgtgatgattttgtatcccgcaactttactgaatttgtttatcagttctaataggcttttggtgcagactttaggcttttccaaatataagatcatattatctgcaaacaagaataatttgacttctttcttttcaatttggatgcctttcatttctttctcttgtctgattgctctaactaggacttccagtactctgttgaataacagtggggaaagttaacatccttgttttgtttcagatcttatagccaaggccttcagtttttctgaatttagtatgatactagctatgggtctgtcatatatggcttttattatgttgaagtatgttccctagttttttgaaggtttttatattttaaggaagataaaaattgaactttatcaaatgcttttcatgcaacaattgaaatgatcaagtgctttttgtctttcattctgttgatacgatgtatcacactgattgacttgtgtatttagaaccatccttgcatcccgtggtaaatcccacttagtcatggtgaatgaactttttaatgtgttgttgaattcagtttgctagtattttgttggggatttttgcatcagtgtttatcagggatattggcctatagttttccttttttttatgtgtcttttgggttttgttatcagggtaatactggccttgtagaatgagtttggaatgattctctcctctattttttgaaatactttgaataggattgatgttacttctttaaatgtttggtaaaattctgcactgaagccattgggtcctgggctttttactgctggggagacttttcattacagcttcaatcttattacttgttattggtctgttcaggctttagatttttttcatgaatcaatcttcacaagttgtctgtttctcaaaatttatcaatttcttctaggttttccaatgtattgtcatccagttgctcataatgccctctaatgatgccttgaatttttgcagtaaccactgtaatgtttccttttttaatctctgattttatttgagctttctctttttttcttagtctagctaaatatttgtcaatgttgtttgttcatccacaaaaccaacttttcatttcactgatcttttgtattattttttccttttaattttatttatttctattctgatatttatcatttcatttcttccagttatttgagtttggtttgctcttgcttttccagttctttaagatgcattgttaggttatttatttgaacttttttgatataggtgcatattgctataaactttcaccataatattgcttttgctgtatcccataggttttagtatgttgtttagtatgtttccaatttggtacatttcaataaatttttaaattttcttctttatttattgacatagtcattccagagtatactgtttaatttccatgtggtttgtatagtttccaaaattcctcttgttattgatttctagttttattccattgtggtcagagaagaagcttgatatgaatgcaattgttaataatttttttaaaacttgttttgtgacctaagatatgatctgtcattgagaatgatccatatgctgaggaaagaatgtatattctgcagccattggataaaattgtctttaaatatctattaggtccatttaagacataatgcagattaaagccgatgtttcattgttcatttttctgtctggatgatctcttcagtgctgaaagtggtgtgttaaaatctctaaatattattgttttgggatctttctcttctttcaactctgataatatttgctttagatacctgggtgctccagtgttgggtgcatatatacttaaaattgttgtatcctcctgatgaattgacccctttatcattatataatgaccttctttttctctttgtgtagtgtttgtcttgaaatctattttgtcggatattagtattgctgctaatttttttggtttccatttgcatgaaatatctttttcattcctttattttcaggcagcgtgtttctttatatttaataggtgaaatatgtttcttgtaaataaaaattattattttaaaatatttttaaaataatactattttttaataagaacaattattattttttaaaaaatttcattagttttgggggcacaagtggattttggttaaatgggtgagttctttagtagtggattttgagattttagtgcagcagccacctgagaagtgtacattacccatatattatatatatactatatatgctttatatatatagtgtgtatatataatatatatacaactacatattgggtaatgtacacttctcaggtgactgctgcactaaaatctcaaaatccactactaaagaactcacccatttaaccaaaatccacttgtgcccccaaaactaatgaaattttttaaaaaataataattgttcttattaaaaaatagtattattttaaaaatattttaaaataataatttttatttacaagaaacataattcacctattaaatataaagaaacacgctgcctgaaagtaaaggaatgaaaaagatatttcatgcaaatggaaaccaaaaaaattagcagctatactaatatattatatatatactacataaagcatatatatagtatagtatatatataatacatttataaagcatatatatagtatgtagataatatatgtttatatactttaagttctgggatacatgtgcagaacgtgcaggtttcttacataggtatactcgtgccatggtggtttgctgcacccatcaacctgccatatacattaagtatttctcctaatgctatctttcccctagccctaccccactccctgacaggccctggtgtatgatgttcccctccctgtgtccatgtgttctcattgttcaactgccacttatgagtgagaacatgtggtgtttggttttctgttcttgtgttttagtttgctgaggatgatggtttccagcttcatccatgtccctgcaaaggacatgaactcatcctttttgatggctgcatagtattccatggtgtatatgtgccacgttttctttatccagtatatcattgatgggcattttggttggttccaagtctttgctattgtgaatagtgctgcaataaacatacgtgtgcatttgtctttatagaagaatgatttataatcttttgggtatatacccagtaatgggattgctgagtcaaatgatatttctggttctagatccttaatgaattgccacactgtcttccacaatggttgaactaatttatgctcccaccaacagtgtaaaagcgttcctatttcttcaaatcctcaccagcatctgttgtttcctgactttttaatcgccattctaactggcatgagatggtatctcattgtggttttgatttgcatttctctaatgaccagtgatgatgagctttttttcatgtttgttggcagcataaatgtcttcttttgagaagtgtctgttcatattcttcacccactttttgatggagttatttgttttcttcttgtaaatttgtttaagttccttgtcgattctggatattagctctttgtcagatgaatagattgcaaaaattttctcccattctgtaagttgcctgttccctctgctgatagtttcttctgctgtgcagaagctctttagtttaattagatcccatttgtcaattttggcttttgttgccattgcttctggtgttttagtcatgaagtctctacccatgcctatgtcctggatggtattgccttggttttcttctacagtttttatggttttaggtcttgcatttaagtctttaatccatcttgagttaattttgtataacgtgtaaggaagaggtccactttcagttttctgcatgaggctaacgagttttcccaacaccatttattaaatagggaatcctttccccattgtttgtttttgtcaagtttgtcaaagatcaggtggttgtagatgtgtggtgttatttctgaggcctctgctctgttccacgtgtctatatctctgttttggtaccagtaccatgctgttttgggtactgtaccacttgattggtgagagagggaatccttgtcttgcactggttttcaaagggaatgcttcagcttttgcctattcagtatgaccaatatgtagtcttttattcctcaccctctctcaacaccccacccccacggagtcctcaaagtccattatatcactctgtatgtttttgcgttctcatagcttagctcccacttataaatgagaaaatacagtatttggttttccattctttggttacttaattagtataatggcctccagctccatccaggtgtcttgtttttcatccattcagccagtctataacttttgcttggagagtttcgtccatttagattcagcgttatgattgataactaagggcttactcctgccatttggttgttttctggttattctgtggtcttctcttccttttttccttctttcctgtctcccttttagtgaaagtggttttctctggtggtgtattttattttcttcctttttatttttttttgtgtgtatttgttgcatgttattgatttgaggttaccatgaggcttgtacataatattttctaactcattatttcaaactgatgacaacactctatcgcataaaaaaacatggaaagagaaaactaataaaaactctacattttaacttcatctctctgcttgttgtcactttgtcgtttctatttacatcttattgtactgtttatgtcttgaaaagtagtttcagttattacttttgattggttcatctcatagtctttctactcaagatatgagtagttcacacaccacaattacagtgttacaatattctgtgtttttctgtgtactttcaattacccatgagttttgtattttcagataatttgttattgctcactaacatcctattctttcagattaaagagctccctttagcatttcttgtaggaaaagtctggtgttaatgaattccttcagctcttgttgatctgtgaaagtctttatttttccttcatgtttcaaggatattttcactggatagtctattctagggtaaaagttttttttttttttttcttcagcccttcaggtaagtcatgccactctctcctggcctataaggctaccactgaaaagtctgctgccagacatatatgagttccattctatgttacttgtttattttctcttgttacttttaggatcctttctttatctttgacctttgggagtttgattattaaatgccttgaggtggtcttttttggattaaatcttcttcgtgttcttgtacttggatattaatatctttctctaggtttgggaagttctctgttattatccctttgaataaactttctaccaagatctctctttctctctctgtctctctctctctctctctctccttcttaaggccaataacttttagatttgcccttttgaggctgttttctagatctcgtaggtgtgcttcattgtttgctattttttttttttttttgtctcttctgactacattttcaaatagcctgttttaaaactcactaattctttcttttgcctggtcaattatgctgttaagagactctgaggcattcttcagtgtgtcagttgcatttttcagcaccagaatgtctgcttatttttttttagattatttccatctctttgttaaatatatctgatagaattctgaattctttcttagtgttatctttaatttccttgaatttcctcaacacaactattttgaattatctgtctgaaaggtcacatatctctatttttccaggattgctatctggtgctttatttagttcattttgtgaggtcatgttttcctggatggtgttaatgctagtagatgtttttcagtgtctgagcattgaaaagttagatgtttattgtagtcttcacagtctgggcttgttcatacctgccctccttgggagactttccaagtattcgaagggatttggatgctgtgatcttagtctttggtcactgcagccatatctgctttatggagcatcccatgctcagtaatgctgtggctctttcagactcatagagttactgcctgcatgctcttgggtaagagccaggaaaattccctggattaccaagcagagactcttgttctcttctctcactttcccccaaacaaatagagtctctctctctctctctctttctctctctctctctccctctcattctctgccgacctgcctgaatctggggtagggatgacacaatcacatttgtagtcaacaccattgggactgtgctaggtcagacccaaagctggcacagcactgagtctcgcccaacgcccacagagaccactccctgggtaatgtctgtgtttgctcaaagcctaagggctatacaatcagtcagtggtgaagccagcctgtcttatgtccttcccttcagggtgatgagttcctcaagcaggtccagggatggtgtccaggagccaaggcctcgagctgtgactgagctggcacccaatccataagacaaagattttttccacactttccttccttgtcctcaagcaaaggagtctctccctgtggccaccaccacccccatgttcatggcaagtattgtctggctaccaccaatcttcactcaaggcccaggggttctttagttagcttatggtgaatgctaccaaggctgagtctctcccttcaaggaagtgggctcctctctggcccagggcaggtccggaaatactatccaagagccaaggcctggaatcagtttccccaagagtccatttggtgctctacacccactgtggcagaaccagtacccaagctgcaagacaaagtcctctttactcttccttctcctttacagagactctccctatagccaccacagctgggaatatgctgggtcactcttgaagcaagaacagctctgagtctcactcaaaactcctggcaagtactgcctggctatcacactgattattcagggcccaagggctctttagtcagcaggagatgaatcctgccagtactgattccttcccttcaaggcagccggtttctttctggcccagtgtgtatctagaaatatcatttgggagctagggcctggcatggtgacctcaggactctgcctggtgccctgttctactgtggctgatgtagtatccaaattgcaagaccaagtcctctttactctcccctctcctgtcttcaagcagaaggaatgagtccgccctggagttgggagctgcattgcctgggattggaggaggggtggcacaagcactctcttggtcaccccagctggtgtcttactaggtcgcatgttccccaagtccactggctctgaggctagcacaccaggatttgaccaagaattgcaattcttgtggcttacactgcctttcaagtttatttgagatcccagagcactttagcccacagtgacagggcttgccagaatttagtttctgactgctgagatggacaatttgcgtctgattagggctggtctaagtgctccttctgtgggcactggctgagttctgctccatgttgctttctgctgtgacagggcaacattgagtttcaatgcaagtcccacagtcactgcaatcttcctctcccaagcctgctctgaacaccatgtggttgctgctgggggctgggggagggatgttgtaggcaattcaagaatgtctttcctacccttttcggtgcttctttccttggtatgatattaaaaccagttactgtgattgctcacctgatttttggttcttatgaaggtgcttttttgtgtggatcactgttcaatttgtgcctgcaagcggggatgggggacaattgctggaggcttctctttggccatcttgctccacctctaccctagtattagcaatttcaaagcagttgggatggaggtagaaggaaagggcgcttggaatcagaaaatccatgtcttagctttgagccttagaaaattcatttgacccttgtaagcctcagttgcttcatctgtaaaagagaaataatataatggctgaaaagatcaaaggtgataatgcttttgaaaacactatagaaaatgacaaaatatcacatgagtattattttctagtttctaggagtctccttaccattgtacaggacaaccatgtctatttttaaataaattattatttgcctctgagcaaccctgcaaagagttgcctgtaggagaaacagctttacttgcaaatcactccactgttttctttgtgcacagcttattaatacataaggcacatgtcctccagcctgcagtaacattggaatcattacctctttggagtacctaccagagcttctcaaagtgaattttgtttatcaccacaaaaaatagtctgttgcagagataacctccaaattcaatgacaatatttccaatcacttttgcatgatgcagaaatagacaaatatataattttgcttatagagacaattattgtctcccaacaagtgatcagtagtcagaaaatggccaagaaataccatggggtgtgccttcccataacagcttatctttgtgttttagttgcaaggttactaaaagcctgtgcagggtttatggcaaaagtaaaacttgctccaggagcaagcccttgtttcattgtctaatgttcttaatccccagcagacaggatttggatctggcatttggtaacagggcagtttccaaagttgctgtacgcaacttgaggaagagaggtgatattatcggaatgaatttctttgttgtaagttataaatgtatgggcttttccaatcccatcacccttaaaactttatttgttttctgcagtgagggtgtctccgttgtctttaatatgcttgctttgagttcatggatgaacattcctgcctggctgacatgtggactctctgaaattgttataaggtctttttctttgtttttttcttgatgcccaagctgccaagggtagtactggcagtggtgggcagacaaggaggtgatagcaaactttgtcctctggcctcccttgacccattccattcattatctaagggactccaagccagcattccacagagtgccctcaccaaactcactaagactgaaggcgaaccaggattccaaacagccattatgaaaggaaagagagagagacttagggtttgcaaaataagataccctgttgattctttttattccatacagatactactattctttaggaaaacgttaaaatcacatgatcttccaggacctgggctgcttctttaagaagcatgttacagaaagctttattggccaacaacatattgaaagatagattaatcaatcattcattcaaataaggtatattcagaattgaggtatattgtagccagacagtgagactacaaaaaaagaatgcaccgtacccttatctcttgcacaatctaacgagggagataaccactctttcaatttatagtgacctataacatttcgtacactgctgaatatctttacatggtaataacacaatggaaagcttgcaaaatagacagaggctaggggaagaaggattgagtgtgaatatagcctcttataaatcgagaggaatggtctgtgtcttctgatcatacagagataataaatatggaaatgatttcaaactaacaaagcaaatgtgcagaaaatactgagaatatagtgggcaggatacctgagttttggttccatctctgttattgactcattgtgtaatctgagtcaggtctgttctgctctctggatctcaccctttcctatctgtaaaatgagattgttggattagatgatctccatagaggttctcacctattctgacattcaaaaggactcctaatttttcttatataataataatatatatgatctgtagagtgctttacactttatatgatatttttgcatctgttatctcatgtgagaaaagcactggactgctggactggcaatgaggacacctggattcttgtctctgttttgacactgattcatggtgtgatcttcaagcaaattctctgagtttcagtttctcaatctgtaaaataggggggtatgaagattggactaaatcagtaggtctctaaaatgttccacaaagccctggggtggggggctcctacagagtttcgctaaggcaaaccacaacgctaagcctgcatggaagaggagaaaaagagtggcctgacaagagaagttcccagtttcctatgccaaccccaggcagattacatttaattttatctgatttatatagagagtttctatgtaatgttttattcttaaaaatagtttactataaaaaactcaactggtttgatttttaaagattgcacatataagtgagatcatgcagtcagtatttgtctttctatgcctggcttatttcacttagcataatgtcttccagcatcatctatgttgctgcaaatgacagacttttcttttcattaaaggctatatagtattccatcgtgtatgtacaccacattttctcttttgtaactttcattttaggttcaggggttcatgtgcatgtttgatatataggtaaactgcatgtcagagaggtttcttgtacagattatttcatcacccaggtaataagcatagtatctaatcaatttttttctgatcctctcccttctcccaccctacaacctcaagtaggccctggtgtctattgttcccctctttgtgtccattacaccacattttctttatccacttatccatccatggacacttagtttgcttccatatgttggctattgtgaataatgctgaaaaaagtcaaactcatagaagcagagagtagaatggtggttaccagggactgggaggcagttgactgagctaggaaaagagagataataaaagggtacaatgtgtcagttatatagaaggaataagttatattgaactattgcacagcatggtgaccatagttaataataatgtattatatgtctcagtattgctaaaagagtaaatttaaatattctaaccacaaaaaattattagtaggcaaggtgatggatatgttaatttgcttgatttaatctttctagaatgcatacatatatcaaaacatcccactgtaccccataaatatatacaattattatttgtcaatttagaaatttaaaaacttgatttagatgagctctaaggccttaagtattaaagtattaagtattaaagtgatatgtaaccaagtatattgtttggtaacttcatttttgttattattttaacaaaccaatatattgtgaatatacttccaagtgaaaagaaaaaagacattgcagtcatcactaataactgcaaaacattcctttgcaagaatatggaataattcatttaatcattcccctaatgttagacattcaaatgtttccaactttttctatttaaataatgctacaataaacttctattttgtgcttattgtattattttcttacaacacatccctagaagtggaattcctagaagtttatacacatttccaatttttttccaaatatatggcaaaatttctctctaaagtatttttattcctaccagaaatacctcttcaccaacacgtagtatttaatctgtaccaatctggcttaagacaatgatatttaatttgtatttctgtgatttctagctaaattaaataatcttcatatgcttattggtcatttgtacttctaactgctttctcctgtctgttgcccatttttctattgtgctgtttatttttatatatcgaatatattgaccattggttttacatacttgatgctaataattattcttagtttatggtttgtctttgagttttataatggtgtttatttcacataagaaattataaatgttttctaatgaaatttatcaagtctgtcttcacttatgttttcttcattgtcaataacttaaaatgaccttttctacctttaaaaattttgaaattttcctctgtattgtctaatagtacttacatgatttcctcttttaaattgacatatttaatccatttggaatttattttgattttaactagtaatttaactttattttcttctccaaatgattcactagttgttctgacattatttagtgaataattcatcctttcttcactgaattggaatggcatattccatatactgtgtctggttttggcttttctgatctcttccactgatcaacctaagctggagccagtatcaaactgttgtaatcattatgcctttagatactttaaatgtacagcagggaatgtcttattactcttatttttcacaaatatcttggcattgtctcatgttttattccttcagataaattttgggattattttgtcaagattttgtttgagttgttttaaatttttagatttcattgggaaagaactgaaatccttgaaatattgcttcttcttagccaggaatatggtacaactttgcatttaattcagttctttccttaaataccaccatgaagttttttgttttgttcatataggtcctgcattaacaccatatatataaagtgtgagaaatactacattcttcaggattctctgtaggttaacaatgaagatgatgactcaaccctttctttgtttgcataatgtgatgccactaatagtgggtaacttctctgccttacctcctctgttccaaacaggatttttcagaatgaacaaattaaaagaatcataatcagacactaaccccaagccatactgcatggcagcaccaatgggactgacagaaaacaacagaaataggaagaaatcctacagagaaacaaacttgaaagctgtctcatggcctttgaatcatacttaagttttatgatggaaggatacgactatgaagaaagacacagagcaacatcagacagtcaagaatttcagagccagctggcatgcagtggacctcatgccagcccattttatgactatttaggtagtcaagggtttaagatttttctaataagacagttattatgcatttcaatgagtgatttctttgcagctctagagtgtggccttacctacttcaacatgagaagatttttgtattttgtcagtcatttcacaatgacttttagtgagcccttcattatagactgtggatacaactttgctgttggaaattaacagtgtcaaacaactgggtataatgtttgtaatatctgaggagggggagctgcctaggaagttgtattccctgtgttaatttttcagtctcttaggttatagaggaccttctagaaccaccttacagcaggattacatcccatttacacagttctctgtcacttgaatacagagaagggatccacaaggccatatgcttcctagacaaagagaaaagatttctgccacactcagaacgctttgtcttcagactataatcacccacaccatatttcctttggatccactttccagatttttgtgctggcactaacaccaacttgctgtggcttggggcatgtaatttcaatactttgtgcccattttcataagtgaagtgtcaggcatcacattggacattttaagattctttacagcccaatgattctgtgtttctaattaggcccaatgggttagagctaaaaggaaacagtgagtttcctggaaggaaaggacatataacacagtccagaggtaaaatgggctgtattcaagaaaagataggacaatactttgcagggatgctgcagagaggattcaagccttgtatggaggaatggatgtgatacaaccaaaaagtctttaaaaattctttccaactaatctgagatttgtaaccttatggactgtgatttgcagcaaaccaaggatgtgataaagactagtattgtttctagaatgcaaggatggttcaacatatgcaaatcaatagtattaacagaatgaaggacaaaaactatatgatcatctcaatagatgcagaaaaataatttgacaaaattcaacatcattttatgataaaatctttcaagaaattgggtattagaaggaatgtttctcaacacaataaaggccatatcagacaagcccacagctaacattatattcaatgaccaggaatgagataaggatgctcactctcaccacttctgtttaacatagtactggaagtcctagccaatttcatattaatgagcctcattttcttcatcatagaatgaagtatataataatccctgttatacttactttgcacagattattattattatttaattattattttgagacagggtctcactctgtcacccaggctggagtgcagtaccacaatcacagcttacttcagccacgacctcccaggcataaaggatcctagcccctcagcctcctgagtagctgggagtacaggtgcacaccaccacacctagctaatttttttttttcatttttttatagagacggagtctcactatgctgcccaggctggtctcaaactcctgtgctcaagcaatctttccaccttggccttccaaagtgctgggattacaggagtgagccactgcacctggccttgcagattattattaaactttgtaaactaatcaaatgagagtgattattgttactgttaagaactctgatagcctcatccatatatttggagaaattgaataaataataggaaagaaataatagcatcccaatgattttaccttggctctaccatcatttggggaagtgataattcagataggagaagtgacttggaagcagtcttgagagattgcctgttccatcccctatctttgtccttaaaccaaattgtacagataaataaggtcttatttttaggacttacagaaaaaagattcctttcatatccatctttgcaatcctcaaccacttctgtcactattatgtgtcatttcaaacattaaattcctcattctgctttgaaggaacacatgtgtcatgtgtacccatttgtatgttttggtgtgttttatgctttatgtgatcacccacatatgcacagataattccaaaatccagtgtgtgggtgttgtattccctgtgttaattattcagtcacactcaaacacctatgcactcacacatacatgaatacacacatgtacattagcatgtttatgcttatgttgcatgtgactggcaacatcagtgcctttctaaggcaatgttaactaccttgagttttgggagagctttagagaacaaagacaagagactaaatgattctagatgtaagagacaatgttgcaataagttactatcctaaaaagacagaatacagggacaagagactattattttggatagtttcttgcttaccagtaatacttaagtcctttacattaaaaaaaaaaaactctgtaaatatattgcagaagaaatccagacatccttcaagattcttagagctggaaaagattttaatgactttccagtccaatctatctcatgtaatcaatggggcccagagaggcaaaaggtcttgtccaaggtcatatagtgagttagtgataaggctgaacaaggattcagatgttggggcttccagcccactgctctttctctcatctgggatttgtgtatttttgttcattagagattttcctctgtaacctcaatatccaatgcagggccttgcacataatagattatcagtaaatgttaaattaatatgtcatggctttggttgtactgggcttttgcacttactcctgagtaaattgtaaagaatatctacgttttaggttgccttgttttagaccaagaggtacccagagaaaaggtgtgaactatgctaaggaaattatccgagttccaaattgaaaaaaaaaaaaaatcatgcttttccgctataacctctctcattcacagagtgattctctttcagaagggcaatctagaactattatgggagccatattccattggtggtgcaaccatttcttgacaaactagggtccaagaaagtattttcctggggaagatgagatttctcaaagaaggcacgcactttctaacctaagcttatttcagtaatcaatgtaacaagctggtcttgatgattgcagcagtaccaatactgtgggagtgtaccagttctagaacagctacaacattggaattgaacgcactagaattggatacaggacctgtttttgaggagctaacacccaaaggctgaacagcactcgtagcaccgtcctttctgtgcacatatggtagtcctcagtttgcaacagaaataaagctgttagcaaattatgtgttctatttatgcaaataaaatcttgtggtatgctagaaagagcactggcctggagaccttagttttctcatatgttaaaaacccctaacacaggcctggttcatagtaggcacccaataaatagtagttttcttcctttgggggcctccgattcagtgtgcttcttcaggtaagtcacttccctggaactcctccttggaatgagagttgtactgttgtgatttttaacagttccttcaagccaagcattttggaatcctttcataaagggagaaaggaaggaaagaagaaaggaaaattaaaggaaaaagaacaaataaaacgttaaaaaggaggaaaggaaaaaggatcctttactacaataaaactaatcttatgttcttgcaagtagcactttaagtaaaagaagttctttgctgacctggttactactgaacctactacataaaatagcctactataatagatgcatttatgtgcctaatcttcactttttaggcttagtaaagggagaggaaagctgatgtatagttaaatttatgtttttagttgtttttttttctactctcaaatatcaatcactctttagtttctctttctttttccgaccacaagcattcttcctctgcttaaagaagcttccctaaaatcccagtctatccagtaagccaaagcacagcaataaatttgaggaaaaaataccagggacttagagacagaaaggagtgaggggatgcagaagctgaagctggagcacggttgcaagcatgagaagttctgcgtgtttcagagcagccaaggatgtatttttgcctattcctgctggtgactctgtgtgtctatgcatccatctgctatatttacatgtttagtcagtcaatccacgtttgctgagagcctgctgtgtgccaggattgtgctagcgtaaaggagcaaagtattgagcaaaatatgtttgagcagctgtaattctgaggatctctaggtctgagcatgtgtatgtgtgtgcgcttctatgtatctgtgacaactccaggtgttcatgacagtgatctttgttactctgttggcttcatcgaacttccttttacttgctgtgattcactacatagagtgggctttatctctgatttttataacctgcaagactgggggtatgatcaccagcaatctaaaaacagttagaaatcccatggagttatcttttgtagaaattttcctctactaatattatgaaaaataagcatcttattagctcgagtgtaattctatgcatgattacaggtatcaataggaagaaacattgactgagttcaaatctcttctacgccatgctaaaggggtgacaagttccacaatggatcattttctcatgggcatttctgacttttggtaaaagtagagcaccttattttaaaaaccattgagtagtcctaatagtggagatatcatcaggatctgaattgttcatccctaaaaaaaacaccaatggaaatcaaacaatatagtgccaaattaaactgtttgaatatttaggttctgtatgatcaaattgtttggtgccatactctgtccacttttttcatgtggtaggatataatttcatatcttttctgttctagaaatacccgaagaaagagactctggaaactcattatcaggtctatcaactcttgtatttgttctcccagggaaacagaagtacctgtgcgccagcagaaatgattgcactattgataaattccgaaggaaaaattgtccatcttgtcgtcttcggaaatgttatgaagcagggatgactctgggaggtaagatacttttctttctcttcctcctccttcctctctcccccttctccctcattttctagtctctctttagaccagattttcttctttgatgcttccaaggggaccagccatgctctagacacaggctgaccctttcataggcaacgtggccatcagccagctggtgccttttttttaatccttatctataccaatccccattccggggctcagcattagagcaggcggtgtgaagcagggatcaggagccaacagaaggtgagtgaggatgcatctgactgggcagggcccccaggggacttaatgatactggcctgatgttgttcagtggtagctaggatgagagaactaagaaatccagaacagtcagaggtgcaggatgacccaggcataggcgcaggatgacccaggcacaggctgatcctgaacacctgggaatatcccttagctaactgctgcctatgttgtagggccagccacctcgaatgagaagctacttctctttggagcctgtgactaggctgccacacagagccaatttcctatcctatctctcccaaagatgagcaggtgttttaataatttccttttctttgcaaagctattgaccatttccaaaagcattttttttcagtagcacagtaacgtgatagatggaagatacagctctttcaagggcgttcctctatcataaggctctctgtcccacaaacctgtctaccatgagtgttgtcaccattccagaaaggcttgacatcagttgattgagacttatattttccctctccaaactcccccatctcttcatgtttacatctgcccaatgccagggtcctcgctgctgcctgctacttccaaaaagatgtgtctttcatgagaaaaacaagatcattaatccacttcgatttggaaatggaatttgaagaaaggcaagcctatttctgagtgcctgcaactgtagcctcatacccaattattcattattagcctggaaaacccaagtgcctagaatccaaccctctcccctctcctcttaagtctaatttagaccagttgtctatctctggctttctgtgaggtgttcaataccttgtctgcctatgtgcacatttatagacaacaactagttctcttatcctggagcagggccatgtgtggatcttcatatagataactatatcctccccatcctcacagggcagtagtattatttaaacagaacaaagtacctcacatgaattgacccaggctggatgagagacaatttcaaaagaatcatctcaagtagcgtccagtactcccaaacatcacaggtagatgttctgtgagtggctttccaagcatccacatcaaatgagactcagatatctgagaaaactcaaccttgttttggtttgcttggtgcaccccaaagaaatccaacaattgaggtctacagtggagaagaagtaggactggggtcagggagtacagaggcaaaggcaggaagggtgacaaagtgattgacaagaaaaaatgttctccatatgaatgttgcagccccatgttgagggttcttatacactcaactgtcaattatttagccttctgtgaattatgtatagtataaaagatagggactctcaagtagggaacctcttggcttgccatctggcaatatgaattgcaagtccactttgatgcaggtaaagtttaatggtaacaaaagtcctcataacatttggatgcaaatcttaacattaattccatgtctcagccaacattctccattattaagcagcctgtgatgtgattacagtgaaccacttttgaaaaggagcctgtgtataacagatagtttcactatactatataaccgtcagatgcaggcttgtaaattaatttgttggtgacaatgtttcagtacattttcaaattgattcattggtatagtactcaaatttgagtgggcttggtgaacacaatgaagacaagctgagaagtgctgtgactggccttcatttcagttgcaggcccatgatattttgagtgtcttccatgtacaaggcaccatgctaggcattagagcttgaggctggcaaacttcaggaagtgttcacaagataccaggattcttgatgttgtgtaaatggccttgcctttagagtcaggcagatctagtttaaaggctcagctcctttatttactgtgtgcccctctgagcctcaatttcctcatctctgatttagaaataccatcctcatagagttataatgagtatcagatgacatgatgaatgtgaacatccttgataaatagcaaaatgctagacaaatatgggggcttaatatgacattgaggtcactagtaatttagctggaaagtctgtaacacagcacttcccgatggcttttaccctaagtaacttggtatgccatataatatgtaacagcaccaacaggcagagaatcgccagaaaacactcttgattacctcaaacgaaaaagtaccaccaggatcctgttcagaagctaattttagtaattaagggaatcatatgctatgttcaaataccatgccagtaaaaacccaattgtttaccttcttaaatcactgcttgaagagcaaatctttccattttgctgaatgaacttatctccacgttccctgccctactgacacaaccccctcccaagtttattgttaacttacacattcaatgcacagcacacctttactcaaacaatggaaaagaaagaaagtgtcaattcaaagtggcccttgtctattccttaaggagtagacttccattttcatcagatttggatttagcatagacatattgattaccttgaagaagaattcatataattttatcttctgattcccatcactcaaatcaaaattacataatatattccaaaatggcaactaggaatgtggccttgggcaagtcccttctctcctctgatgcttggttttcccatcatagaactggaattgtggcttcaccgaggacctttctggtgctaacattttgtgattctatgtaaaaagccacacagaaaggattgtttttcagccctttcttagattgtctgttccctgctcccagaagtatagatagtgagacttgagtgctttgatacatcgtaattgtatctacctccattcacacctacttaagatatctgtctaaaagtagactagacagattattcagagagtggagggcagaagggctgtctctgtatcttaaagaagctggcactcttcagctgatggctgcttggtcttgaggcctcaagatctttaatctggctttctctatagtgtttcattcactgtttggtgatggaatctcttcagttcagagatacttaatagatatagctttttctttcctgcttccaggcctacctacctgtttcttgcttttttttctagcagctgttgttgtttctgaaagaatcttgagggtgtttggagtctcagaatggcttccttaaagactaccttcagactctcagctgctcatccacaacagagatcagcctttctttgtagatgattcattcctggctgcatttgaaaaccacatattgttaattgcttgacgaatttaaatcccttgactacttttcatttcagaaaacacttacaaaaaaagtccaaatgaggaccttccctccagtgaattagctgtggctttctcacagtccatagttaggataaatgtaaagccatttctcatttttctccgcactttccaagggtacactccttgtttccaagatggaatgagaaataaagaagtgcccttcctgccatcttctcccctgaccctttcctccttcccactttcctcctattcctccccaaacatgatttatttctgcgttttgcaactcttgagttctcagcatttagtaaatggtgttggtccctgttgattccttcctctcctggaccatggaaggtagtaggcctttcagaaatttcaggtagcagccaaaccccagaagaagagaaggaacacagagacctagaccatgtgagaacctgaggtgtgcagcatttacttcacagattcgtctagcatatttgagaggtgtctttcctactaggagactgaactctgcatctgagaataaaaacttaacatatctacaggttttgacaacctctgtgaattatctagttgagaggatggctcaaggagcctattgccatggtctgatgtcgttatggacgctatgaacatccttgcagtttccattgttgaagacagccctgatgccagctgtctcatcattccccatgttcaagagcatcccagcattgctacctcaggatcccatgtcctgaatgcaacagagtgatttcgctgctgaattactattcatggcatggctcttcacagcatttattcatccatgtatctatccattcatccttccagccagccaagaagttcacgctttcatcttttcatccatttactcacctatttattcatttagcaaatatttattgagtaccaactatgtgccagacactctgctaggcattttggggaagcagaactgaataagatactattcctttcctcaaaaatttgagcaagaggagaaaggaagtaatgaggaatattccttagccataaaggaaaaataagaaatcacttggaagaagttaggtgagatggaaggaaaaggacatctaaggtaaagcgtacagtttgaataaaggcacagagacatgaacaaaatgcattgagggtttgaggaacagcaattggtttaacatggccagagctggggaaatggtaagggcaagctgaaaccacattgaaagcaaacttggttattatactaggtagtttagacttcaagcagttgaaaatctttgagcatgggataggcatgatgacattgtgtttatttgcatgtttctttaaagaaaactggcagcagcacaaatgttttgttgatgagggtttaaattgtagaaagtgagacaattttaggaaggccagctagagagaaatttctagcatcaaattttgctaaacacctaggatttgtagttacctccatttgggttgttacctgcaagtactgaccacgtatatgaagaagtactggtttagaccaaggcaattggcttgtataagaggcctaccctcataccaaaagccagtttccttggtctaggccagtgtttactggtatgtgtcctgagaaaactagttccatgacatgttccatgaaaaatatgatttctattgtcaaataagtgagggaaacttgcatatcatggtcctgctcaggaagatttacaatccttattagcatatcacaggtcctggtgaatactgcggtaaagtaaccgaggagctttgtaactcaggattcccgaagttgattcaaccacaggacctcatttattcacataacacctgttatcctacaaaaccactgttctctggaatacactttcgaaaacatgggtatagacaaaaactctatcctataggcagagaatacctatacctctagctcaggtcatcattttgcagatgtgtgtgtcattaagaatcagtcaataatgcattaatgatcaaaagcagaccatccttaccacatggtgcataagattatgctattatgctattagctactaatgccactaaagttaattatgttgggtctgcaacgttgtcatacacaaaggataggatgcaaaactgtcctaggccaaagcatggttattgcccaagttatctaatgtctgcaggtacatattcctggcctaaggattgtgctaaagaagttatttctaagaaatatagtgacttccagcatcatgcagaatgaccatttaatattttgaatatctagacattctgctgtagaatttaatagtccttttatacactgtctgaccaacattttgacatttactcagaaccccatcacagtgctaccacataacctcattgctaaagtgggaggcctagaaatcacagatttgtagaaaccatccaatgattgaatcccctctacttcctgttcagcaggcagcagagtgtcataaagaattaacaacgtggaactcagttactgggatttcttccattctcctttgattctctagactagaattccaaagaccctcaggctggtgatgcaagtgggaagtctcatttctgagaagtgctgcttcctacccacaattctttgatagctgagtgctttagctgatctgcataactgaggtgtgcaccaaggagcagaattactctataaattttggcatcaacatgtgcaacttgtgactcagcactttgaaactctggggatttttttgtttggttggtttttgttttaagatgtcctgtggtatagtggaaatagtacaatagactcagatacagagaggccttgtttctagtcttggttctgtcacttactatcttgatgtccttgcacaaatcaccagacctctctgagcctcagtttctccaaccacactgtgggaataataaaatcttttttacggcattgttgtaagtatgtagagaaactggtacacagtaggcacacaatcaatgtcaccgtacccttcagcccttcttttgtggatgaaaaatggtctttgtgctcccagtcaccactggggtctgttctctctctctctgctgttacagtgtggcttttggttcttgtttctttgttctttggtctgtaaattacccttgaaacaacccttgaaatttccactccatgacctaaatcgtcatccctaaattggttacatacatatttggtgacactttggaggggaaaagctttatgtctctctaactgtagttcttaagggaatttgcatatggaaaaaacagagactgcgtctcttaattcctccaaaccaaattatctgggatagcacatatatgttgtactctgtctctgagcatttgctcttagagaactatggttagagcgaagtaaatttttctaatcataaaaattaatgataccgcatatctgatacttgaatgagtacctccttgtaaaatttatacttaaatccttgagtttttaaagtgtaatagcaatagaaagattttattgttgtttacttttactgtgagtgctccaaaatccctcagttgctcttgaaagagcaagatgatgccataggcaatattttccaaaggtagtaggcagaaaactgagtacacagcacacaataggccatatatacaaaagcaagtattttgcaaataataataattcaggaaaaaagcttcactttcgttggtaacctgtttgtttaaaaccattttattatttattatttaaaaagagtgtcacttgttacagattgtgggatgtgttccttaagatcacaaaaatgtaaaatattttctttttatactgaacacatgcatagacaacttacctgagcaagctgctttttggagacatttgcacatcttttgggatcacgttgttaagaagtagaactaagggaaaaacacgcagccacccagaaatcggtagagccttcagctcatctgttattaatatttctgtgacaacagatatctaggaagtaaacaggaaattgcatcgctatcctgcatcaccttttttggaatcaggttccattcttctcagtccagttcaaccttgtgatactttttagatctcaaccaaggcatagaaatatattttcccttgcttaataccccatggaaccaatgcccctgtggttgaagtaaaaattgattgttgagggacatttcagccctctagcagtcaacaattaaaaacatgtaagcaccgagcacctgcagaaaacttggactggcatttggatctaagaagaaaatctgcatcttgaccaagatgaaaagtcaccagcccaagcttgtgcagtgaagtgtcatgttggccacaatgaaactgaaagagactgatgactctcctcagggtggaaaatgaggcatggaagctttgattagtgagctgttaggcacacagacattaatttcaaagcattctcatctccagtctgagtaataatgcttatagtattatgcaattgtttggctgctgcaagaaattcagcagactccaacaagtagtctttcttggtctctgagtgactgtaacttaaattctacctcccttctcttctcctacatcttctcactccccaccccacccccacatacacacaattcttgtccactatgttcagagagatgcacgcacacatatatatgtatatatatagtatatttgtcaataaagcagaaaagaagaaaaaactccaagtaaacaattttccatttccccatctcacttctgtcttacaagtggataggaaaagaaaaacccccagtaaaaaatggcaaccgcccacctccccaactttacatgctgcttcctatgttagaggatctgtcttaggcatctgattatggagcctgctagatacaagcccgtatttagactgctacagtcaacaatgtctctctttcatactagaaaaattccgggttggcaattgcaagcatctcaaaatgaccagaccctgaagaaaggctgacttgcctcattcaaaatgagggctctagagggctctagtggatagtctggagaaacctggcgtctgaggcttaggagcttaggtttttgctcctcaacacagactttgacgttggggttgggggctactctcttgattgctgactccctccagcgggaccaatagtgttttcctacctcacagggatgttgtgaggacgggctgtagaagtaatagtggttaccattcatgtagttgtgagtatcatgattattgtttcctgtaatgtggcttggcattggcaaagtgctttttgattgttcttgatcacatatgatgggggccaggcactgactcaggcggatgcagtgaagctctggctcagtcgcttgcttttcgtggtgtgctgccaggaagaaactttgctgatgggactcaaggtgtcaccttggacaagaagcaactgtgtctgtctgaggttcctgtggccatctttatttgtgtattaggcaattcgtatttcccccttaggttctagccttctggatcccagccagtgacctagatcttagcctcaggccctgtcactgagctgaaggtagtagctgatccacagaagttcagtaaacaaggaccagatttctgcttctccaggagaagaagccagccaacccctctcttcaaacacactgagagactacagtccgactttccctcttacatctagccttactgtagccacactccttgattgctctctcacatcacatgcttctcttcatcagttgtaagcctctcattcttctcccaagccagactcaaatattgtattgatgtcaaagaagaatcacttagagtttggaatatcttgttctctctctgctccatagcttccatattgacaccagtttctttctagtggagaagtggagtctgtgaagccagggaaacacacatgtgagagtcagaaggactctccctgacttgcctggggcctgtctttcccaccttctccagtctgtctaaacacacacacacacacacacacacacacacacacgctctctctctctctccccccccaacacacacacactctctctctctctcacacacacacacatacacacacacttctttctctttcccctgactcagcaacattctggagaaaagccaaggaaggacttcaggaggggagtttcccccttctcagggcagaattttaatctccagaccaacaagaagttccctaatgtggattgaaaggctaatgaggtttatttttaactactttctatttgtttgaatgttgcatatttctactagtgaaattttcccttaataaagccattaatacaccaatcgtattttcttatttacaacagactgagagaattaatgctgttaacattggatcttttttcttttttttttttccttttttttctctctcgtttgctttccaggtcatgctgacctgttcagcttggactgtttcacatttgtttttaatgtcagtttaaatgtaattgtaaaagcatgtatgctctaaaatcatgtagttacttttttcagtggaaaagcctggtattcgaaagcatttccaggctctgcaatttcatatgagcaggtttttggtaaaatcttttgtccctcactcagggtggtatctggacagtgagcccctttcttctggctcagtagtcagagagaggagacttggagacagtttctgctggatcctgtgctttggcaaggatgtgcagcattgcatatcattctatcattaattatgtttactcctccatgaactaaaaaccattagactaaatagtccaacataaaccttgaaagataaaatttgatattcttttgcctggccatttctctgacccagaattggggctgggaggggattggagacttgggggaaagaatcaaggagccttcttgcctgggggaatttggcatgcacttattaatcccatttggttgcactccctactaatccctcactccatacctgccaaggattggctctgctccctgcttctcatccctgtcctagttcttcctcacctatctccatttcccactactgatccttctctccagtaagatgctattcaacccgatgaaatataaagagtagcaccaccctggaagtcaggataccttagttttagctcctgctctaccattatctagctgtgtgacctggggcatgacttaacctttgctcttcagtctgaacagtctttaagaattggtttggaggaggaaggaagggatagacaagatccaaggcctttgaactcttttttggaaatgggtccttttcttcaaacaaaatttgatgcagagtcccaaatttacctacagaataaaatactgctgttcttgtttgaaaggaagtggggtgcttggagccacatgctcaggcccactttgccccctctcaggaaccctcgaaaaaacttataggacttataggactgttggggatctgccaagtctctcttatgttacatttcagtccttgtgaaactctatatgtttcatcagttcactttttcagaaagttcacctgcttggggtaaaggtcatgaagtggagaatgtggggctcagtaactagcaatagtaaaaaacatcattgattggcttgcagaatttactctgttctaagcatcttacacacatactcatccgaaaactcacaacaaccttgtgaggtagatctgttattatcttaagattctgaaacctgccagcatgactctcaatctttgacttgagaccagttgcccaacatggaaggttatacttttcacagtttaccaccataagcagtctttcagagtgatttctagctagagatccattcttagaaaaagtcagaacctgcccattagcatacactgtcacatggtgcagagtaccttcactgggttcatctcatttcctcctaaaaatagtcctatgcagtagtccagtcatatcatcaccattatatagatgagaaaaactgaggtgtaggagaaatcaagagatctgttcaaggtcacacattccataagactctgaataccaccatcaagaataataaaccttttatgtgaaaagcattttagaacttcagtgtcattattgcattctgcctcctggagttcagtgcactttttcaccatgctttaatcttggagtcctggtggtacagaatctgccttctactctcagacaacaccacagtgtctttatccctcataacaaacttatgaattaagtaatgatattatccccattttacaaattagttaactgagataccaagaggctaagtcttgcccaaagtcacacagctagtcagtgatagagccggagttacaaatgaggcatcctgactccagaatatttgctcttaactactactctttatacatatgtaaggaaactaaaagcaaaagagggaaagatgtccctgaggccccacagtgagctcccctgactcacaatccagtattcctctgaccttctaatcctaaagttatacagtaaggtcccttgactctaatcctagtagatggaaagatggctggcatgatttaagccagaggccacaaactggcttccccagagccagaattcacctgcagaattctgtttgtccagcacagtgtttgtttagaaaattgacgtagactgcccctaggcagggcatcaatcactgtcattgtccccagccctccttatttatgtttgccaggcttttttactcatttatgtgtctgcctgacttgtgaaggtatttgagtttatgacttttagatttaagcattgcaatatataagcactgcacacatgcattcacaaaagtatagcctagtctagcttcacaaagaatttgtagccctacaccaaacacacctttatgtttacttagtgtttagaattagatttaagatcagaatttagtttcacaggcattcatgtgtggaagaacctcagttattgttttttgtttcatactgtctcacccttgctttccctgctgtgtctggacccctgtcaatcctgctttctgccattcttcatgcctgagttagggcccctgcaagccattcactggttaatctttaggaatgaatggagagtgaaaaccagtttggagggttcactgtgtcccaagcatcctctcatttagttctcataagtgtcctaagagacaggtagcagcacattcgttttataaatgaggaaactaaatctcagagaagctgaacaaagacctcaaagtcattaaggtagtaattaacggagccgggatttgaacgcaagactgttggactccagagcctattcttttgccctacaccacagttccttacaaggaagatgtattcattttctattactgcataacacattgccacaaatttagcagcttcaaacatttatcagctcactgttttgtaagtcagaagtctggcacagcatggctagattctcagttcagggtctctgaaggatgaaactgatgtgtttaccaggatgcattctaatctgaagctcagggttctcttccaagctcatgtaattattgcaggattcagttatttgtggttgtaggactaaggctccctcttcctttctggctaccagccaagggccattctcagctcttggaggctgccctctttccttatcatgtggaccccaacgccttcaaagccaacaacagagactcttccttgtgttgaatgtttctcactctacggatgtctttcctggaggatcccagtcccgtaagggctcacctgatgaggtcaggtacatcaagaatagccacccttcaaattcaactgaattagcaccttcattacatctacctagcctttttacaacagcatctaggttagtgcttgactgaatgactggaaactaaggtctcagaatctcggggaccgtcttagaagtcagcctactacagatgttgattcttttcatgtgtcaaatttcatagtgagatagggagaacagaaacatcacatccttgaccttaggtaaagggattcaaacttcctaagactttggaaacttcacgccactttcaccttttccttaatcatggttgagaaggcctatatcttggagtggccaggagtgagactggaacagtacctaaaggttaaggacgctaaagaagttacagattggttacatctgctcctccctaggaatgatccatggaacctgatttgaaatttttttctctggtgctatagatagctcccacaggggtctaatgccccagggctgaaaagttagttccccataggatccatccaggcatgatatcaggccaggtgttacaatctcctaaagaggaggtatggactggaaagccccttgccaatggccctttcttgtcactgctctgacccaagactaacagggcagagatagtgaactcacatactattaaaactatccacttatacttccccctttctctttgctttatcactccatttaagtaaaccaatgagtctctgccttgacacagtggcaagctgacctgtatcttatatgaaagaattagatttgactctggggctcaggtgcagagggcaggaggggcataaggatggccttcatggaagaaaagaagtccttggatactgagtaacagctgagactagcaagcctcattgtccaggattccaagtcgtctagcaacatcctggtctctgctgcagacagaacagaggatcccccggcagaatgaatggagtctgatttcaattacgttcagtatagtcactctctttaggcagagaagccagaacacctggtgcagctagggccactgtggtcacagggacaagcacactacctgggtcctggaggcaagtgggaatgcagtttttcttccttaagcagatgccatataggcctggggaggaggatgtgagaataccagccaagttctcattggcactatacagagaaaggggaattatttcatcttgatggattctccccacagtctctgcacatattgatcttacttgtaatgagtttgcttaggttcacgagtcatcatcccagggagatctgagtcattggtgggaaagtcgaggcgacagattatatctcactgatctcactgtcaccaattgctctgtgtgtccctccaccttttgaaaaagtccatggattcatttgtgtgtaattcatttggatttatttcttctttatcaatagctttagtggggtattgcaaatgggaaagttgccccagagaacagtgtacattcacagcattattcagtagaactttctgagatgatgaaaatcttctatatcttatgttgtacaatataatacagccactaactacatgtagcttttgaacactggaaatgtggcaggtgagactgagggattatatttttaattttttaatgttgtaattaatttaattttttaaaatttttgctttctattttatagtttaataattaaactaaacttacgtagcccacatgtggctagttggctactatactggacagtacaagtctagaaggatctcagagagacacatgctgagatacagcaggaataagtcaaaaagagagccaatgtaacatagggaattctggattgggaattagagccctggctctaatctcagctctgccactaggtgaccttgccctctctggcttcagcctccccatctttgacttgaaaggttaaactaactaacgtcgaaagtcccaaaatggtggctatggactgaattcaattttgggatacacaagtttcaggaattttttaaaaatctattaatgccttctaggtgtgtgtatgcacgcttgcagacatgtgcccatgcacaagcatgggaaggcagtaaggcattcatttcaattcaccagtgtactaaccattcacacacacacacacacacacacacacacacacacatgcacacacaccctactgtattgcctatgtagagcctgaagatcttttaatctgtcaccattggataagataatttctaaggacccttcctgttttgtcatgctgaaaatctttaagccactatagtgtcccaaatctattccagtttgggcagatgactggagtattctcatagcctcctgtctattcccttctggatttgatactagttatgaagtttggagtcaagggtgaagaagggaggcagggatgatataaccccagccccactcctcaactctgcttttgagttagaagtagggttcagggcttcagattccttggggaggcagtagagagaatatgggctttataatcagaagatgaggttcagatgattgggttctcaccttttttatagctgtgttacctcagtttattcatttgtaaaatagggataagaaatatctttaacctcctaagatcatgtggaattaagtgatgtaatgtgatgaagcgaggcacgcagaaggccctgaaaaaattagtagttacccttaaggggactaaatggtctggcaactcccgagctcaaagctagaaaggtccagtaatggggaagatggggtctttctgtaggaactgtagcaggggagcagatcctgtaggccaccagtctgtggagctgtgtccaagaactcatgtttgcaataagcccaccaaatgacaagttattgtggggttcaggcctctaactcaagaagatggtcttggcccagatcataccttgcagcctgtgcctttggtgggatgtgggtgttggcagtggctatgcatatctccttattactggctgtgccaaagccccgcagaaatgattgttggacaaagtcatcttgcactcagggctggttttccaggcttccttgttattttcccctgagttcttctgtgttcctcttgcaacaccaaccccactattttcctcttccctaccctagttgttggtccaaacatgtaatccattcttgcagtgatttattgggtgacaccatgactggagtttgcattgaaggacttctttttctaattagaactaaaagtcagttccaggctgggtgtggtggctcacgcctataatcccagcactttgggaggccgagatgggaggattgcttaaggccaggagtttgagtccagcctggacaacatagtgagatcccatctctacaaaaaatgttaaccaggagtggtagtgtacaactctggtcccagctacttgggagactgaggagggagaattgcttgagcccaggaagttgaggctacagtgagctttgatcgtgccactgctctccagctgggtgacagaggaagatcctccttcaaaaaataaataaaaactaaaaaaaaagtcagttccaggttgtatcttttttcacaggggccagacacagatgagagcaggttttgttgtatttatccatttaaattgagcaataaaattctctctttggtttctacctttcttatttattattattatgttaaagggattaaagtggttcatggtctttctcagtgcaactgcttatgctagacctcagaattatgaccttttcaattatttatatttctgtctatataaatactggaaaaaatagtacaaagtaagcatcggaatgcctaaggacctctaaattgtgtgtgtgagcacatggggaagatggttcttaaggtttgagttttggattattgtggttgtcttaaataatgttatttctatcattctttccaatgactgtctcctagcatagttcccattttacagactgatggcagaggcagaaagattctctcacttctttgatactattgaggacttcagcctttcaccgctcttctcccctttgctaaaaaagaaaaaaatcaatatgtatgttacagtgcatttttttaaatattttttattatactttaagttctagggtacgtgtgcacaacttgcaggtttgttacatatgtatacatgtgccaagttggtgtgctgcacccattaactccttatttacattaagtatatctcctaatgctatccctccacccttccccaaccccacaacaggccccagtgtgtgatgttccccttcctgtgtccaggtgttctcattgttcaattcccacctgtgagtgagaacatgcagtgtttggctttttgtccttgagatagtttgctgagaatgatggtttccagcttcatccatgtccctacaaaggacatgaactcatcattttttatggctgcatagtattccatggtgtatatatgccacattttcttaatccagtctatcattgatggacatttgggttggttccaaggctttgctattgtgaatagtgccacaataaacatatgtgtgcatgtacctttagagcagcatgacatataatcctttgggtatatacccaataatgggatggctgggtgcaatggtatttctagttctagatccctgaggaatcaccacactgacttccacaatggttgaactagtttacagtcccaccaacagtgtaaaagtgttcctatttctccacatcctttccagcacctgttgtttcctgactttttaatgatcgccattctaactggtgtgagatggtatctcattgtggttttgatttgcatttctctgatggccagtgatgatgagcattttttcatgtgtctgttggctgcataaatgtctttttttgagaagtatctgttaatatcctctgcccactttttgatggggttgtttgtttttttcttgtaaatttgtttgagttctttgtagattctgggtatttgccctttgtcagatgagtagatggaaaaaattttctcccattctgtaggttgcctgttcactctgatggtagtttcttttgctgtgtagaagctctttagtttaattagatcccatttgtcaattttggcttttgttgccattgcttttggtgttttagacatgaagtccttgccggtgcctatgtcatgaatggtattgcctaggttttcttctagggttttatggttttaggtctaacatttaagtcttgaatccatcttgaattaatttttctataaggtgtaaggaagggatccagtttcagctttctacatatggctaaccagttttcacagcaccatttgttaaatagggaatcttttcccaatttcttgtttttgtcaggtttgtcaaagatcagatggttgtagatacgcagcattatttctgagggctctgttctgttccattgatctatatctctgttttggtaccagtatcatgctgttttggttactgtagccttgtagtatagtttgaagtcaggtagcgtgatacctccagctttgttcttttggcttaggattgtcttggcaatgcaggctcttttttggttccatatgaactttaaagtagttttctccaattctgtggagaaagtcattgatagcttgatggggatggcattgaatctatgaattaccttgggcagtatggccattttcacgatattgattcttcctacccatgagcatggaatgttcttccatttctttgtatcctcttttatttcattgagcagtggtttgtagttctccttgaagaggtccttcacgtcccttgtaagttggattcctaggtattttattctcttagaagcagttgtgaatgggagttcactcatgatttggcttctgtttgtgtgttattggtgtataagaatgcttgtgatttttgcacattgattttgtatcctgagactttgctgaagttgcttatcagcttaaggagattttgggctgagacaatggggttttctagatatacaatcatgtcatcggcaaacagggacaatttgacttcctcttttcctaattgaataccctttatttctttctgctgcctgattgtcctagccagaacttccaacactatgttgaataggaatggtgagagagggcatccctgtcttgtgccagttttcaaagggagtgcttccagtttttgcctattcagtatgatattggctgtgggtttgtcataaatagctcttattattttgagatacgtcccatcaatacctaatttattgagagtttttagcatgaagggctgttgaattttgtcaaaggccttttctgcatctattgagataatcatgtggtttttgtctttggttctgtttgtatgctcaattacatttattgatttgcatatgtggaaccagtcttgcatcccagggatgaagcccacttgatcatggtggataagctttttgatgtgctgctggattcagtttgccagtattgtattgaggttttttgcatcgatattcatcagggatattggtgtaaaattctctttttttgttgtgtctctgccaggctttggtatcaggatgatgctggcctcataaaatgagttagggaggattccctctttttctagtgattggaatggtttcagaaggaatggtaccagctcctccttgtacctctggtagaattcagctgtgaaatccatctagtcctggactttttttggctggtaagctattaattattgcctcaatttcagaacctgttattggtctattaagagattcaacttcctcctagtttagtcttgggagggtgtatgtgtcgaggaatttatccatttcttctagattttctagtttatttgcatagaggtatttatagtattctctgatggtagtttgtatttctgtgggatcggtggtgatctcccctttatcattttttattgcatctatttgatttttctctcttttcttctttattagtcttgccagcagtctatcaattttgttgatcttttcaaaaaaccagctcctggattcattgattttttgaagggtttcccatgtctctatctccttcagttcttctctgatcttggttatttcttgccttctgctagcttttgaatgtgtttgctcttccttctctagttcttttaattgtgatgttagggtgtcaattttagatctttcctgctttctcttgtgggaatttggtgctataaatttccctctacacactactttaaatgtgtcccagagattctggtatgttgtgtctttgttctcattggtttcaaggaacatctttatttctgccttcatttcattatgtacccagtagtcattcaggagcaggttgttcagtttccatgtagtagagtggttttgagtgagtttcttaatcctgagttccagtttgattgcactgtggtctgagagacagtttgttataatttctgttcttttacatttgctgaggagtgttttacttccaactcagtggtcaattttggaataggtgtggtgtggtgctgagaagaatgtatattctgttgatttggggtggagagttctgtataagtctattaggtccacttggtacagagctgagttcaattcctggatatcctttgtgtcttgttgatctgtctaatgttgacagtggggtgttaaagtctcccttgattattgtgtgggagtctaagtctctttgtaggtctctaagtaatcactttatgaatctggttgttcctgtattggtgcatatatatttaggatagttagttcttcttgttgaactgatccctttaccattatgtaatggccttctttgtctcttttgatctttgttggtttaaagtctgttttatcagagactagcattgcaatccctgcctcttttggttttccatttgcttggtagatcttcctccatccctttgttttgagcctatatgtgtctctgcacatgagatgggtttcctgaatacagcacactgatgggtcttgactctttatccaatttgccagtctgtgtcttttaattggagcatttaggttaatatttacgtttaaggttaatattgttatatgtgaatttgatcctgtcattgtgatgttagctggttcttttgctcgttggttgatgcagtttcttcctagcctcgatggtctttacaatttggcatgtttttgcagtggctggtaccggttgttcctttccatgtttagtgcttccttcaggagctcctgtagtgcaggcctggtggtgacaaaatctctcagcatttgcttgtttttaaagtattttatttctccttcacttatgaagcttagtttggctggatatgaaattctgggttgaaaattcttttctttaagaatgatgaatattggcccccactctcttctggcttgtagagtttctgccaagaaatccactgttagtctgatggcttccctttgtgggtaacccgacctttctctctggctgcccttaacattgtatccttcatttcaactttggcgaatctgataattatgtgtcttggagttgctcttctcgaggagtatctttgtggcgttctctgtatttcctgaatgtgaatgttggcctgtcttgctaggttgggtaagttctcctggggaatatcctgcagagtgttttccaacttggttccattctccctgtcactttcaggtacaccaatcagatgtagatttggtcttttcacatagtcccatatttcttggaggctttgttcgtttctttttactctttttttctctaaacttctcttctcgcttcatttcattcatttgatcttcaatcactgatacccttttttccagttgatcgaatcagctactgaagcttgtgcattcgtcatatagttctcgtgccatggttttcagctccatcaggtcatttaaggccgtctctacattgattattctagttagccattcgtctaatcttttttcaaggtttttaacttctttgcgatgggttcaaacttcctcctttagcttggagaaatttggtcatctgaagccttctctcaactcatcaaagtcattctccgtccaggtttgttctgttgctggtgaggagctgtgttcctttggaggagaagaggggctctgatttttagaatgtttcagtttttctgctctgttttttccccatctttgtggttttatctacctttggtctttgatgatggtgacatacagatgggattttggtgtggatgtcctttctgtttgttagttttccttctaacagtcaggaccctcagctgcaggtctgttggagtttgctggaggtccactctagaccctgtttgcctgggtgtcggcagcagaggctcagaacagcgaatattgctgaacagcaaatgttgctgcctactcattcttctggaagtttcgtctcagaggggtacctagccatgtgaggtatcagtctgcccctactggtgggtgtctcccagttaggctactcgggggtcagggagccacttgaggaggcagtctgtccgttctcagatctccagctgtgtgctgggagaaccactactctcttcaaagctgtcagacagggacatttaagtctgcagaggtttctgctgccttttgttcggctatgccctgcccccagaggtggagtctacagaggcatgcaggcctccttgagttgcggtaggctccacccagttcgagcttcccagctgctttgtttacctactcaagcctcagcaatggcgggtgcccctcccccagcctcactgctgccttgcagttcgatttcagactgctctgctagcagtgagcgatgctccatgggcgtgggaccctccgagccaggtgtgggatataatctcctggtgtgccgtttgctaagaccattggaaaagtgcagtattagggtgggagtgacccaattttccaggtgccatctgtcacagctttgcttggctaggaaagggaatttcctgaccctttgcacttcccgggtgaggcgatgcctctccctgctttggctcacacttggtgcactgcacccactgtcctgtacccactgtccaacaagccccagtgagatgaacccggtacctcagtcggaaatgcagaaatcactcatcttctgcgtcactcacgctgggagctgtagactggagctgttcctattcggccatcttatgaatcatgcatgttcaactatgagcaactatgtgtattcaatgggaaatggaataccataaaattgtcatatgttgagcccaaaatgataggatagaatttgatagtctgaggatggaaaggaccttcaaggccacttttaaaaaccccattcccatatgatgcttgaattcttaaccactgtgtgtctagtattttctcatttccagtgatatgtgtgcctgccaacctttccgtctccaagagctttaactatcaaaatgtatgtgtgtgtgtttttgtgtgtgcatgtgtgtgtgagtgtgcgtgtgtgtgtgtgtgtgtttagagagagagagagagacagaaagagaaggagagactaaaatccaattcactgttctttctgggacccaaagaacaagtctagtcattctccatttctagtctctttccctagcaatcggctagacatgctagacatagacacatgtacatcactcctttgaattacaacattcagtatttgtctatcacttatatgataaaatacaaacttagcttttatttttatttttttagagacagtgttttactatgtcacccaggctagagcatcagtggcacaatcatagcccactgcagcctggaacccctgggctcaaggaatccttccacctctgcctcctgagtagcagagactacagatgtgcaccaccagacccagctaatttggttttttactattttttgtggagatggtgtattgtcttgtggtgttgctcaggctgatcttgagctcctggcctcaagcactcctcccatctcagcctcccaaaatgctgggattacaggcatgaaccaccttacccagccaaatttcttaatatgatatacatgctcctttaaaatcaagcaccatctttgctttcaacctcattattaaccactttcccatatatgcaacatatgtttcagccatactagtgtctagtttttccctgaacactccttggtgcttttgtttatgccctttctgcccacctttgcctggtgaaatcctcatcaatcttcaaattctatcaaatactatcttccatataaagcattttctaaacccacctatgtaaaaagattagtgttttcctattttgttgatgcctccattgcagcattttccagtccaacgttttctagaattgattgtggccaggctaccagactgggccagggcctgtgtcttttctgtcacccagaagcaaaggtctaacaatggatatctgctgaatgaatgaacgaaaatgaatcattaatatattagtaaatacgttaattaaagttccaggtatgaatactgaaggctgcattcaggcagagctggatccaaggatatgctaggttggtctagcacaagaatcagagttttcctctgcaagctatgaaaaatttgggtttagcaggtatttgggatgatgaattatacatttaaccagtgttgaatgagcacttgtccttaaggagtttagagtctgtgaccagggagaatggtgattttcttagctagggcagtttttctaaaaaggtagttgcattgtgtgtttttgaccactgatgataaattcaagtctctcttccttcccaatagcccggaagctgaagaaacttggtaatctgaaactacaggaggaaggagaggcttccagcaccaccagccccactgaggagacaacccagaagctgacagtgtcacacattgaaggctatgaatgtcagcccatctttctgaatgtcctggaagccattgagccaggtgtagtgtgtgctggacacgacaacaaccagcccgactcctttgcagccttgctctctagcctcaatgaactgggagagagacagcttgtacacgtggtcaagtgggccaaggccttgcctggtaaggaaaagggaagtgggagcatgagataagggggatcatatttagtgaacgctcctatggaccagccaccatgtctggtgcttttctgcccattaactcaggcagtcttcatcataaccctgtgggagagggattgttacaagtctcaatttaaacatacagggatcgaaactcagaaagcaaagagaaagatagtattatcgggtgtcttatgtggcccacattgatgcacagcagtcatgctttcatattcaactcacaaaaatggtcagcaaattttccattaatcacaaatcacatagacatacccatatatgccttaggatgctcttctatatttgcacacacaggctcaccccaaagataatctctagtttgactgacattctgtcttcaatgtcatctttaggagctatatcatgggaactctcataatatggtatggtggaaagaacatgaggttgggaatcagaacacttcgggtctgctcttagctctgctagtaacttattgtgtgatcccttccccttctgggtctcaatttctctatctgtataatgtataaagcgtggtttgtatcaaattgatggtttccagtttttgaaaaaaggaacgctttttgcaccttaaactacctaaggaatcataatgagaggaaagattaggtaatagtgaaagaattaccaagtgttggtctaacagaagttggataacagaagttcctcagtgatggggaactcacttctttcttatgtcatctgttgtttaaacaagtctggttattaaaatattacagcttaaggaattcttagagatcctctatccaatgattcacaaactttcctttagcagccaagtgctttatttctcaaaagaattgtacacagatacaagtggagctagtttatttaaagccagagcctgtagcttgggcctcaccagttcagcctctttctctctatcccagggaagccctaggtcactcttgcaaaatcttagggctccaaggaacacagtttgaaaaccagtgaagtatatgccctttaaaggttctcctaatcctgcaattatgattcaaagattcttttgaaataacaacaaccaaaccttctcttgtggagtcaaagattaacctgcctttcaataataactgccattcaggtagaaatttatagtgaacagagcaattttgtatgtattacctgaattgattcttataggaatcctataacatgagattctttctcttattttacagaccaaatagggaagctgtgagaatgatgtgattggcctatagttacatagtcagaaaatagcaggaccagaacttgagcccaggttctctcctgattccaaattctctctattccactccacctgtaggctgtagcaccactgcagttctgtagctctgggctttacagtgaggggccaaggcttcattgaaggccacttgggtcatagtatgggcttgttgcatttgaagacatttcatgttggctgtcaagtcttagatttgtatttccaactcacagggcctggtcacagccctaaccatctcttataccttctcagcttgggaagctgaggtcgactagccaataagaacactgggaaggaaacccaaggactctgactggatatgctctgtgccaaaacagagggttcactcagagaggaaaaatataaaaaagaaaaaggagaaggttgctttaattcttatcactttttcatctggatattttgatatcatgtgtttgacagagattcaaagtttaatcttcccaagcagtttccaaacacttatctcattttataggctacagagctttttcatatatatgatcccacttaatctttacaacaattctatgaatcatagagactattatttccatttcacatgccaaggctcaaagaggttaactaacttgctccatttggtcacttaacacatggaaccagaacttgacctagaccttcgggtttctaaattggttatcttgacaataacctagtgcaaaacactatagcagaatttgtatgacttgggatcactggggctttccttggcccaaccaccaagatggaaagccccctccccttacattaacaaatctgcaagccaatatcagttcaccatctagcttgccagactaaatgatttctgaccccaagtcttttaaaagaatagcttcaaaagaaagccaattaccacattcacaagaactgttcttcatattatctataattacctacaagtacaagtaatttgctaattcaatagattgagttcttgacctgtaagatgaactgtgctaggcccctaataagataaattttgttttaagttttctgtgacagtaaagatgtatgaaaattgcctagtagagtacctggcacattaataaatgataactgttaatttggagtgggtgagtagactgggtgtgcacagtatatttagaatcaaatttatctggtttggaatcctagctatggactagttctgtgaccttgagcaaatcacatgtcttctctgtgcttctgtgtcctcatttgtaagatgatagaataatcactacctttcaaattgttgtcaacaaaaagattatgtataaagagcacctagtaacgtagcctgaaacatagtcaatgctctgtaaatggtggtttattattatgagacttgaatgctaagccactgctttcacgaaactcaattttagctaccacttgccttgcctagaagctcatgcatggaccccaaggtgaaattgtgttctctgaagacctcggctggcagatgtactacagcagcaaagatttccaaactggcctttctttgagcccattctcccagactagacaggagactacaagtttctgctgcacatgaaaaaaatatgatgtcaatcggattctagtgagaaaacagagtctcaaagaaactgcttctgctccctagcgtgtttaatgtgtttcagaacctgagaatgactcctctctgtttctccagaacagcctaacacagtggcaaatgggtgttgagtgaatgcatacttaaggaaatctgtagggttgcagctactctttcctcaagtaatcccttgatagtcatgtaggctacttcagagattgggcattagagaacagagtcaggtattataatcagattagactctagggaggttagccagccatattgctgatatgtgcacagttactgggtttgagtgctaagcagctctcattaaggacggttaattaatattatggccaaattaagctttcccttttctctcctctttgttagttcggtggcattttagggagaaaaaaataagcatcagtatggacaatttgcttgatacctgtacaatttaattctcatccttccatgtgccttcacattcacacattccaccagaagaccaaggttcaccagccaaaagcttttcttgctccccactgcctcctacccaagatattcagggtcaacctcccaggcctcttctctaagagatccttggttgctacatgcttagaccctgcttcttatttcctgctgagaagggtcagtccaaggcattctgtgctacagaagggttccaagcaggaactactctgggatctgaggctccagccggtctgtcagcgtgtcattacagtgaaggtgggaagcacaggcctgggagctaagactgctaagatgagggactctagaatccctgatacctggaaggcctaggatctaaaagaaaagaacagggaaatggggctatatgagtggacagggaccaaccaagcagaacaatgtgtctggataatgtagacttcagacctgatcctatggctgacaaaagctggtgaccttggtagttcctgagctgtaaccttcattagtggagtagaaaaaacactggagaagagaatcagaacacctgggttctagtattagttcagccacatataaaccatatgaccttgggtaagtcagtttatttctctggccctcatgttccttgttggtaaaataagtgccacatcacctaacctctgggattattgtgagagttaaattaggtcatcaacaggaaagtgagaagtttgatctaaatttggggaagcattcctaatgaggtatgatgacaaaatttcagataattctggatttgttggtgagaagagagagtgttggtagggacgagctctgaggtgatgcctttataactttaagcatccaactgtttcaaaaactccaggagaacatggccatgtctgttctacctgtgtattattgtagacgtagcttctgggagcctctgctctctgagcttaagggaggtaatttggagatcatttaattctcattttacaaaaggaaaaaaaattgagggtctttaggccatttgtttaggtaatatttcttaagtgcccactcaaatacgtggactgtactaagtactagggaggtaaagataaataagaagatatggtccctgtcttcaagaagctccaagtcttgtgggggagacagacatgtatatacatagacttcaatgctgtgtaatgactgctataattgggtgaggctacacaaggtgcaatgagaatgtaaaagaagaatctttaagccttcttcttggatgagttgggaaagccttcacagaagaggtagcctttgagtgaagacttgaaagatgagtagtgtttaccggatgaaaggcctgagaaggaggaatgcattctaggcaaaagtaactgcctgtgcagagataacagagatatagaggcatgtgagagcgcaagtggcaagagatcagtctaggtaggcaggtcataaagggcctattcatgtataatgatggcagtaagatgaggatggcagtagggtgggaaattagtagggccagggtacctattgagtagaaaagaatggagaggaaatgccaggcagaaagaggatggacgcaagagagggaacatgaaagtggtgaacaggtggcagtggctgtcaagacatctctccataccctgtacactgtatgtaatatccatctcccagggttgttagaagggtcaaaccagatcgtagctggaaaacagctttgtgaagtgaaaactgctgtttatgtgggggaaatgattgttaaactgcatctttggaaaggtgaagtgatcaagagcacagaccttggaatctgactgctttgctttgtaacttggtctgccaattactagctgtatgatcttggacaagttccttaacctctctctgactcacttgtactggttcacagaatggagataataatagtacttaccttactcattgttgtgaatgttaaatgagataatataagtaaagtgcttagaaaagagttaaatgtaccccataaatacatacaactatcatgtacccaaaattatttttaatttttttaaaaaagagcaatccaatagcaaaagaaaaaaagagttcactcatataagcagtcaataagtgttagattatttttctcttacaactgacaatgccctttttgtctccatcatcatctcatttgagcagctcagggaagtagggaggataaggaatattatcctcaccatatagtttgtgcttttccccaccaccccttaatggccagcctggatggtccctggggatccttaggggatgcccgaataccagagcatctctgcccaacagggactcagacttagctcaacccgtcagtacccagactgaccactgcctctgcctcttcttctccaggcttccgcaacttacacgtggacgaccagatggctgtcattcagtactcctggatggggctcatggtgtttgccatgggctggcgatccttcaccaatgtcaactccaggatgctctacttcgcccctgatctggttttcaatgagtaagtgctcctggggcccagacctcactaaaatacagcagcttggccagacctggttggtggtgatggtgatggggtgacagtgaagcttagctcatttgatctgcagttgtcgcagcggatgccccagccagccaatccagtatgaggcggctttgccctggctttcagccaactggcaggagcccaggaggatggtgctgagaccacccctttcacacccaagaaccaatcctagtcatatttctggtctgctttgcagcttatctcaaaaccacatggaaagattcctccccttcacatataaaagaggcagaaagactctggctttaagggctggagtttcttgggttcttttgctaccaccaaaggctacttctagtcaccatttgctgagcaactagtttgtgccaagactatgctagatactttctaaatcctagctcattgagtcctcatggtgacctgacctcacctttttatagataacactatttttttatggatggggaaaatcaggctcagcaaaataaagtgactcacccaaagtcacagagctagtgcctgttggagacaagattcaaacgtatgtccctgtcgatctcagctcttctgcgtcatggtggtaactgatgggaaggagtacctctaccgctctctggctgtgtgaccttggtactgccattttccttcccttaaacagctttaattaatacctgccctgccaccagctccatataacatcatgaatttggccagtggctcagattttggaattacatttttctccactaaaatctcagttctactattttcttagtcagcatctttgggaaagacctttaacttttccgaccctcaatttcttcatccattaatgataacagaaccttcataagtaatttcttatgataactaaatgggaattgacagatgtggaatgtctggcccatagtaggcaagaaggaaaaaaaaagtccctttctgattcaccctttccctaatagtgatacattttttttccccgagatggggttttgctctgccacccaggctggagggcagtggcgcaatgatctcagcccagtgcaacctccacctccctggttcaagcaattctcctgcctcagcttcccgagtagctgggattatagatgcccgccaccgtgtccatctaatttttgtatttttggtagagacgggatttcaccatgttagccaggctggtctcaaactcctgacctcatgatctgcccgcctcagccgggcatgataatcttttctatgtctgctgtatgaggtccctcgatggcattgtgaatggagctggccagagaaatcttcccaaggaccttgagctagtctcaccacagagaatccttccagtcaggacaggaattgaccttcccccctcttcagccctctaacccagaagagtcttaaaataaaatctacaggccaatggttccttccagtacagcactgcaatgcgagggagagtgagcgtccccagctgccctctcccaaccctgccagcctggtagccaaaagctaagaataaccactaggcttttggcacaaactgctttgtggttttcagatctccgcaaagttgcctatgatgccatcttctggggcaggccttgaaaagccccctaactgttcatctcccatccttaaacccctgctgcccttaagcagttgaatcaactccatgagcacctgctctaccttccccagagccctgagacctttggagctttgaaaagtgataattggttgttctctaaatcctcatttccttctctgcctctaagtaagcatgtggcatcccacctcggcttcctggtccagtcttgttcatcttataaaaaggcctccctacggggtcagaggcctagacccatcaaacccagggctcctgaaacaataggacccctattcctcctgtaggaagccactgtgttagagctctcagggtgtctacaaacatctagataagtgtttctcaacatggattctgttgacatattgggaaaaataattttgtcattatgtagaatatggttaacatacctggcaccagcctactctataccaaataggattccagtcattctgacagcccaaactgctcccacacatttctgacacccactgaagaggcagtactctccagttgagtgcaactaatccctgccagccttcctaaggtgctaatggggagcctcagacccaaagagagagagaagaacttgtccaatgtaggtcaacccatttgctgatctcttcaacaccaagctctattatcagccctgtttttttctttctttctctctttgtagagatcacatgttgtgaggataatgagcttgaaccttagctgtgtgaccttgggcaaattactgaacttctatgtgccgcaaattttatctggagactgctgaagagtattataatagcacctttctatatgtcatttattgaacacctgctatgtgtcaggcactgtgctcagtgttttccaatcttcatttctcctcttattttctctcttgcactcccaccaaccttgttctcttcctaaattccattcctgcctcatttttctaccctccattctcctctctcttccttcctttaactgtctccctagtatttttccccttttccccctttcttttccccttcccccatgaatttcttctctttcctttccccttctctttcctccattccccactttttctgcccctgaggcctgcagcaatgttaaaggaatcctcattccagcattgtgatttcaatggtaaaaagattgcagcattgtcatcaacagaggtgggaaagtacattggagactggagcagagccagacctcagggtcagccaatcttactaaaaaattctctacagtgaaagagcttggagcaacactgttctgctcaattgatttgtgataccatctaaacacttcctctttctagttgggcttcagcctgagttgaataattctacaccatctgccctcttctctctttctccaggacagccaagatctctctgagataggatgctgagcttccacccagacaataccaggcctgctcatcctatggagtaggctagtggcttggaaaccaaaatgtcaaaccatagcctttaggctccatctgggaggtctttgtcctcaccacttaagtgggtgtcaaatttccttccctttctgcacacgctgcacaatcaatttctgtcttacacacacacacacacacacacacacacacgatttttgaagtgctgaaaactggaaggcctactagcatgaggatgctgtgtcttctcttagaggtatgccatggtcagccatggaaccgagaggttgctcttccttgaaaagctggccaagcattggccacttccccatataatttataggtgataatgtggtgatctgttcagaagtgactataataaatgcaactcacatatgtctacagtttccaaactgtggtaaggagcagccagcatatgagggaatgggctccccttcagcaggggacatttaaactagacattcaaaaacactccctggcagatttaacattggaactcgttttgaaagaacaatgtggaatctccttcactgggagtttttgaataagtatgaaatttctagtattccaggccagaggcaaaggggtcaacaggatgaccaaacacttcgggtcatttgcaaatcttgatgtcctgatgttaagagctgactactggggcttctcctaaaaatccttcatgttgagctgcctggaaggcaggttctcattctggctgtagctgagatgttagaactgtagtcagggagaccatgtgcctcccccattgtgttcatttggttaggctttcctgtccctgactcagaaaacagaaggggcacagagacctggaaattccatgtgctaacccatatcctggccagagaagatgagtagttatcagggtgtcaggattttggaaaacagagagagaaaaaaaacaaacaaacagacaaacaaacaaaaaaaccttttcctggtccctggagcaccagcaggagaaacagcaagctcttcttggaaaacctggcgagggatggcaatcagagacattccctctgggcttattgtaaacttcccctcattcctttttcctctgtgtatctccttcccaggtaccgcatgcacaagtcccggatgtacagccagtgtgtccgaatgaggcacctctctcaagagtttggatggctccaaatcaccccccaggaattcctgtgcatgaaagcactgctactcttcagcattagtaagtgcctagaagtgcagggaatgccccctgagggcacagagattcagagaggaccacttttgccattaaaacattattagggaaaagccagctcctggacatttcccttcttcattccccctccccatccccactctactctctctcagcatcattttcctaacaagaaacaatttcatgactagaagccaatttatttgctagaagtcaacctccatcagattccccacctatccccagtctgtctttgggacaaggcctttttgactggttacagcaggtctctgaatttttccatagcttctgctatagaaacagacatgggccaccttgtattctttgcagggcagtagagcaggaggcatttcctcctggaaagatttcctcttctgccaacaggaggagatctatgtaagcaactcagataggatttgtatggcagccaaggaacttttctttaatatcttttctaagagccctctcttagcccctacggagggagaagggcaaaatttgatattcaaagctatgtgttttggttatctaaatcagggttttactgtgaatgacataaaagcttaggtcctaaaaaatgagtatctgagaagagtagaaaaagaaaaggttcaggaaatttgatttacttgactcctttcagatcggatccagctatcctttcccctgagatctccctgacagactgaaggccccaagcacacagacttcaactaacaggaagccaagtagatggttccctgtgggggtgggggtcaagtctgtggtcagaaaacttggtgctttgtctaatgctccttcgtgggcatgcttcccctccccattctgtcttcatcccacatcagttccagtggatgggctgaaaaatcaaaaattctttgatgaacttcgaatgaactacatcaaggaactcgatcgtatcattgcatgcaaaagaaaaaatcccacatcctgctcaagacgcttctaccagctcaccaagctcctggactccgtgcagcctgtaagcaaacgatggagggtgctttatcagggagaacagcctgatagagccaatgataatatgcttctctagagtctggcaccacctgttgggaggtgcttccattcccctctggctttgagtgtggtccaggaagaaaatgtggtgaagaaaagaacacgggtcacagtgtcccagctggatattgtgaaaggggtggaggagttgagaacagagcagttgggactcagggaagggacttgcagcagatgaattctctaggcagacaaaacagacctggatgtttttcccctcttctttgagtcatgttcatgtgagtttgtctgtctgtgtgtgtgtgtgtgtgtgtgtgtgtgtgtgtgtgtgtgtcagagagagagagagagagagagagatggagtgcggaggcttgggtgagagcacaagctggagaagtcttgagtcagagagcttacaatggtataagacatctcttgggagccctcagtgactccatggagaccatttctttctctctctctcgctgtctctctctaacacacacacacacacacacgacctcatgggggaggaccaaggaagtacggggaagggggaggaaacaaaaggctgaaagaccaaaaatcagaggttggggaagaggctagcagaggccacctccttgtcaaccctgtttttctccctcttattgttccctacagattgcgagagagctgcatcagttcacttttgacctgctaatcaagtcacacatggtgagcgtggactttccggaaatgatggcagagatcatctctgtgcaagtgcccaagatcctttctgggaaagtcaagcccatctatttccacacccagtgaagcattggaaaccctatttccccaccccagctcatgccccctttcagatgtcttctgcctgttataactctgcactactcctctgcagtgccttg

SEQ ID NO: 4659 - DNA, 144943 bp, human
acactgaatttggaaggtggaggattttgtttttttcttttaagatctgggcatcttttgaatctacccttcaagtattaagagacagactgtgagcctagcagggcagatcttgtccaccgtgtgtcttcttctgcacgagactttgaggctgtcagagcgctttttgcgtggttgctcccgcaagtttccttctctggagcttcccgcaggtgggcagctagctgcagcgactaccgcatcatcacagcctgttgaactcttctgagcaagagaaggggaggcggggtaagggaagtaggtggaagattcagccaagctcaaggatggaagtgcagttagggctgggaagggtctaccctcggccgccgtccaagacctaccgaggagctttccagaatctgttccagagcgtgcgcgaagtgatccagaacccgggccccaggcacccagaggccgcgagcgcagcacctcccggcgccagtttgctgctgctgcagcagcagcagcagcagcagcagcagcagcagcagcagcagcagcagcagcagcagcagcagcagcaagagactagccccaggcagcagcagcagcagcagggtgaggatggttctccccaagcccatcgtagaggccccacaggctacctggtcctggatgaggaacagcaaccttcacagccgcagtcggccctggagtgccaccccgagagaggttgcgtcccagagcctggagccgccgtggccgccagcaaggggctgccgcagcagctgccagcacctccggacgaggatgactcagctgccccatccacgttgtccctgctgggccccactttccccggcttaagcagctgctccgctgaccttaaagacatcctgagcgaggccagcaccatgcaactccttcagcaacagcagcaggaagcagtatccgaaggcagcagcagcgggagagcgagggaggcctcgggggctcccacttcctccaaggacaattacttagggggcacttcgaccatttctgacaacgccaaggagttgtgtaaggcagtgtcggtgtccatgggcctgggtgtggaggcgttggagcatctgagtccaggggaacagcttcggggggattgcatgtacgccccacttttgggagttccacccgctgtgcgtcccactccttgtgccccattggccgaatgcaaaggttctctgctagacgacagcgcaggcaagagcactgaagatactgctgagtattcccctttcaagggaggttacaccaaagggctagaaggcgagagcctaggctgctctggcagcgctgcagcagggagctccgggacacttgaactgccgtctaccctgtctctctacaagtccggagcactggacgaggcagctgcgtaccagagtcgcgactactacaactttccactggctctggccggaccgccgccccctccgccgcctccccatccccacgctcgcatcaagctggagaacccgctggactacggcagcgcctgggcggctgcggcggcgcagtgccgctatggggacctggcgagcctgcatggcgcgggtgcagcgggacccggttctgggtcaccctcagccgccgcttcctcatcctggcacactctcttcacagccgaagaaggccagttgtatggaccgtgtggtggtggtgggggtggtggcggcggcggcggcggcggcggcggcggcggcggcggcggcggcggcggcgaggcgggagctgtagccccctacggctacactcggccccctcaggggctggcgggccaggaaagcgacttcaccgcacctgatgtgtggtaccctggcggcatggtgagcagagtgccctatcccagtcccacttgtgtcaaaagcgaaatgggcccctggatggatagctactccggaccttacggggacatgcggtaagtttttccttccagaaatgtcgcctttcggcccagggcagagtcactctgtgttctggggtatctagcggctcctacctgcgcgaacactcagattgcccctgggagagctcagcagggtaaacctagagctctcccgtggactcccggcctgccagaggtttaacctgagctctcctaatttctgctgcgtgccctgggtgctgattcctgccctcccagattcttcaactcccccaaccgccccaaattctcactacctcctggtactcgaggtcccaaacagaaatcctattgcacgggccaccttcagagataaagctcccaagccctccactcttcctttcctcctgtcctcaaagtctgagaacctcaacaggaatttgggcaatttctcctcttcaggtctgttaggatttcactttcagcctgcgcagattagagtcaaaaagaccggcccaatagcttctcagcgggtatcctccagagaggtaaagtgaaattctcggttagggaaagaaagtggtctctgggtgctgaggtctgctgtgtgaaagggtgaacttctttctcctgaagcaactggggacttgctccagggctggaggtcagtagagataatccaaaccgtcatgtttagagtaggcagaggggcaactttcttggtaaagacttcacaggatttgcactcacagtttctcaacgttggttgactatgttgaaagtagttgcttgggtcggttttctcttgtaaagtgtttattttctctgtggattataacagatccacagccccctacttcaggtttgcatcagatctataaagaggagaatattcttttaatgtacaatttaattaggcttgactctgacttacaaaactgttggaaaacatttttttgtaaagcatttcctgctatttcagtgtgctccaaaatctccactggggagggtggagtgaggttttttattatattcctttatttttaggacatgtttgcattttagaatatgtgcagttagctctaacaaattgagtaagaactcttaatgacctatgagccgtaatcttaccccaaagttttaattagcatatgagaaaagtggcaggcaattgcatcgtgcttattaaaaattattcctcaccgcagttgttgagcttcttggagaccatgctgaagattttctcccccagcaaattaagatattagtttatctgctgagggaggacagactgaattggggaattaactcctcaggtaggccaggtgctgatgtccctgtggacttttgtcttattctttgtttctatggctgttttcttttacctgtgacttctccgaaatttctttgttagccttaacatctttgtttggggacttaaatccagcaatttgccttctttcactgatgctttccttcttacaaggtagatagcacagtgttagtaaagaaagaaagaggagggtaggatttcatattatttcgtgggctgttgaagaaacagcttcttaccaggctttacattccattaggtttttaatgtttgacttacaagattttcagagggttcatttgatattgtcaaagtcttttccagttaatttagactcttcatttttgtaatgggtttatgctatgggacaaaaaaagtattcttcattttataagaacaaatttacttggtagggttaattttttttctagggctgtcactagacggtggagcccctcttctactgtaaacttttcttgggggaaaatgtctaaggtgcattttgacctgccatgatactaaacccagacactggaaccttccatcttctgcatgcctcccccacaacttacttacttaacagggaaaaaactgatggttccacatatttgctaaaaaatgtgtgccttcaaagacaaaaccaaaatttttagggaataactatagagagcaaaagttactcccatcaagtagacaacgagcttggtgattttatttcaggtcttaatgaaaaaagcttctttatgaggaaggttatcatatcttggtgcctccttgacagtccgcttaaattaatgacataaactaatgagaatttagcagttcctgcagaaagtacaagtttattttttttttctggtttgtgattgctgcactgaatatgaggagtctagttaaagggacaactggtgttcctgtcttgtgagttgacgaagactttccatttctaggatatagaaaatccttaagccggtttattgaaaattaatcaatttaatcagaatgcaatcaattccaatacaaaagttagtattttctttctttttattgaaaattaatttaatcagaatacaatcaattccaatccaaaagttgatattttcttactttctctttttttccctcattttgtagggatacaatttggtgaaaggcaagagatttcttaagccaaagcaagagtgtcttccctctctgtgttgcatgcattatgtgccatgtttgagctaaaaatctcaaaattgggcaggcttccaatgacctgttgggtccctccctttaccattcatgtgtgtgtttatgtacataattttgtggaggggtttttttaaaccttagtaacatctgcactcactctgtgttcttatacatttacagtgtttctgctgagaggagggaagatgcaaaggtggtctcttttacttaatttagcatgtggtttgaacagaaggaaaaataaaaagtgatggggcttgtgtgcaaccctgatgatattttatggagctgtctgtcttctctctgagatcaaacaggactacaactttgttaattgaccactggctcccttggcaaaagtagggcttcttatattccagcaagcagcacaataatatgacaaaaatttattcttgggagttgggttctaagagagtgcatgccagaattagagtttggggtttagagaaattatccagatgccaaaagaacattttaatttttctcttggtaatttgttctggtctccatagtaggtagtattttagtagtgctttgatattgacaagtcttgctccctttctctattagatttttcaaaataaggcattttattaattcctctttccttctcctctctcctctcagttatcaagcatttttatgactatcttacaagcaacagtttgtcttgtaaagcagaattttcctttgaaaccaagacagattatttctgcccataggcttcaggaaccaatattttggcaagaagcatcttttctttgtggtcagcaaataggtggtgagttctgtctggatcccaacaatcaacacctgaggaccaaatagccacactgggtggcaccccattcggaagtatacacaggaagtagccctcttgcttgttcacagctcaagtcagccaaagattaacactggtgagagatattttcaaagaagtttgcaggcttccaattgcagggtcattttggggtgctttcttgcctgtactaattttatctcatcaagcttccattctttgagctgtaaactttgaaataatatactggatttgctggtacgtttaattttctttgttaagtgttttcattcccatagtaatttttcatctagtgtacatatatgcatttaaaacaaaaattctttggtctccttatgcgtatatgcactgcggcttgtacacgtacaagctacttggtgggattatgtgaactggagttagaaatgtggacaattttattatgattatttttaatggtgatatcaagatcaccagtttcattcggaaccttgcataagcagggagcagaatgcggactgggtgtggcaaagcaagggcttattttatagccaaacctgaaatcacaactctgaaaaataaaaaaaaaaaaaaccaaacaaaaaaatcaagttttgtgagcttggtcagagaaggaaaaggaaatctctccctaccccccacctccaccattttctctttgtctgcagcttcctcaagtgctgcctgtccccgattttcttttattccactcctttcatgtttttgacattgaaatacagactcttctttccacttctcagggtatttttcttattacacctgtggcatgctcctaaagaatttcttttttaaaaaaaatctgtagagtagtagattagattaaccccagtatctctcccttaagactagatgacatgaggggattgcaaaatgaatagctgggtttttttttttttttttttttttaccttgaggttaaagcctggttcaacagttgctgagagagttaactagattgcttgaggacttggcaatttcataaagtattttgtcttatgctgtctctgtctctgtcttgatctctgtctctctctgtctactgtaatgttggctactttctctcagagcctgagagacagctctgagacacttcccaggtctgttcggttcagacctcagtagctggatcacaagcagtacccaatatgcatatgagggtgcgtgctgcaagtgtccggctgggctaatctgcttaagcttcataaaaattaatcatttgaaaacaaagaaagatattaaagaaattattctatctccgacttcccctatcagcattccatcaagttctgggatgttaaattcagagaaagttaaccttatcttaaacacaaagttgacttttaaacaaaattgcttataaagttctgtacagttaccagcattggttgccctttgtcgtacggaagagaattatgaaatctcatatttacatagcattcttccaaaaaaagagacggtgttttccagtttattcactgcattcgtgtaagtgtgagtaggccaggaggggtgcttagtgattacccttttgctaggtaacaaagtagaaagttagattttctatgatatttgtttaccacgtaggggaacctctctagagcaatactcccaagctttttcttcttgaaatttcccacctgacagataatactttagattgttgctcttaaggacttctctcagtagctgctacatagagatgattgtccgtgaattattgcttgcacactcatgggtgatgctactccctctctctcatggcaattcttgctgccaacctgcaggccacaccaggattgagggcagctcatctcgataaatttatagcattaaagtgctgggtcatttgagaatgttgtcaatttaggttacttagtacctaagttttattctttaaataacagctttattgagacgtaatttacaatccatacaattcactcatctaaagtgtacagtttcatgctttttagaatattcagagttgtgcaaccattattgcaatcaattttagaacattttaatcacccccaaaggaaaccctatgcacctttgtgttcatccccctatattccctcagtccttagcaaccaataatctacttctatctatggatgtgcttattctaacattttgtatgaatgaaatcatgtaatatgtggtcttttgtgactagcttctttcacataaaatatgttttcaaggtcatccatgttgaagcacatatcagtacttcactattttttatagcctaataatgttccactatatggatataccacattctatctatccatttatcaggtgatgagcattacggttgtttccaccttttggctattatgaataatactgctgtgaacattcacgtgcaagtttattgtggacatattcagtccacatattttggacattttcagttcttttggatacatacataggattgaaatctctgagtcatatgatacctctgtgtttatccttttgaagaactgtcaaactgttttctaaagtgtctgcactgttttacaatcccatcagcaacctatgggggtccatttcttccacatccttgccaacacttgttattctctgtctttttcattatagctatattagtgggtgtgaagtggtacctcattgtggcttttatttccatttccctaataacaaataatgttcagtatccatgttcttattggccatttgtatatcttcttttttgagaaatatctatttggatcctttgctcagtttttagttgggttttttattattgagttttaagatttttaaaaaatatattctggatacatgtcctttaatagattgtgatttgtagatattttttcacattctgtgagttgtcttttttactttccttttttttctttttacgttcttaatggtatctagattgaagcacaaaaatgtttttaagtttgatgaagtccaattcatctatttattttctgttttggcttatgattttggcgtcgtatctaagaagtctttgcctaatccaagatcacaaagatttacatatgtttccttctaagagttttatagttttcgctatttacatttaggtctttcatcagttttgatgtaatgtttatatatgactgaggtaggggtccaacttcattcttttgcatgtagatattcagttctcacaatattgttgttgaatctttcctcacttaactgtcttggcaccctttgtgtaaaatcagttgaccgtaaatgtgagggtttaattgtggactctcaactatattcagttgatctatatgtttattcctatgccggtaccacgttatcttgattattgtaggtttttagtgagttttgaaattaggaattttgaactcttcaactttggtcttctttttcaagattgctttggctcttgtgggtcccttgaattttcaaatgaattgggataagcttgtcaatttctacgaagaagtcagctaggattctcacaggaactatattaaatctgtaaaccaatttggggagcattgtcatctcaacaacgttaagttattttcatccataaatatgcgatgtcttcccatttatttaggtcttccttttgtcaacaatttttattgttttcagattataagttttgcagttctttttaaaatttattcctaagtgatttattttttgatactataaattgaactgtcttattgattttattttcagattattcgctgccaatgtatggaaatataattgttttgtatattgatcttgtatcctgcaaccttgctgaaaatacctgagttttgaatgcttctgggacttatggggaagagggcttctgctgctgcactgaaagttaaagcttacttcatttcatcctgtatgaaggctgcatggggacattcttctcagttttactcagctataaattcgaactggtaatcccatcccctttcgggatgaataggagagtgtttttaaatgttcatctctttagagaacagcaggaaagaagcctagtaaggtttgggtagtttataatcccttttttagaatttggatttgggaactattagcaaggcagtgagtaataataataatttctatatagaaaactaacatgtagaggtgacaaatgaaatcactagctatattaggcttatgtttaggttatcgtaagcagctaaaatcataattttatgtttttatatgttgtcctttggacaaagtaaattccagtactccttctgatgtgcatttctagatggggaaaggattcatttactctcatataatttaagcttctttttagggatgtactccatagccatgaagcaaagataaaattcatctatacacagactgaactttgtcttcattaacactctaggctaagggtcatagctaatcagctacaactgtaatgtcctgataattgtgaattaactgcagggcacccagcaaaaggtttagttataatctaatagctgtctgtagagattagcctaataaagggattttttaaaaaagaatctggccgggcatggtggctcaatcctgtaatcccagcactttgggaggccgaggtgggtggatcacctgagatcgggagtccaagaccagcctggccaacatggtgaaaccccatgtctactaaaaatacaaaaattatccaggcgttttggtgagcacccacaatcccagctacttgtgaggctgaggcaggaggatcacttaagcctaagaggcagaggttgcagtgagccgagatcatgccactgcactccaggctccgtcaaaaaaaaaaaaaaaaaagaatctatcaatcaaccacttttcattaagcacctgctatgtgcccagcatgtgctaggaagagataaggtgaaaggggacacaattcagacagaatcttcttgaggtaactgcttacgaggagcttatagccactaaaaacaaaaacaaacaaaaaccaaacaaccaaaaaccaaacagaaatgcagtatcatcatgccatgatgcctgtatgagatcctggattgtacggtatggatttcttaaaatgtagatattttaaaaaaaaagaggaatgaatcaatagaggctgaagtggtcagcaatgttacctgtggctgcttttaatccttcgtggaagtaagtaggagcatgtctaaactcaagcaatagattaaagatcttgatgtatattttaaataacagaagttagtaccactggaaagaatgaactggaggaatgggttgaaatctatttctgcttattcaatagtgcaccccagtcaagttagttgccaatttcttcttcagtttctttggctatatcattgcacttggtgggtacatgtttatgatgtctttatctgaacaagtcagcaataatatgagtaataaattaaaattgaaggtgattaatggctctgaatttgacataagagttgttttcctgccttctaagtttccattgatcctgatgaattgcacaaaccaaacaattcggggagtaagggggcacatgatgatcttataagagctttgctgtattagacaacgtaacattctgaaatggcctaccacctaacatgggctctgttctctgcaggttgagtaggttccttgcttgtggaactgtagtcccgctatttggccgctagggggactgcaagtgccccgtggcaggatttccctgggaatggtgagcctccattgatggtttcaacacacagccaaggccctatcgcaggataacttgaaccagaactgcctagcaccagacaataaataagctactatggtacttactgtttcatttgggatgttgtttctcgaagtggcaagcattttttagtaatattttgactttttaatacctttctttgcatatggagcagaaaacagtgacactggatatattcaagtagcactgtccagtttatagagaagtttcatattccattattgcatttcattcttgtttctaccttttacaagtaactagagtttggagtattataatagtattcatactattacagtactattattcccattataaaaattgtgcaaagagtggttaagttacatgtttacaatcaaacagcttcaaagtgactgatctggaatttcagtcccattctttcttctccagatcatgtgttccctgcttttatctcacagctctttttaccttatagatgggaaacatgagagtcagagaggcaaaagaaccacaagtggtatcaatactagaaatttatgaatttcttaaggcttctaggtttgttacccatccaccagactgatggatttggttgtgtgagagttctgggtgccaataaccttgccattctactttacagactgcatatattcaataaatgcttattaagcatctactatatgccaaattctgtactaggcaccaatgatgtagtggtgaacagaacagacaaaaatctcttcgtggagcagacagtttaatgagaggagacatgtagtgtacatctgagcatgaaaagtgccatgcagaataacttcacagagtgtagggtatagagattgatggtgagagggaatattttatatttgctggccagggaaaaccttactggaaaagtaaattttgagtagtgacctgaaggaaattaggaaatgagctgctatttggacatctggagttagaatattccaggcccagggaaccacaggcgcaaagggcctgaggcaggagcacacttgctgtgatggaggacaaagaggcccatatggctggtttaaataagtgaaggatggtagacaatgagatcagagttaatgaggttgcatggtaggtcttccttaggactttgaattttactcctaagcaggttgtattggacggttttgagcagggtaacatgacctgacttacattttaacaggctccctcctcttcataacatctgtcactctgatatattatacgtttgtttgtttacttactgtatgtggggggaagagactgtgggagcaaggggggaagcagggaaacaagtacactgcagtgatctgggtgagaggtgaccgtgtctcagactaaggtggtattggtggagaaggtaggaagtggctgaattctggatgagttttgatggtatagccaacagcatttactgacagattggatattcactgtgaaaaaaatagagatgaggatgattgccaagtttttggtctgagtaactggaaaaatgagattgccatttactgaaatggtgaagactgtatgtagagcaggtgcatgggcagggtagaaatcaagagtttgatttttgacttataaagtttgaattatctgatgaacatcctgatggcttcttctcagttagttctcatgcagtgccttcagctttgctgttcttcaagaaaattaaaaaggaacttagagatcgcctaggctgtaggtaccctctcccctctttccttttactttatagaggtctatagaagggtagggacttatccaaggtgaaacagtgagctggcgacagaactagggcacaaacccagttctcttgaattctgaatcagtagattttctttttttagtgtgattctgaggactcatttgggcaagagtgagttttttgttattgttttttgtttgtttctttgcccaaacctaaaaccaggtaattaaactaaatagtgaataaaactgggaaactatacaaattggttgctctccccaatcacactgaaatattattatttttactgaaccacataccaaaatatttttcctgtaaaaacacagtaagtgaacttttaaaggcaattgagcttttaacaaagctagaatctacagaggacctggacagaaatggccttaaatcctaggaaattagagttcatggaacctgggagaccatcttgtccagctagctcattttatgggtgaggtgcctgaggcaccaagatggaaagggacctggctaagctcatacagcaagctagtgcctgagcctagtcagagcctgttttaagggttagtcgtatgttgttttcttgaaaaaagttacattggaaaagtgaaaattctttggtccatactgagaacaaagaattatacataatcatatataataataatgatagcacttcctgaatgtttgctgtgtaaactttggcaccttgcatgaattgattcatttaattctcatgtcaactttaggaagcaggcctagagaggttaaggaacatgtccaagggtcacacagctaggaagtagcagaacttgtgtgcactcccaggaagtctggcttctaaccacaaggttctaactactgtgcaataccaggagcttctcagattacccttcacctttaccaacccaaatgactggtgacgtaggtgacttcattatgctctgcccctattatagtccactgatcctcaccaaataggtgggtggcctagaggttaaagtagaggcagagtgatggaaaggggtggttagaagaagttgatgactcatgatagggattggaaaacaggactacaggaattattgaaaagggcctagagatcccaaggaggttgatctccgactgctacaaacctgggcaattcaatgcctgcttaaataggagagttaagataagaaaaataaaattgccaatttttacagtcagacattgttttatttattttacatgtattaattcatttaatcctcaaaatactccatgaggtagctacaattatcatttctatgttgtagatgaagaaacaggcacagagcaattaaataacatgcacaagattagagaacaagtaagtggaagtgccaatattagaatctaggtagttcagctccacaacttatgttattttccactatatttatggaatgaggtaattttcttataacagaaagtttttaaaatgcaaaaacattgtgcctgaacttcaaacactgaacaactcatatccttaatatgcaccagtttcttttaagcactcttagaaggaaggatacttaacctaatgtcacatggtgagtaagtagcagaaccggaacttgaatttgagactccggactgccagacctctttccactctatcacttgggctcccttctaacattgacttgtctccctccattcctcctccgtattgttctgcccttcaccttttaattacctgtctccatcaacaagattggacagagaattgggagagtgagcagagtccatttccttccagagactggacaaaaggaacaaaatgttaggaaaaaatgtcagcatgtgggatttgtgggatttacactaaataagaagggacacttcccaggactgacaagatgctacctccgtccctctaggccccaatgtgttgtgcaggatcccataggaagtcatgaatgtggttgtcagataacctttttgttactgtggaaatggaagcaggctactgcaaaaatctgtctctccaggttttcttttaaagaaggtagtcttgctaaatgataactatttcagcatttatttgaaaatgggcagtgcaggagagaaagaatttttccaagcttgtcacattgggccacctctctgaagcattgtccaacttctaattagatgaggagactgcataaaccaagagttgagagtaaagatggaaacacttgatgtttggtgtttgggtgcagaaaggattccagaacatgttttgggtctctttactctgtccatccctccttccctttcatctttgtttaaaaaccacagttagcaaatgtgtagtctgtttgcaattgttcatctgaaaaatttgtttgatcagccttttgaataaaaaagaccaaattagactgagatatttcagtcaccaactatctaataatagaccaaaaattttaaccatgctcatactttcatatggtatgtagtttgctttagacattttctgggcttcagtgaggtgctagattgactcaaaatatggcaggtcagatgtgggattgagcagggtggactcttctctacccttcccaattcagagttccccatcaaagatgatctcatagtgtttgaaaaaccaagctgaaggctttgggaattagggtgctgaagggatatgctgtttcccaaagccttctcagtcattccttctccccccagttcagattcttaacacctctttccaggattagtgcagtgatcccacgtcctttctctctagctctctctgctactctctaattcctattgtatttgtgccaccagatctttccaaagtttagctccaatcttgtctgtatactgctttaaatgtctattagtctttaagctccttaagggtgggagtcctgtcttattttttccctattcttcgtgcttaatgcaaaggaagccttgctgtatagttgtgtaatgcatgattacaatttcagcttctccccattggcttatgggttaaagtccaaattatttaaatctggtgttcaagtccttttatgatctgcttatttttccagcctgaattcctggagttcccttacaaaactcttaaaacccagccaaaaggatctagtcactgtcactttaaaccatcctcactctcttgttttttgaacatgttatttttcttataatccctttgaccttgaaggctatcccaatttcaatactatccattcttctatgacagccccctacaaaatgaatattctcaacctcccaacccaaggagaagtgatctatatgacacaatatggttgaaagaatgttggcttcacttctttatctgtaaaccaggggctagaaatctctagtttataagattttgtggagaggggatcatatgtgattatggatgttaggcacaagtcaagagtgcataagaccttttggatttatcccttttttctttctccatcaatatggtacttagtcccttaaatcagaagtacttgtgttaatgtctgataacgtccttctaaatatacctctaaacatctgtctctctttagggcaaaggttggatatatctgcaaagattctctttggatataagatatccacagcacataacttaacagtggtgtacacagtaggtattccataagtatttctttatgaaatgattcagagtcaatagtagtaagtaactgccaaaaacaactgatggattgtaagttccattaacataaatacagtcagccctccatatccatggattccatatccacagatttaagcaactgcagatggaaaatatattttagagacacagtaaaaataacaattcgacagtaaaaaaatacaaataaaattatgtaaaacaactatttacataacattgtattagctattacaagtaatctagatataaatgaaatatatgggggatgtatataggttaaatacaaatatgacaccattttatatgttttagttaaggaacatgaatatttttggattttggtattcatgggagtgggggaatggaaccatgccccttcaaataccaagggactattatatgggacacagaataaaggagttgattgtcttgctctgttaaattctggtcagacacatttgcaatgtattgttcagccccagtattcatggagcatctccttttgtaaagcatggaggagctgtgagagagacatggagcagtgaacataactattgtttcaacgtacctgaaggattatcatggaataaagaagttagatgtttttctgtagtaccccaaagggcaaaagcaatgaggacagattacagttcagtaaacgaaagaggtttttttttttttttttttttttttttgagatgggagtcttcactcttgtcgcccaggctggagtgcaatggcgcaatcttggctcactgcaacctcgcctcccgggttcaagtgattctcctgccttagcctctggagtagctgggattacaggtgtataccaccactcctgggtaattttatttattatttatttatttctttatttattttagtagagacggagatttcatcatgttggccaagctggtctcaaactcctgactgcaggtgatccgcctgcctcggcctcccaaattgttgagattacaggcgtgaatcaatgtgcccagcctgaaagatattttcttagaatagcttctttcacccttcatcagaagttgtcaacatggaccatatgagttttgtttggtctatatggtgtatatgtgtgtgtgtgtgtgtgtgtgtgtgtgtgtgtgtgtgtatgtgtgtgtgtttattgaattacttgctaacattttacttcaaaattcagatttccaccatagggaatgaagatctggcaatacaggactttcattcctacatggtaatgaccagctgtaggtgaaaagcagctgatcctctggatgggccatgcactttgcagtttgcccaggcagcactgatccgctttattcatttaagttacctgcttgactcttctagtcattcgagtatgtcatccccatcagatcagagacctaagcaaatcttgggtcccttgcttactccaagggctttcactcctcgtataggaggagctaaagaaatgtacaagcagcaccacaataggatcagacctggctttcaattctagcacggccacataacatagttggatgacctcaggacagtaacataacccctctgagcctctagatcttcattatctgtagagcactcttcttatagagttattataagaatgaaataaaacaactaggataaagggcatggcacttagtaggtgctgaaatattagttcccttcttctaattcaccacaccatatctgtctatctattggctgaatcacataaatagtaaattcacattcactgaagacattcaagaagagtctggaccctttgggaaccatgtatagggcaaaggtttgaactcatagtagatgatttttacagtcactttttaacaatttaaaagcctatagatgactccaaaatgcccatttggatgatatgaggcatactttgtgtagttaaggattttaaatacataacagagaggctgaagggccttcgggaaagaagctggggtaagagtcaaagtgtagtatgttgaccgatgttcaggaataggctttggcatctgacagattttgttttaaatactggctctgggtcttactagcttccagttctgggctgcttcacctctcttgagtttcagtttcttcatttctaaaatgaagatactaatgcttcctttgttgggtttttgtgaatataagtgagataataaatgtaaatatctagcccagggcctggtgcatagtacaagcttcataaattgtacctattattattagtagtagtagtagtccagacaaacagagcttgggaaaacgctagactctggctgacatacatgggcttttccccaggccactgctgcctggcttccccttccacaaagctttgagtctccaaaatgctttggctggaatgtaagcgtgaggtcattgcagataacaggggagcatgatttgcttcggtaatgcaagttattaagttacttccctcagcccagctgaaatctcttattggttgatgtgtgcttcaaagtgtgagacagagctagtctgaggagagagggagagtgagaagattcctcttcttggccagaggtcatggtcttccacaaggaacagaatgactcaatgcaaattatgggacctctttgagtttggggcccctacatttaaactagtaactccgttgcacatattggcacccttcccccaacaaaattactgggcaggaattttcttgaatccttccgtggcctggaatgatctcccttctcatccttgtgatccacacagctggcaaatggcaggcagcagaacaaaaacaagcctcttagcatatagggagagaaagagtcacagcagtactgaatttgcttgggaacctaatgttaacaaaggaccttcctctcaacaccccaaacagattaaaacatttttttaacagcaagttgtgtctcggagcagctctttgcttgggtatatttaaagatctgctgagtcatttaagagcaggctggcatatcctaagaggcaaggactataccccagtctatgggggagtaagttgagaggtgaaatctgtttggctttctcccatggaaacaaacaaggtgatccacttccatctcccacgactctggagagcatctactaagccttcttattctatcaactttgaactcctcagtgtataatagagtaagggtgagagggaaggagcagtcgtaccagtgtcattattggtatgttcaggagttcaatttcttcctgattcagtcttggcgggatgtatttgtttgggaatttatccattttttctagatttttctagtttgtgtgcatagaggtgttcataataccttctgatagttatttttatttctgtggtgtcagtggtaataacccctgctgtctgaaattgtaatggccctgctattggtagctgagagtagcatggaagtgtcaggttgatgggttcatttaattcttttcttttcagtttcagtcacatgcattgttaccatggcatatgacagttgctagaaagtgaaataattttttttctactttattctccactgcacttctaaatttattagtggagaaattagcagttaccaactgttcattataggtacacattggggtttccttagagccaattttccccctggttttcatcttgtaaatctgtaatcctaaaaattagcaaaacctagagcttctctttggtcctggcctgtttgaaccctgttccacagaccccaatcttctttcttgtttgaggcaactatccttctctttgcccaccgccattttccttcatctacttttcccttctctagcacctcagactgtcttcccacagtggcacagcctcccactccactttcactgtgccatctccttgccatcaaaaccatcctcacagacccttctgaaaccacttctaggaagggaaatcacaatggatccatgaaggatgctttctggatgactttaaaagattggtattaagatattttatcagtggtagcaacactgacttattcaggcagccatgccccggatctataagaaatcaggtaagctaaaagttgcttgagctggcaggagacctagttctcttttttcctttccctcttgcattttgtttatcgatggttttcaaaggacttagaggctggctttgttatagttagttggtaagagaaatggtggaggaccggaaaatgggagtggaacgaatgagcatgtttgagactaagttattacaattcctaggatgtataaattgcttgaaatctaccaagtactttcagacacattatcttttttactcttcaaaatcaacttggaggtaggcacaacagggatcaaatccttagttcacagatgagtaaactgagactggaggaaattaaaggagattccaaggtaactcagacaataagcaacagaaccaggatttggtgaattttttggggggtgggaggtacagagtctcactcaggctggagtgcagtggcaaggtctcgtctcactgcaacctctgcctcctgagttcaagtgattctcgtgcctcaacctcctgagtagctgggattacagacatgtgctacaatgcctggctaatttttgtatttttagtagagatgaggttttgtcatgttgcccaggccggtcctgaattcttggtctcaagtgatccacctccattggccttccaaagtgcagggattataagcatgagccactgctcccagccccagaccattaatttttgacagtaagtccaacttttttcaagttcacagctcagatttgctattgaatgaatgagtatatatgtcatttgggaacattctttccaacttttggttgaagatttgttttatcacttgtgaaaattttttttcattcttagcaatgtcagtttagttaaatgagcatttcatttgcgaattcactaattaattattttattcatcaatacatttcctgagtaccaactttctatcaaaccctgtgctggattctgaggctacaaagagaaataagataccatctcaggcctctaaaatctcacagactggggactgacatctcagtagtaaacatatgaacagcaacttgtgaaacgccattagcaaaatctcaagttatattcttcagtgactatggccatcctaaaaatggggtgtcttttatttggggtaaatgaagatgaagccttatgagaaattgcattttaatctaatcttgtcttgctaagaacagaagtggaatgtttcagcctctgtgtgtgtatttgtgtgtgtgaaggttgagtgtgtgatgatggatggggctgcgagattgttaagtaggatctatggggggccttaaatggtcctggtgagtcccaactttctggttatgtatttgagtagagtatgggggtgacaaagattgttgtttaagagttgattttagattttttccaagtaaatggtcagctgacttggagcatcatcattccacttgctttgaaaacctgccacttaaggctccttccagtcataggttaactctttctggtcaagtattactctttttgagcatttacctgtcagtgacaggtacaatgttagatgttgtctctctgttttcttgtttaatctttactttgatcctaggtagctcttattagttccactttataggtaagaaactgaatttcagagacttgaatgacttgttcaagatcacatagtatagtaacttggtagtttgggacttgaattttgattgttcagttttttgtttgtttgtttcctggcctccctgctgttttcactattccacaccacttcagctttatttttcatagaggccattaaatgtaccctccatcagccaaagcctcttgcctcccttcaacgtaactcttctctagcgtcctcttaataatcttctgaaaaggttttacagcctttctgggtactgggacccagagtcttaatccaggctcttaagtgccttatttaactgtaatatggaaaatcaaagtcacagctaattcaggaaaaatgagtttgggatgtgaatttcctaggcaacttgtcatctcttttttacttccttagcttcataaacttacccacaatgttccctgaggactaagagtaatggagggtgatgaggaaaggctttcctcccttcctttccgagagtcctttagccaaatgccacacctcctcctgtttccctagtctccgtgcagagatggaagtgggagatagacatgggttcctttcagccctgagttcatgccagggttttctttccctctagctggactgaggtaggaggagaggttgaagtccaccaataagaccatgagtgaagaagactaaagtacttgaaagagcagcagacctacgcttaaaatactagggtttgtgtccagactttgtgggttactatctgtataattttgggcaagtcaacagttctgagtcagagttcccttatcagcagattggaagataaattctaattatatagatgaaacattaagtctagaagtaatttgtaaattcagaaagggcttatagatttaaagtgtagccgttttgattaccacaaactaaatcctatacttcagggataaaatcttctcctgttttttctaaaagcctgtgcatgtgtggtgtaaggggtgggttttcccttgtaccagcaacttagcaattgtagtaacggggctgagggcagtggcatgcttcttcattgagcaagtgtgaaaagagggttatgcattcaggggtcagcagatggcaggcagagtagcccctccaaatctccctcccataccacaaagccctcttatttattcaaacttaacattagaagctcatttcaagtaggcacgtctgtgtctgggcgtctattttccttctttgtatatagcaggcatttgtcaacttggtgaaaagcattactcttctttccatttctgaggactaattgtgcttcttcgctagacacgagttcaaaacagtgggttgaaagagggcaagtttatgccaaagaatcagaaatagtcataatttagagagaattctagaggtcagttccctttcgtatggactgggcaactgaaacccagacagggaagggaattagaccaagttcacaagcacaaacactttactggcacattcagattggaaatcgagggcttctgctcccaggtcagaactaaatgccctttctagctagggtgttctttgatctcagtgattttgactctttctactgcactctggggacagtgggttctgcggtaccaactccaattaaagtgggaatatgtaccagcccctccccttggtttttatttttcagaggcctggcagtcagagggattctgatctctatatgcaatattttcacactactgtacttattgaaatcacatttgaatcttggcaattaacaaggcagtaattggcatcaggagggtatgttagtttgcttatctgcgccgtccctcctcttcccaacccactgtgtattgcagaatgttttatcagctctgatttgccaagttgctctcttctccagtaggtgctgcgagcagagagggattcctcggaggtcatctgttccatcttcttgcctatgcaaatgcctgcctgaagctgctggaggctggctttgtaccggactttgtacagggaaccagggaaacgaatgcagagtgctcctgacattgcctgtcactttttcccatgatactctggcttcacaggtgggaggttcttcaattgaaaacttagaactcagtttctagggtagtgagtgttgtaaggtttggactgtgacctaatattacgcagccatgacattatctattaggcatctagactagcttgcttgaatatcttagcatgttgactaatttggggcagaatatagtgtgggtgggggattttgtgtgtgggggggggttgggggttgagcaattcattattattaaaatgcaaaaagcacttaattcgctatgataagattgcctttttcatgcatactggcctacctgcaagacccctagagacagtaagcagcatacatggtgtcttccagttttcagcctttgtgcaaggaacaactgtgggtttctgcacatgtgttgtggtttgatgtttgtatgtgattgtgtaccagggtatgtgtgtctgttattgtgagttcatttctgagcagttgtgacacacagagatccagaaacagtgtcttaccctgtgtgctttgctagtgggaacgtgtcttttcttttgtgctcgtatctctgtgtaatcgagtgtcttgctaagtcaatgtgcctctgtctctttttaccagttctgtctttgtgtctctgtgccttcatgtattttttcccctgagtttgcacgtctctgtctatgtggatatctctcactccaggccactgtatcactgtgtctgtattacagctgtttatttctgtcggtgtgtggatttctatgtctgttttcatcttaatttgtgtgtctaagcaagactgttttggggtgactatttcagtttatgtcatagccattctttgtgtgactgcttctaggtatgtctttttctatgcccctattgtccccatctccatgtgtctctgtgtgtatatgttctaatgtatctgcctacttatcttagtttgtatttctctgggtgtatatccctctcttgcagttctgggcctttgcagtttttggcttatgtttttgtatatatccactagaattggcttcttatcttttttgtgcatgttttagtttgtatgagtgagcatatccaactctgtctttgagaagcagaactgtctgtgtttgcagtcagttgtgttggctgtccctgtgtttgtccctgtgtgtgcatttcattgtatgtgtacgcatccatgtatctttctgcttctctgtgaccagatatttctgtgtagctgtctatgtatattggcttctgtctgtgtctgtgttgttggctctacgtctgtgcatatgcacccaccgggttcataaaaagctcacctgctctccaaggaatctaccagattattttgtgaaataactcacgtttcgtttttttacttgccagctgctatggtacttaaaagtgtgttggtacgtaggtgtgcataatttattcatgtaggatgtcaaaagagtcagttaaaaattatgcacagtgtgtctttattaacaggacacttgtgtgtagagaatccttgagaaatgagtggttagatgataaatcttttcatattaatttcatgatgtcagtgaagtaaatttgcaagatatgggctgcataagaactatgttctttttaaaactcagcatattgatggtggagaaagcatttatttgtactgcaaagtcttatttctgataagacatcacaaataagaattattgtgatgagacttatcacaaataagaattattgtgataattcttatttgtgataagaattactgggttagaaggtgttacttttctggttttgtttgggtttttgttttgaagtgttactacagatggtgtcttagggacaaagagctctgaggttgacttagaacacatggagtacagataaaaaggagaatgaaaagtaacagagagatgggcatattccttgtttgaatggagtcatccaggggctcaggatggagtgcacaggaaatggagaggtgaaggtcatagagagaagtttagcaggaccagatctttccttgtcctgggctgctgtgaccatataaggaaggcagtaaggggaggggtagggatgaggaagagaccagctctcctctttctttctgatggaaggttaccacctctatttaaaacttctgttcttttggtttctctttctttctttgattatattattttctggacttgttctgccaaagcaagaaggaaattccacatgtggctcactcatttattatacttgtttctttgcacgatattaaagacagcttgttaagtgtcactgcaaacatcatacacactgatccactgatatgggcagggggttctttatgccagttctgctctcttcccagtgtatctgtggtgcttaatgggcgcaaccatgatttttctgatgtcagtctgtgatgtcagttgtccagtgtgtatgcaggctgcttaagagtacatacagttccttcacaattatggtagtccctgagaaggaagtggtcattaataaaagactaggttcagtagaaacatgtaagttgtctaggtgttggaaattaatacagtactgtgctaagggaacatatatctagaagttaactgaattatgctcaataaaaagagtacaaatgtttcataaatattttgacctaatcctcctgtaagattaggagagggatatttccgatattcaaataatttttttaattggcaaacaccttagacatactatttacataaaattgacatgacaaaattaagtcattgtgtctgttttatgataaaacaggctcttttgatttagttagaattattgaatgtaaaataatgaaaattaaaaaaaaaacaaggaggaggaatctatcctattttataattcagaccgttgaattgagtttttcttttgttgtattgatttaaatgcagagaagtctatgatgctggattccagtcagaagataaacatttgtatgtgggctctacattgcagccaaccttgataatttcaaacctcgattttctcatctgtataatggtaataataaagcctgtctcagtagctaccaaatgattgcatatgacaaacttctcacttatttaagggaaaaaataagaaaaagaaggacaatagggtggatttttcatatagtaaaatttattcagttagggtaatattctgagattgtcttctgaagcaaaccctgcaaaccctggccattctgttttgtttaggaaagaattcatcagttctgattctgccttttctggggagggaggctgagtattggattgaagaggagtcactacttttctgagatgatatatccgtggtaaaaattattaatgctttgcacatgcaacatagagtgttcaattttgttagtcaacaaatatttaagtggcagctgttatgacctcaggggtgtagtgacttccttattgtcctttaattattaaaaaagaaatctatatcagaatatcaggtaaactcttattacatcaaatattataataaagatactttttatattctctaaacaaagtagagatctcagatgttggttcatttatcaatataatattagatttgaaaattccagtatacaaaaggaaaaggacagcttcttaaagtttatagtgattttctatgaactatcaattccgtttttttctgttttactggtatgatggaaactaaatttcgagttgtaagtagtagataattagactgcagggtaagccttgagattacttcttttcaggtaggaaactctactgtgtatttggctagttcaacctatcatgggtagtcaaaaatagttacatatacaagtcagcattttttaaattgttcagttgtgcttaagattggtcctttccaggaacaatccagctttatcaaaaaattattgcgtacatgtaaagtgttctgacattttaatgctcacaatagccgaatgacgtgggtaagaatcttcgtcttcattttatagatgaagaaatgaagacacagagacataaattaactgggccagggtcctaccactagaatgtgatagatgataatttgagctcagcacatagttatttccctataatatttgttttatgattgtatagatgtctgctgaccaaccttaatctctgctccctaagattaaccattctacaaagcagaaactggaggtcattcaaatgaaagctctacacttttagagggccattaacaatgctcaagttaaagaaaagcaatcaaagacaactaaaatactggtaccttcaaacagtacttatgaattatttaaccttagataatttggctttgagttagaaagatagagtaagatggaggaaccaattcttccctgggttgatatttatttatcttgctcttttgaagtctaggccaatcatcctatttattctgaatggcccgttaacgtttatccatttagggacagcaggtttggcacaaatggattggttttctgaggtcttatgtagagggctgcactgactgacttctgaaagtcccccctaacccttcaaatctcagggtcatctggtctcaagccttcaattatgaatacatttctattgcctttttgagtaacagcacaacactgcaagctgacccactgggtggatggaatggggctcttgccctaccaccctttggcaaacaatttgagggtggcattgtcactacctcattgtatatagggtctcttgaggcccagaatggcaaaataattttcccagtgtcacacagcgagttattgtcagagtaaatatcaattttgaatttgtagaccacgtggttttacctcatcatttctgtttgttatgaaagttttacaaataattagaagtagaaataatgattaaaataaagcataactactaaaaaatagtttattgcagcaccacctaaattcatctcaccactctaccagtagcatacatttcacaattgggttaacattgctctggatcttatagctgttgaagaagacaaaattctttccattctccagcttatattttccccatttgtaaaacataatggaagtgtacggaaaataggagttgataatttttaaggcccttgccagcacattagtacataggattcttgcaagtggtggtttacttcacttcaactatagaaggcctatgcgacaccacccatagagggtagtttgaaagaaaatgctagtgactacgtgtgtttccttcctgacatattttatagaaggtgatgagttccagcattttttcagacttggatctggctttcattccccttctcctcccaccctctaaaacaacagaggcagcaaccatttacacactttccagaagtaagtaagtaagactgtattccagaaacaccctatatcaaaatggaaatatactcaagtgccccaatgacccattgggctagtttgaacgtgtgcagtctctgtgctccccgttttagcttaagcctactccctaacctgtcatatgtcacccagccatggagcctagggcaatgactgccatcatatctgactttatggcctctcagctttcaatgactagctttgtagcagaagtttagcctctcatccccataactttggaagtagtgttgagataaagaaacgttgaattgaaggttgtgttttctagatttctttcaattgctccttaggctttagaagataaattctcctaaaagagaggtgctacaattaatccaagcaaagggaaagatgtcagtaaaactgccccttttcatagaggtgtggcaactgctgggaaggaagaaattagcctgaggccatgtgattactaataaactcaaagcggcatttttttacttctcaatatgaggttgaaactataagcttaaattgctgactttctggcagcaccaaacagtaaggaaaccacaaagataaacccaaataatagagccaattttctttttttccgggggggatgacttctaactagtgatatgaggaaggataagaaaatgtttctttgtaggacatatgatctttgctaagtgcactgaatgtatgtagaggagacaagtctgctgagggtatgagaattgggccaagatttaacacattttcaaagctccatgaagaagcctactgagcagtgggagtggagcaggttggggatagtgaagtatttgtaattcatttttaaaaaggagagggagagagaaaaggaaaaactgggccacccatcctttgaaaagaaaccttgaaagaggtccaaatatccttagaaatccttgacttcttaaaagtgatgtttgttttttccccctgacaattatagaggtcagagagtttttcttttctattacaaaacattgagagtgtgtagaaataattgtaggtagcttagccttggctgtagtcagaacttttgtactgtgactttaggatctgtatggaatcgtatgatatgcggatacaccaaaaactctatgggttatcaaaatgggatagcattaaaagaaatagtgcttttgtttagaagaagaaatgaaatgcttgtgtccagatgcttaaaggaaggcagtgcagactttcagaaactagactttaagagctgtactcagatactgagaagggctgatggctgaaggaggaacaatttaaaagaataaccgtctctcctctccctgtatattggacataaaagaatatcccattcttttcagaaatgtaatacaacagtttagcttgctagtaacttcacatgctatttcctttacctcttatatttgaggtgtctatttggagtgggctgtgtttctagctattctgtttatctggtttgtttttgttggtgtaggaaactggtataaattttatttgggtaaatatcacctcaattttcaactaaagctttatttaagtttcacatgaaaaagacaaatgaggcaaaggaagagaaaaatgcattgtcagaatcagaattatgagaaaaaaagtcaaacaaacatatttgaaatgtccagaaaacctgtgagtttttatgtatactatacaggaaagatattctgtcatctggttgccaaactatggagggtgggagacttcgaatttttgtcaaaaagtattctttcattagaaagatacatgggtgtgcttccatgtcagcaacatgactgcagaccaggaagtcctcacggagagctggaatatgggtattttggactctctggttagatgcagcttttacttcacatcctcagtggtactactgtaaattttcattttcctgtggaataccctatttggttccattgtatatagttgacaactagaattcgttcgctgttgcttgagcccaactataacttcttggcactatacctatcttctgatgtgcctgtggaagagctaccataatgaatgtgtacatggacaaaaaaaaagagagagagagagagaattaaatcatgagtttgtgccttgggagctacagtttaaacatttgctgtttttctcacttaatgaaaaatttatttgaaaataacagcacagaaaggaagaaagacaggctggcaagcatcctcctcctaatacacttatccacgtttggataccttggtctcagcctcagaggtcatatttttagtaaaatggccaccagaaataaaggattttattttccagactttggtgtttggagctggtgtgctgagagctagcagagaaagccctactcaggtagatgtaccagagcaggatggttgctggtggatatggtggaataccttttatgtggttatctcctccttgtaactcttggctgcataacccttattttcttttctatttttattctctctcttggaaaaaaaattggtggtaaattttcatgtgagccatattgtctttttaaatagttttattaatataaaatgtacgtaccataaagcatacccatttaaactgtaaatgtcaatgggtttctctctctctctctctttttttttttttttttggatgctcagagttgtgcaacaattatcaaaatcaattttggaacaatttcattgccccaaaaggaaaccctctgcccattagcagttactccccatttcccccaccccctgacccttcaaccctaggcaagcacaaatgtactttctgtctctatagatttagccattctggacatttcatgtaaacagaatcatgcaatatgtcaccctttgtatctggcttctttcacttagcatgatgtttccaaggttcatctgcattgtagcatctgccaatacttcattccttatttatggctgaataatattccattgtattaatgtatcatatttgttttttccaatcatcagttgatggacatttgggttgttttcatcctttttttagctattttaaataatgctgctatgaacgttcgtgtacaagtttttgtatgaacatctgtttttatttctccttggtatacacctaggagtggaattgctgggtaatatggtagcttaacatttaatcttttgaggaactgccagatttttccaaagcagcagaatcattttacattttgaccagaagtatatgagagttttagtttctccacatcctcaacaacactcattattgtcattgtccttttcagcttttttgataatagtaatctcaatgggtgtgaattgggaccccatcatgcttttgatttgcatttccttgaagagtaaggatattgatcatcttttcatgtgcttattggccgtttgtatattttttgatcctttgctcatttccaaattgggttatttgtctttgcattattgagttgtaagatcttacaatatattttggatgtttgtcattttagggatgatacttcacagttatatgatgttttctagcaagcatttgcgttgttctactggtgttacatatcttagctgcattagccactttgctgggtatgaatgccagcagaatctaagtgaccttggcttcactactgagaatgcaacccaagaacagaaatttgtcagaaatttagcactgaagccccccacttcccaaacttatctgggacaaggagaatctacatttaaagctctatactttgtgttgtgttttttttactttagcttggttggatttaggatcttttctttttgttttgccttatgcatacctaagcagaggcaagggaggaaagggatatgaacctggtagaaaagtaagtaagctttattcagattggcatatccatcttaatatggttcaattggctgaagaagtatctcaactaaaactctggaatactttgaagtaccagcaatatgtaccaaatgtactttttatttatgtttggtctctatgtacttgtgtgtgaaacaatgagcacaaataataccctccttgtttttaagcaatttatattggtgatttaaaaataaaataaactcaagtgggaaatcatgaaaccccatgtaaaaacaataagagcatgttttaaaatcccacagactttagtttcaaatagtggttttgctatttcttagctgtgtgtcactgtgcaagttactttgtttctctgagtctttattggtgatatatgtaaaaacccaccttctcaaattattgtgaggacaaaatgaagtaattaacataaagttcctggtgtataataagtgttcatattttgtatttgagcacagggcaactgggtttttgaaactgcacattactgttgcagtcaaatctggcatgaaattagtgcatagacagaatgggctgggaaaatgaaaggactttgaacatttatattctgctttatttaggcataagtgcttaataattattgatagtttcttctggttatctgacattttgaagatactattacctagcagaaatttcttgtaataataatctcttacacttatatactgttttgtgcctttagaagtacttaatgctctttatttcactatctgttcataaacattctctgaagcaagcatacagtcagtatgaattccatttttcagatgagacagctgaggctgaaagacatagagttacttgtctcaattcacaaagtaaagtgccagagtttgaaccagagcccaggtcttctctctcaacgtagctctttttctccttcattatatcaggcatagtagcaacgtattcttttactagctttttatcttgaatatccttttagcgacttgcctttggtgttagtgtgcctataacattgtcgttgaatatcttaatacatttagtggtcttggcaagcagttttgtcttcagaaggacactgaaatctgtggaaaggactgcagaagattgggtgggcagacacctatcactttcggggctggtagactttctattgaagcaatttgcaaggctactttgtattgtctaaaagcactacttcagaaaagggttgtgatgtcaaaataggcactttgagtgaagaaagggctgtaagcatgggtggaaaatgtggtagatgattgtcttgagttattttctttaatgtcaaacaggcagtccttggaatgctacttcaaaaagtgttgtataatgttgaagatacagttacagatttccaacacgaaactcataaatatgcaattccctgtcctcctaggcacatgaaggaaaatttatgagcttcaggtttctatgcagctattaaagcatatttaatctgctttgagctcaagctcactctcgttggctctcttcgtttcttcctcttacatgagcaaactgcctttctttttgtttaaaaatagtaagtaggtttgttttcctccaggtgtcatgaatgcaaacattgtaatttctcatctgttcagcctttttgcacaacaaaatggcagcacccaggaggttgaaagggttaaattgttccttctctgagtagtaccataagttgttagtctgctactctttctcccagttggcacatgaccctaacatccaatcgctagtggtgtggccattttttggtcttattttggcctttcctcagccaccactcatcagttctcatgcgtatttgtcagatcctgctccccaactccacagttcttagttcatcttaagcatatggctgtctgtcttttctctaaagatcctcaagggaaaaaaaaaaaagcatctccagggggaatttactgcctcatagccctgacagagatttctgaccaaaccctaacgaaaaaatttcttccctccatttgtcttttattgtttttacaggggagatatgtaacataataacaattatattgcacataataattacttctacaaataataatctgttgtcaaaaatatacacagctttggatttccttattatggcccttcattaagttgtggtttaagaatagctatgattattacttttgtgataattataatccataatatggaaacttataaaattacctttaaagtgttactattattctggccacaggatggaaagttgttcgctagttactcatttataacctgaatgtactttttactgaatctaaaggtatcatctttgcttggcaattcccatgacttgtctttctgactcttcagatctcagcttaaaagctctcccttcaaagaagccttccctgaccactctggttttttcttctttttttacctctactccttttcccattacttgctgtcatagcattctgtttgtttcctttgaagtgcctattccaatttgtcattatgaatgagtttttttgttctgttgcttattatccattttccccactagattgtcaactctgtgagggcagagaccatgatactctgttcactcctatatacattcccagcactatcagactttttggcacatagaagatactcagtaaatatttgttgaatgaataagtcataaagaagagtttatattttaactcttagttgaataatctaagccaagaattatcaacctgggttggacgtgagaatcattaatgaatctttaaaacaatgacaaggcaatctatttattaattatctccaggtctaaactttagcacgtatatacattttaaaagcccataagtgattcttacgtatagccagtgctatctgtctcttctcctgtcctttcccctcctctccttactcctctctcatagttttaggattagcatggccccacaacaaatctttaattcacatggcaatttctaggatttatcatggaaaatgagccaaattgccttcaagaagtttttacgtacctcttatatagaatgtgatgttttatatgtacctcttatagaatgtgagcttttaagaggcatatcttattgcaagaaatttcaatgttgaaaaaaatattgaatatttataaagtcaaaaatgcaaacttttatatgattttcaaacctatgaagttatatcatgttcaggccttctttccagcatgtggctctcagccctggtactgtccttaaccataaacctcatctttgccctctatagggagaggtttatggttataattactcattttaaatagtgtatattagtaatgtacactatttgtatatttgttgactgcctcctatatgccaaccactatgctagaaattttgtaatattcttcacgatattcaagatattaacatatccgcattttataaatgaggaaactgctctcaaagaggttagtttacacagccagtaagccgctaagcctagattggatggaaggtatgtgagaaaaaagcagcatccataaggttttcattctcctaccctgtacgacagaggtaatagaaattattagttaaagaaataatagaattttacaagactctaggaagggagaatgtgaaggatacagttctcagttactggaatgagtgccagagtaccagtacatggcttgccttggggtttggactacctatcttaactcctttgctcctcccaatcttgatctcatttgtttgaaagatcatctgcccaacataaaaatgcatttctaattctgtaatttaagtcagtggcaagatcagattcagttaaagtttactttcctgacagctttttagtatcatatctattttgcaaaactctagtgataaatgtatgcacatttacacatacagcatctcttctgattctgactaagatattactgggttgtgtagaagtgatgggctctttagaagaaaggtttgatatactactaatctaaggactgaattttctcatctttgtctttgccccttttgactgatgaccagagcaggagcacataacattcttttgtgctaacagtatctctgcatcacattgatcaggagaattggcatctccagagccctgggatggtaacttctctgttgattttcaggaaagattaggtgatattttctccatgggaagaggatgtttgatgtgtgttggctttagcaaaaggaagcttgtggagtcaactgtaagtagacagaattgcctttgacttaatctgtttcagtcgttgttcatactcaggtcctccagaggacctttaagcatttttattgactttgtggtctattacacgaaactaaagatactgattctcagtcatgagtctgctccaaaattgcctagggaatcaaaaataattgtaccagttcctattcctggacattatgattcatttggtctggtatgaaggccaggaatctgtatttttaaaattcactcaagcaattttcatatatagctataattgaaaatctgtggctgaacttctccactcccgtatccatcgcaatacttccccaaggtggcatttaagatgggcctagagggttatataagatttcaatattaaaacatggattaaaagtgaagacttttcacatggagataatttggaagaaaaacttgcaaaaatgtgagagcattgagaacttttctttcccaaggaaagaagtggcagcttcatttttggtcattgcaaacagcagtgccatacatgaaaggaaagtggtggtgctcatcaactttgaataactttgtacagaacccttgagactcctctctgcttataaagaaaaagtgtcaactgtaaagttgatttatttatgaaccataggctactatgaaatctctgttcccagctagaggcctgggagagtaagataactacttgtttattccacggagccacttattagctttttctatagcacatacctcaaatgaagcatttcaataaaagaaccacattctattcacatgcttcattttattctgatttatgtaaaaattcccaaactcctcaagcagtgtttctttgtaaggcaataatcttcagttctgttgcaaaggtcaggagtgatagaatgaaaatggtactagatacaacagctctttggtatttgcatggccattacattgccatggggctgcaagacttgtgagtgcttgatattttgcttgttgatgaatgagtctgtgtttgtgctaatggagtgatttgagaggtagttctccactgtcagtcaagaggttggttttgaaagctgattgccaatggtcattctgctaaccactctggttctcctttagatagagacttattcagattcaagtcttcatgtactttgtggcataaacattgtacacaccagatgtattcaacaaccataaaaaaaaacaattaggactcaagtagtatgtcagagtgtagtcactgatgatatataattctccactaccaagaagatggaagcacactgttgagtagctacatcctacatatgttggccagaatttaggaatacacatgtgatctatacattttgaggtattgtctgacccctagaaaatcctggtgaagtttttctggtgtcagtttggtcttaatgtttaggaaatgcccacagactactcctgctttctgcttattcacatagtaaacgcaaagcacaggactagtttgtcatctggatcaaggagaaatgagttagcagatataaaataaatcagaaaggaggtagttctcaaatatttactccatgaatagttgctggatgttcattaactctatagcatttgttactacttattggggatcctggaaagaaaatatattgtctatatccactgttcactgaggccctctccctacccagaaactccctgtctccatcactcactctccacattcattgacccaggggaacagttcatggatgagtgaacttgagctctatcttaaaggatggagttcgatttcaaggcaagaggtataagagaaagttcagagacaacactggctatggtctttgtgaagaaaagtgaattgaataggctcctgtggagatcttaagtaagtacttctggagataaggttgaggaaaagtaggtttgaatcttcatccagaggtagcccctaaatgtgttgagtttattgaaagagtacttgacttggattcagacagatctgcatttgactcctgttttgccatttataagaatttgagtaattattgtttctaaataagagtttattgagccaagcactcagtaaatgtttgaatgggaaaattaactgccctgtttttctattgtcagatggtcctcttcgttggataacttggtaactgttgataaccttttctcaggaatcagaaggtagaaaggttgggaaaatataagaaacaaaaaggcatattcctatttttattttcatattgtcttccaactctcccaggcttctttgtttgcaaggctgacttttataatactttttgggtagagcaggtccttctttggtttggggttaaaccgtgagtaaccttattttctaggtctcagccaactttgaagggcatgaactcacagtagcctcactaggatcacttcagcagtgagaatttatctttcttgtataaaagtgtaagagttgatggcggccaggcgcagtggctcacgactgtaatcccagcactttaggaggttgagatgggtggatcacctgaggtcaggagttcaagaccagcctgaccaacatggtgaaaccccatgtctactaaaaatacaaaaattagttgggtgtggtggcacatgcctgtaatcccagctactcaggaggctgagacagaagaattgcttgaacctggaaagcagaggttggagattgcagtgagccgagattgcaccactgcactccagcctgggtgacagagtgagactgtcaaaaaaaaaaaaaaaaaagagttgatagcaaaataactatctgtagcataaacctcagtattctttatcattcagtatcaacattattactgaaaacaataagcaatatggactgagtttctgtggggtggaaatgtgaagtggatcatagcatgatataacttgtcatttggcttcctttataaacattatcaactacctcagctctatcaatcacttggcagtccgtagtgaacattataactcaaatgactagtcaggtctgttcattgcccatgtaaaggcatatacctgaagtgagaagtctgaggtaacttagcaataagcttgcagtacagtgtttagtgaagccgaggaattcaaggatttgagtcatgccagattgctccataaccatagcctatctttgtcacaagtaagaaggtttaaaaatcaccataccattattggtcacaacgtttggagatagggaagagtttgtggatggatcatggcagtgcatggacagtgattagcccataacacaaccagtgaacactgttgtacccaaagcacataaatcaccacatatactattaatatatttatggatgacaacagacactataattttatgtcagtgctttctgctgtgaaaaacaaagaaagttaagggtaccttttttatatttgcatcatatctccagaccttttcctttatctccttcttgcaagttcttctttctttcagctgactatctgctgttcctgctatggctcccagtggcttttcaagagggtacttgttttttaagagaagacccttgaaggacagagagagcctgaatcattcaaaataatgaattactcaggatgaaatttcaataatttgcaagtgtgtggagatagatattttgaggaagcataattttctatgtacccctcaaatcgtggctggagatgacagcctcttccacctccatataagaccatttcatttccttctacttttttctccctccttcccccaaacacacaaacatacacatatcctgtgcttcagtcacacagaacttcttactatttcatttcaattctctatggctttgcatgttctgctccttctgcctagaatgctcctttccttttttcacctggaaacatcccaattcaaatgtcacctcccttatttataccaactttgtctgtaactcctttatcacacttcttcctgtgattagtcaattcacttgtctgctgttacacctctatgagagatgaaaattccttctccatctctggaactcatgcccttcgcatatagtaggcaatctgtaaatgtttgaaggttgagtgaattaatgaatgaccttcaacctttcaggcttccaattttctctctgaaaaggacagccaaatgaaaactcataattttagaagatgaggttagacggttggtaggtgcatgcagagaccagttattatttaggtattatggaagtttatagttcttgtatgttgagttcagtgtaagagtggccccaaacatagttaatgaccactccagacccagttgttatagagttggccccagctgtattgcttctatttaagactaggataagaaatgacactttcctactttttaccttattgaaagggtagaggctcactgttatcaatctcagttcacttgttgattgcactggcttgccaagtgagaatattagcacctctgcacatttctatagctctgccacttatgagatctttccttcccattgtcatatttaataatcaggatagccctataaaatatgcattctcatttcccagatgaggatactaaggctcaagtaggagaacttacttgtttagtaagatcatacagctaggaagtgggagaggcaagagttgaacccagatcttcctagctcctagtccattgttctgtctactgggtcacactggaccagccaggaggcaggaaaatcagctggggaatgtggtgccaacgtgtgatgtttgcctaaatgtgtgcatccttgctggaagccagccatgattcatgctgcataagtattcattaatgttcatttcatttatttggctatccatatgctttccagggcgaaggcaagctaggacaagggcagacaagcagccttaaagtttgggtgctttccttcgaagttgagctgcctgtttgaaaatcacactttttggtgatagaagatggttccagtacagattttatttattactgcatctacatggatagacattttccaaagcatagctgaaaatatgtgtaagtcccagaatattttctgatttagacacagactttgagcatgataaccacatttagcatgttaggaaattctgtcagaatgcttctggaaaggctacctttccagaatgaaatgaaaaaagaaaaggatggactttgaaactggctagatttgggttatacttactcatagtgtgaccctggcaaatgatttaacttctccgaatttcacttttcttattctttgaagtgaaattttaaaatgccatcttgcctgatttttgtgagaatgaaaatgagatcccacaccaggaatttagaagctactcagtaaatattgcttctctcctttccccttccccagtcctgtcccccgagacattcagtagttattcacaggcatgcattctgaagtctgcctactgctccatgttgaaatgcactgctcttgcaaggactgattatctatttttctgtcttccaaggccccctgtgttccactccaccctcccaattctgggggcttccaaagtgggcaggtacagaatgttctgtggagcatcggaggctgttactcaatatcttggccagcactctcaactgctctttgcacacactccatatgaaggcaaactccagatcttggagcccatgtgtgtgtcatgcattgtactgcttcttgtacccaaatccatctcaagggtgagtagaccaggctcagacttgtcctgggagcagatttctcaagctgcccatgtccccacactgtttgattaaaaggaggtgcttcaaactctttggctttatatagactagaatcagaatgattggtggtgcctctgttctcaaggtatcccaaagcactttgtaaggaaatatgacaagcgctgaggccatgcaggccagtacaacagccgccacccagcacttcacaattagtcatgcccagcctgggatcatcaagcctgtttttattggaagagcaagagagagagggaatgctagctggcaatttccccaggtaccctttatgaaagtgcccttggctcttccaatttcatctgaataaccagctcaggcaaattttcctctatcaaaaagcagaatgtgatagtgacaagctgatgcccggctgatgccccaggacattgactaaatagacttggcctcacaattggtttttattctctatctcctttcttcccttttgttctttttctgtgtttctttccccattgccatctgcagagtgttctcagtcagaagtcagctgtggggtggacagtttgtcattttaagatcatccctattctgtctacctttcttatccctcatatcattgcttttagagcaaggacaattctggaagtgaaactacaataacactctgggctcctttccctctagtagtactcaacacacttgtaattacatgttcaaatttgtctttcttatttctacttaggttcatgaaggcaagggacatgcctgtgttgcttactttctcttggcaggcacatacagcaagtcttcaaaaaatgcttgttaactacaaattaagtgtttaagaagtccactgttaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaagaagtccactgttagtatcttttcccctgcctagtttgtaagcaactggcctcttctatttgtaagttacctgttttcatttccatatgccccaaagcaaactttagctcacggccttacagagtgtgtatgttagtatgttaaaatgaaatcaactttcctctcccaggccttctaattgacatgaatttgggagtagacttgcattggcctttgtcctgacagccaacagagtcctcttctgttgtattcactgttgccttccatgaggatcccatggagaaagtttgtcattgatatacattttgagggcagactcaacttgagtaaacctgattgagctttccccatctgcctcccagagatcactgcctgtgctttgttaaaaagagaattataggagtcctctcaaggcagagaggcctaaaattagacatggcagccatgcctttggtgtgcatggaggttggatacaggcagccagtttcccctctgttttctcccttgcttacacagccaaggagtggagccaagcctcaaggggaggagctgtatactcgagcatgccctgtggttcctggccctgactgagggactattttatatatcccaatagagaagcgtggaagacatctaggttgccactgtcatttgaaattggaatttttaaaagagaaacctgaagacttgaagaaagctttcttttgcctccccttacagttgatttttgagcttcttaaagctacctagtccaaagtacccacactcttattcttttgtctttcctactggttttatttttttttcatcttcccaggtgtttgatgatcactaagagcttcaacattgctcaccctgaccaggtatgaagccaagagtttggtttagggcataaaagaatgtcggaactcaaggactaggttgaggtggggaagggggatgaaggcttctttttttcttgggttaagcagaaataacttagatctcagagtgaaagccttgaattatcacatatatcactggaaaagactagttctttgctatgataacaattgttcatcatctctcccctgaggatttggggtcaaggcctggctacaccttttaatgatttcagtcatgtgacttaacctctttaaacttggattttcttcatctttacaatggaaatgatgacaataatcactacctcacagatattgataataatgatatctcactaggaagagaattaagtaatatgagggataaaaaggcatttgtaaatggtaaaatgagattatgattttgaaagctattattattttcctttcactgtctattatctcaactcttctattttcttgccttttgtacagcatggataatttagatgtgactctggacagagggatggatcagatgacttcttaagttatcttccagtttaggagttcgtaaactatactttctcctttccagactatcctagtaagaaaattctcttttaagacagagtagaactctggaattcatcagttttgatgtttcttaaagtgtaatctaagatagtgctcctgtattaagttctgatgtctgaccattgttcaaataaagagtaaaatgcaaatgacaggaaattggctgcgttctgaatcctatttttatttgggataacaataagcctgtatggtcactgtgacctttgatttgctgtttctgcaacctcacacttgtctcaggattcttcttccacttctgcactttatattgggtttcttccaggcatcatattaaactttaagccaggtatgtgtatatgcatgggctgtgggcctgaaaaaaattagcccgagagagaaaaaaatttaagtagtgggctagaagtaagcatgctactagaaacagaatttgggaacacagctctgggcctagaaaagcgacctgtcaacttgttacagttaacatcaataactataggatgggtttggtggaaaattatgctgaccaacagggtgggagagaatagggtcagaatatatatcgctgtaaggttgagaaaaaaagaagtgaaaaaaaaagaaatgcatagagagaaaaaggagtttagaggtaacatgttaaagtgtgagaaataaactggagagcttgacttctcttgaatatatttttaaataaagtactcctttcaactccaaatgcagcaggcttggttcccttctcctacctccattgcggatgaaagcttaatctttaagatgggcttgggtgggtagagtacgccccttggtgagcactgtgctctctgcaaccccaataaggcccaacagggctctccaaggaggcaaaattctgatgatacatttctgtttagtggaaaatgggtagggaaaattatgtcttagaatcaattaaccaaacataaaatcctccaaggggcttggtaggatgcctagggaagagccacgagataaaaactccaggctggaagggcattgttgcagcactgtcattctccagtttctcttggagttgtcaccaccctctcctttgttctcactgctgacatcatttgtaaaataatttcttcccttaaataaacaagacatacaatcctctaaatgactaaagaacagttacctagaagaaaccttagtggaaagtattttcttcatctaacggatgattgtctttacagaggtggagtaaaggatgtgcgagggagcataatcaagctaagagatgcatgctgacttaaaaggcatgatatatgtgaaactaagataatgtgttcaagagtgatgctttgttgatgcagaaccactgaattccttactattatgtttgcctgactatcggcctcttaataaagaacttgtggtttgagtgttcattgaaattagccatattaggtttatgtggggatgtgaggatctatgtctaccaattgcagcctctgctgcaaattggaggcagaaatctgggctgaacaataggtaagagtgtcaactctacagatctctcacatgctaagcaagcacaatatagggcaatccaggtttacacaaaggattaatttgggaacaattatcctcattttcacttcctaaaaagattttgaataagatgtcttttaagtaagaagctccctgaatgcatttaaaatatgatttgattatgtacatttcagatttttctacctttctaggagtatctctgttgtataaaaacacaaaattctggaacttttgaaaggaagatgtgcctctcttcatacatttgtcattcttgaacgattgtaaaatgaagtgactgcatatcacgtcatgtgccctattgatttcttttcttgttttaggaatattcccagaaaaaaaaaaaacttttttttttttaaaatctactaagcatgctaggtaagactgaagatgaatctatttaagttatgtcaatatctatttataaagatttttgtgatattcttttcactgtagaacttcaagcatatcctaaaaggaacggttagatacctctacaaactgtggcaatgacttactgagtaattgctggcaactgatttttggtgcttcttgttttgatagtatagcagtgcgagtaggtttcagaagagcaaaactaagacaatccagggaaatgccatttgagaatttctaactttaaaaaaacaagtaaaatagtgccaagaatattatctaactaaccccaaagtctacaatgtaactcttttattttgataatgctgttctaaccctatctacttcagtcctttcccacccagctggtttaggaatcaaattcccaatgtttcatcactgttaacattactgttttactcttcactttagttcttaaatggcatagtgtcttaaattccctcagcctctttcacatttgatttctttggaaactttttaccttttcattgaagcccatatgatcttttccgaaacagacccttatctttacctccttctttggagtctttctcctacttgaatttctgaacttcttaaaatggccgctttgggttggtgtcagtaattcagtaataagttttcttttctttttttttttttctttttttttgagacagagtcttgctctgtcaccaggctgcaggctgtagtgcagtggagtgatcttggctcactgcaacctccacctcccgggttcaagcgattcccttgcctcagactcccaagtagcaagtagcagcaccatgcccagctaatgtttgtatttttagtagagtcggggtttcgccatgttggccaggatggtctcgatctcttgacctcatgatctgcccgccttgccctcccaaagtgctgggattacaggcgtgtgccagtatgcccagccagtaataagttttcttaagtgctttcttaatattctgatatttttaaaaaagatctggactattttgtcatacaggcaacagaatgttaaaccatttcataaaacaatgacaaatatacatgaatttttcatcagttataaatgcatttcctttataacattgaacatgtttttgcaactgaaataagtacggttttcatttttagaaggcacatgataaagttaaggcagtggttaattaattttttcagattaatttttcagaaaagtgactgtttctgtctattgtcttaaccccaggcatcaaaggattttaatcagaaagaaccgaggaataatttggttattttagtgcctttttttgagacaaagtcttattctgtctcccaggctggagtacagtagtgcgctcatggcttactacagcctcgatctcctggttcaagtgatcctccaacttcactttcccagctaactgggaccacaagtgggcaccacactctctgcaatttattttaatttttcatagaaatggggtctcactatgttgccctggctggtctcagaatcctaggttcaagcaatccttccacctcagcctcctaaagtgctgtgatttcaggcataagccactacactcaccctattttagagctttgtcaagctttggaaagaaaaccatttataatataatagataaattatggatatttgaggcagtttttatcatagtatacatggtaaaccacagcccccctttataatatttgtatttaataaaaatgaaaatattacttttatcttaaacatgttttaacaaagcaagcatatgtagattagcactaattaaaacaaaaacctttgtaatgatagctgttttttatatgattacaaaaaatttactatacaaatttttatcctaatcagtgtgaaaaactgcaaatattagcttatagggctagtcttcagagtcctcttcctacctactactgctaataagccaatgaaaaactctctgatgtgtgtggtggctcaggcctgtaatcccagcactttgggaggccaaggtgggtggatcacttgcactcaggagtttaagaccagcctgggcaacatggtgaaaccctgtctctactaaaaatacaaaaaattagctaggcgttgtggtacgcacctgtagtcccagctactcaggaggctgaggtgggaggatcacttgagcccaggaggttgaggttgcagtgagccaagatcacaggactgcactccagcctgagctacaaagtgaaaccttgtcaaaaagaaagaaagaagagagagagagagagacaggctcctccgctttttcagttcctaaataattttccaatctagaatgcaaaagattctgaaggaagacagttaccatttcagatcggcagaagttgtggctttaatctagactcgaatatgttttacatcaaagggttgcctcaacagtgctcaaacctgcctctctgaaaacatgctgagcacgaaggttacttgaagtcttagcttgagtacttaagagagtgctatggagggattgttgatgagagctgtgtcacagctaatttttctttagtaattaaaggtttataaaaatcttacactgtatattgacaaatttagcaacaaaatgagcttgagaaaaaaatcaaggcctgccatggcatctttgcttttttttcttaaaaaaaaaactttttagaaagattatgcgactgtattatctgtaactactgcaatggtgtaaatcctgatggtataatttgctttttaaagctatctttacttcagtataacttagattaaatttattttaaatttaaatgatatttttctctttgtttattattttataatgtttcccatagaattcacaaaattcattagaaagatttttttttacttccttaggtcattaagattctgatttgtcaatggatttcacataaaccctgtctttccaaaaatatacaaaaaaaaaaaaaatagccaggcgtgatggtgcgtgcctatagtcccagctactcagaaggccgagttgggaggattgcttgaacccaggaagttatggctgcagtgagctatggtcacaccactgcactccagcctgggcaacaaagtgagaccccatctccaataaataaataaacaaataagtaaataattttcaccttgaaaagcttataaatgtatgaaatcacaatgagggtcgctgatatagtttggatgtgtgtccctgcccaaatttggttttgaattgtaatccccagtgttggagatggggcctggagggaggtgattggatcatgagggcagttttttcatgaatggctcagcaccatccccttggtgctgttgtggtgatagtaagttctcatgagatctggttgtatagcacctccccccttgctctcttgttcctgctttcaccatgtgacatgcctgctcccccttcaccttctgccataattttaagttgcctgaggcctcaccagaagccgaacagatgccggcaccatgctttctgcacagcttgcaaagccatgagccaattaaacctcttttttttttttttataaattacccagtctcaagtattctttatagcaaggcaagaatggacttacacagtctcttttgtatcagggagagggtcttcttggtgactccacttcttttctttgtttatgtatccttccagatgatgtatttatttcctttgtttttcaattgatatttactcttaaattaaactaattatttaaaaaagcattttaaagtctcattttagattattttgactatctgatttttaaaatggtttaaaaaatctatcttggcctccatatgcaatcaaataagaaacacattttaagcatattatttaccttgtggattctgccttcctcagtgtgttcagtctgtgtatattcatttctcccacactgtaagaagctagtcagatgtataattggattatcatgctacataatcttagcacactcattttaagcatacatagactagtgagcaccactcattacatgtcatttctctagagaaactagttgggccatggctgcaggactctcacttgaaaagacatgtgtggtgatgttttctcaggcagttaagcaataaagtgtaccctgatttgcactgaaaataaagattcctttaaagggagcagttctagttatctctctctttaggtaccatatgctgaacgtttttctatgcactaaaacagcaactaggttttatactctgccttacagcctacttcacacccatttcacagggagaggaacagagaggtaagtgatttgccccaaattacataactaggaagttatttgctcagtgtggaaacttgttcagaaggtcatttcattgaaatgtaggaagagtttctggcacttctcttgagcaggagtcaaaaacctttttttgcactagcccagatagtaaacattttaggctttgtgggccatatgatctctgtcaaaactcctctacttcgttgttgtagtgcaaaagcagctatacacaatcctgaaatgaatgggtgtggccgtgttccagtacaaccttacagaaaaggcaataggctggatttggctctgagactgtagtttgctgacctcagctcttgaactgagctctttaactgacctcagctcttgaactatggtacaagatcccatggtcctgtttggtacctccatttgccctccttttcactctctgggagcatagctaagttcaaaattgaattaggtacttgtagtaagagcatacttataatcctgggatcttcatgttgccagatattaacctcttgaagtttttcaccacaacctgggcacttttctgatttgctcacttctagccccacctttgggccccttcataagcaaacatgcaggttttccagagagctgtatgctactgaatgcagaaaatttggctcatactggcctatggactatctgctcactgccctgataactattttccaagggagtgggtgccctacctttcctacatgaagttttttgctagtcttgccctaaaaattctaggtatcccttgcttttaggataaatatgtttcactgggaccagctggaaaacgaaaaatagaattatccaactaccactttaaaattggacaaagacttttgttgttgttgttggagggggtggtaaacatcattttagcagaccaaatatacttttggtgaaaggcagcctgttgcaaagacacaacacttggacaagattttgaagccctggttgcctttactactgacttaactacagtatttgcggacttgagcaagttgcttcccttctgtgagcctcaggttattcatctttgaaatgagtataatacctgtgattataattacttatctggattctgcagagaattgaaggagataatgggtgtaaaagtactttagcgcccagcactgctccttatgaaaatgaggaaataattgagatgagtgagccattgaggcaacagtacaaaaagtgctgaaaactcactgcttaaataagcacctcttactgcttttgtggcactttgtagcaatgtttttttttttttttttgagacggagtcttgctgtcttgcccaggctggagttcagtggcacgatctcggctcactgcaacctccgcctcacaggttcaagcattctctgacttcagcctcctgaatagctggattagaggtgcgtgccaccacgcccagctaatttttgtatttttagtagagacggggtttcaccatgttgatcaggttggtctcgaactcctgacctcatgatctgcccgccttggcctcccaaaatgctaggattacagatgtgagccaccgcaccccacctcagcaatgtgtttttattctgactagaaaagtaatgtttggttttgtttggctctttgcttaatatacccataataagggtacctatttgcctttggaccattagttcaaatattattttattaatatggaattactgggctccagaagccatagtcttcttagctgctccctatccccactctcacctcaatttttttttttcacttttgtttttcttctcagggaaaggtttgaggcaaagaatgtcttcttatgatccaaaaccaagcatggtggtgatttattcaccaagagattcctaagtacctgtgtgatggacatggtagaatctttgtcctgagggagctatctagatccattccttctgatatgcagccagtagccacttgtggtaatggagcaatagaaacaacactagttcaagtggaaacgtgagatgagaagtaggaggtggagagaactaaccagaagagggtacccaaataaaccagaaatatgtatgtgttagagaaggggcctattgagcgggtggcagtggcatgtgtggcattacttgctcctgtattctctgctttttacttagttgtggctttggtggtatagtctcaaatctaagttacgtaggtaatattgttatgtatcatgttttggcaatgtagactaaatacttgctcataagagtacaggacaatgaggatagtttggttttgtttactgcatggaaaatgcaggatgtttagtaaatagattcatggcgtagtgagttcactactaaaatcagactctgagaatgggtttgatttaaatggctagtttagaagactgaatttaggccacttgattgagaaaggccattttgggtaattataaaccaccaacattgtgttttgaatgttaaagcttatatttgtcttccagttaccagaatgtaagcttcttgaggagggagagaggagttttcttaatctctgaacctgcacctttcttctgtgcctagcccagtgcctggcaccaaacaggtgctcaatcaatgttgattctatgctaccaacaaaaatgagtccatgatgtttactattcaacaaatgaatacaattttagagtaaatttttactgcttacactacatgtagattttctttttagagatttcgcaatgctgatttatttcaaaataagcttgaagctaagcgacaaagctgaatgatgatttgttttttatttatttttaaatccaaacttacaattttacatgtcattgccagaaaaatcattaaataaattatgatatgcgcatatggaatactttgcaaccattaaatcaaccattaaatactatgcaaccattaaatcaaccattaaatatgttggtatatgcaaatgtgcatataccaacatattatatagttgagtaagaaaagctagtttcaaatgagtatgttaatatcatctgactcttgcaaaaggaaaaccatacatttgaatgtacatatatgcatatgtttatatgtgcatagaaaaagctatgaggggatatacctcaagttgctaaaagtggctccacctggagagggacatggaaaggagttggctaaaaactgaggtttgttatggtatacacccctgcacagtttgattttttaaaaacaatgattataaattacttttattatttataaaaatattatttaaaattttggtactaaaaacagagctccatcaacaggtcaatggataaagaaaatgtggtacatatatacaaccgagtactattcgtcataaaaaaatgagaccctgtcatttttgcaacaaaatggatggaactggaaattattatattaagtgaaataaggcaggcacagaaaggcaaacattgcatgttctcatttaatctgtggaatctaaaaatcaaaacaattgaactaatggatatagaaagtagaaggatggtaaccaaaggctagaaaggatagttggtggggcaggggagggtgaggtgagcatgtttaatgggcacaaaaaaatagaaacaatgaataagacctattatgtgatagcacaataaggtgactatagttaataataatttaattgtacattttaaaataactaaagaggtataataggattgattgtaacacaaagaataaatgcttgagggatgtatacctcattctctataatgtgattagtacacattgcatgcttctatcaaaaattttcatataccccataaatatatacatccattgtgtactcacaaaattaaaaaaaactgtgcattaaagaaaaacaaaaataaaaaccatagttcaagttataaacaaaataaaggtaatttggaggaaaactgtcttcagttatattggatatttgggggacatttttgtatgttagttagcaaagatcacttgaaaaagaagattcttccttctatgattcaagggagcctagcaaaaaataaatgaaatgaaataaaataatacaaagagaaaagattattccataaattctgcttacttatttctggcaaacttgttgacagcacatgtgaccttttggtaaaaagacatttttatatttttagttaagtttcaaatataaattgtttgtgtttttaaaataaattaaatggatgatttcagccagatcattatgaaaacacatgagatattgggttatgcaatgactaacagtgtgtaccttttcttgatatttattcataaactggggaataaaagtacattttggcccatttactccttaaataattttatgtctcccaaggagagttgtaagttgcttgatagtaaatgctatgtattttgtaccttagtgtatatattatgggatttcagcgttagaagagctcttaaatgccgtgttcatagtccaacctgtcttctgatgcttgaaatccccttgcagtaggaaatgcaaagtagagagcagacactcaataatgtagttagtgaattatttagaaagaggcattttgagcccataatgtatgataggtacttctacatttattattttattctttgcagacctgcagaaaactgtaagaaaaaagtttatttcagattcatgtgtttatttgattaatctcttcataggtttcatttttcagctcctgtcagaaaatacagattcttataaggttcaccttttacccataagaataatagtataaaggggataatgtgaaatacaatcacttcacagactgtttcaattaaataagagctcgtagataattcagtccaccacaccccattttacagatgttgaaattgaagcccccaccaaaaggaaaagacttgttcaaagtcacacagcaagtcagtggtgaacctaattaggccccctgccttccattttagtgagattcctgtgctgatagtcatacccatatcaaatcctctttggcagttatagcttgcccacagtaatgtgtcctgaaaaatatgacaattaattaagttggagacagaaccataacctctttataaaaattttctggaaagtttacatgacagtaagtaatatataattagaaaggataattcttatttcatatttatctttttgtttcagaataataaactaagctatctctactcagtccattttaatacaaaaatatttttacccggactgagtttttatgctttttaggaactttgtatctgcctcacttagttaaaatcctagctgcactaatcacttactgtggtgggcagaattctagaatgaccctgaataccttgtccttgtatgattccttcctctttaagtaaggataaaaactgtgaatatgatatcactcccttgattaggctttgttatatggcacagttaactttaagaaaggaccaatcacacaagccatttgaaagcagagggtttgggtattttttaactggtggcagaaagccacgcagagatttgaacattgaggggaatttgaatttgatgtgccagtactaacttgaagatagaggaggctgcatggaaagtggcctttaggagtgatccctggctgacagccagtaagaaaatgagggcctcagacctacagccataaagaattctgtcagtgaacttgaacttggaagtggattcttcctctagaacttccatataagagtccagcctgattgacaccttgattttggacttgtgagaccctgagcagagaatccagttgacttctgacctaaaaaaaaagtcagataataaatgagtattgttttaaactgctaattttgtgataatttgttatgcagcaataaaaaactaatatatttaccatgcaaggcaaggcatttatcctctcatgattcagtttctttttacctgacataatggaattaatttatactgctgtgaagttgtagttgagaaacatgacttctaaagtaatagaggacatgtattattaattttagtagtattaatagtaatgatactgattctcccaggcctatacaaatcctttgatacacaaatgaatagtaaaggaacataaattgtctctaggtagactttcccacaatgcaattttaggatacagaggtcatatgcctgttattctactgtggcagagaaaatatggagcctggaaaactgttcatttgcatcacatacatcttgggagctcactctgaacctggtaccataataagctctgtagacagtataaagaggaaaggaatcagacatggtgtctgacctcaagtgtctcataacgtagtagaagaggtaaaatatgggtcacactaactctactgcaaagtaggaagtgcttgtcgccttgagattgacaaaatttggtaagagttcagaggagattgtctgtgaactgggccttgaagaatagttaggatttgaataggagaaggtgaagaaggaaggcattccagctagggagaagagcacaaacaaaagcatagataaccttgaacatcatcatatgggataattcaatagttcagtataatggaagtataagatgcataaaaataagtgtagtaggaaacaagtttaaaagtatagattggggttagtcatacaaggccttgaatttcaggctaaggagtttagacattaacatttgtttttgaacaaaggggtgaactgatcacatctgtgatttagaaagaaaattctagcaatagtgtagataagggttgatggtaaagtttggaaggtggtgaggcagaggctggagacagggagcacatttaggatagaaagatgataaagagatgatttagaagagttgttttggaaaaggagaagacagaaaatgttttagaggtgtcatagagataaaattggcatggcatggtgcaaggaggtaaagcccaatagctttgtaaggtgctgagatagattgaaatcacagagttaggaagttttagagtcaggattagtaccaagacagcttggctctagatctcatacttaacacttacagtataattctgagagggtgggtaacagcaatagtcagaggaaagaacccttttatacatgatggtacaggaacaacactggcttccaaccccacagctgctctttaacagaaggtcagaagctggggagaaatatgtgtgtgtgtgtgtgtgtgtgtgtgtgtgtgtgtgtgtgtgtgtgtatgtgccatttctgggactaaggatgggaagtagattagttgaggccactgcagtggggtctgcaagttgctagcactcacccgttccaagaggccttaaaggtgttgatctgttccctgggcatcaccacattccacaaattaatgttcctctgagagaatagggtgattcaatttcactgtgcccgaaggttacttttggggttcatgtttgttctaagtctatgctaatgatctgccaactgtctgtttgtcactttctctaacccttagcatgtataaactgatctgttgggaaatgtgtagcatttataggatggtaggatttgtaacatgcgatcacaggactgtttatatagagtccctgggaaggggagagaagagtatttctgttacaaatgtggattctttggcccctcctcaaacttactgaggttcaagaattgacatttataataagcacatatccattttcaataaacatgaaagtttcataccctcttttaatgtttgaaatcctcaaataaattagtcattggtgccagagtatcaaataattatggtacagaatgtatttctctgaatgacaccttctcccagagattctgatatatattcctctgcactcaccctgtttgataattaccagtatatggaccatttacctgaagaataagagtagggtttcctactgttgttgaaaatttgcttgactcttaacaacttgtgtgtgactgtaacaagatcacacagggtaaacaatattagcttattcaaccactggctgaagaaatttaggaaagtgaacacatttttctttacatttctctttgttctgtgagccttttatgctggaatagttttcactgcaggctgttattgtctgcctccagaggagggagttgacctagcagtggtaactggagagtgttttttgaaacctctttccaaggttagttgccaatggcatctttggaacagtgtccttcacttttgtccctcagggaccagtgtgagaatgggaactttatgatctggagctggttaagtgaagtccaaaaataattaagaaagtgtttccttccctgggaatgagttcagtaggaatctcaatgtattgtagagcactaaggactcagcctcaggcatttgcaaaggattcttccagttgcctgtgttacagaggacacagttggcatttccttttggtgttgaggggagatgtgtacatggttgtgagatgactcaccctttttgcttagatagttccactttcattgtggacagactctttggagggccagtttggcatgcacgtgtgtgttcattccatcctggagcattctttatgagaaagccatttgttgagtggtttgccattttgttttacagccactctgtgggctatgaaatggtcatccggccgctttatttgtccctaaaaaaagcagtttttccctttcttatcttcatggctgccaagcagcagaaagagtaactcagggaagccatgtgatagccttttatctgtctgttcagaaactgatgatgtattggatttgataattcatcaaatctgaggtttactggtttgtatttgcctcaaaatgggcatataatattttgtcaggtaacataatagacagatcattggcattgctttattgaagtgaattaattcaataagcctgtaagtgcctgacatgtgccaggcactgtgctaggcattctgttaacagatgagacaaatctctgtcttttaggtgttttcagtcgaacaggggagacaaatatatgagcaaattgctattttttttaaatttcatagtgtacatgagtataaggtgctgaatatgtgattgattctgagggaaaagagagataagggaaagttctcagagaaagtcaagctgagggaagaaaagcaccccagacagagggactagcatagagctatgctagtacattgagtttaagggaatggcacatacttcactgttgcttcagcagacagcaggcctgttaggttacaaagggccttggatgacatgctgaggggttttaaaattttatttaaattttaattgacaaaatataattgtatatttctgtgaggtacaatgtgacgttatgatatatgtatgcaatgtagaatgattaaatcaagctaatttgtatatctaccacctcacatacttattttttggttagaacatttaaaatttattctcttaacaactttgaaatagacaacacattattatcaactgtagtcaccatgttgtgcagatctcaaaaacttctaacaaaaactttttaccctttgaagatattgaactgttttatgaacacaatcttagaaggatttaaaaaataatttgctattcaccaagtacttcttacgtacactgtgcatgaaatgattattactttttctaatattagttttcttgattgaggcttggcaattattagtttgtatgcctttagaaggatcataagcagaggtttatcccagtaggatttgcattttagaatgatgactttgggagtaaaatacagagaagtgaaaccagagatagtgggatcattctggagtctgttgcctacactgaacagtagttgagcgaaaaaggatgggcagaatgtgttggttctgggtattgcaaattcatggcacttgagtgaaaaagtttaagccttctattggctctttgtgaatatcttcaacatgcatgactacaaatagaacacatggttttgttgttattgttgttgtgtttttgtttttttttttatttgagatggagttttgctcttcttgcccagactggagtgcaatggcacgaatttggctcaccacaacctccgcctcccaggttcaagcgattctcctgcctcagcctcctgagtagctgggattagaatcatgcgccaccacacccggctaattttgtatttttagtagaaacagggtttctccatgttggtcaggctgtcttgaactcccgacctcagatgatcctcccacctcggcctcccaaagtactgagattacgggcatgagccaccgcgcccggcccacacggtatttttgaaagaacagtgagcttggattagaacactagtgtccaggccctgctgctactacataagtaattatgaatccatagccatcttgttgctcttcttctctgagccttggtttctttagctataaaatgggaagttgaaactttctagctacttctttgagttatgagtaacaagttaggtaatacacttaaaagagaatgtgctatacaaatactggttcttaagacagctgttgttaatgtactgagtattatgcttacctcacagggttattgtgagcatcaaatgggataatggatttgtaagcattttgtttaaagtgtgattcaaatgttaagaattagtaaaaatagtaaaagaacaattcattctccatccagatgttctgtccccactgtgacttatgtgctcattcagagttgtacagaaaaacctccacttaattttcacaagctggagttccacatgtaacagaatcatatgggaccaaaaaattctctgtattggcttcttccctgccgtattttggctctgggaccaacaagacacccattttgcatgagctgcctgccaccaactttgcgctcacatctagttctgttgcccatgtgcaagctgaatttgggcccgggcccccagatctaacatgaaactcaagtttccttctgttcaaactgtccaggcataatagtcttaaagtccgatgcccagcagagccgtagatttttcactggccaaaaatcaacatgaaaccagatgtatctgtaaatctagtttcataacactttgtagtcaatggaaatacagtagcaggcagaccagaccagagtttactatttgcagtggaattaataaccacatggaaactttgcctttggtatctgcgagatggaagataaaggtgcgaattcaaagcagttcccaccttaccctctaaattccaacataaagaggccttgaatgtccttctatcttattgtatatttcattaacagaagtatgttcctagctacttagtcattctatctctattctcctttgttttaacttcagtggtgccagcttaagatgctctggctttcagctttcatggagcacgtcatgtttttaaacttatctttagggacagaaatgttaggaagatcctagttcctcatctctttgctcctgacaaggaaatttagaattgcctaaagaaaggatgtattggccaacctaataataaatcagtattagtgaatctaaagcatatttgaaaaatttgtaacatgagttgaaattcagacctgcaatgaagtgtttttaaaagatttaaaatcgaaataatataaaagaatgttaaaaacaagtaaaacatatcactagttaatcactctaccaaaattcatttttatgtttgcatatttaaccatttttattttctatatttgtccatgaacatgtgtttttatatattgtttatattaaacatggttttaatcatggcttatttcttttatgttttacttcttttcctttgacataaaatattgtattttttaaattttaattgcttcttggcatacccttccaatattggtggctatatagattgaagttaaaactaattacaatcagagaaaattaacaattcatcccttcaatctcattagtcacaagttaaatactcaatagccacatctatctagttgctactgttttgaatagtacagatataagacattttcatcaacacagaaaattcacttggaaagcattgccctggagtaaatgtgccagactgtactatatcatttttctcttgttggacatctaagttatttcttattttttaaatattttatataacttgacggtgaatatacctatgtacatagctatttgctttggctgaattatttcttagaatcaatttcaaaagtggagttattaggtcaaagagcatgagaagattttttggaacctgcagtgtattgccatagtcctctcaaaaaagtttatgtcaacttaaagtacttctagcagcatatgattgtactaatttcgctgcaatctcaacaacactggacattataagtttttattctaccctattttccattaaaagatagcttatgcttgattgactttgcattttattttattattaataatgatgtggtttccttttttctagattttatttttatttaaggcatcctttgattttaacctgattttttttctctaaaaattattctaagaaaagacaaaggtgatacgaaatatatcctgagtttttatttttttcttgcatgggatttgtatatttgcacctttgcccatttatactatgatttcttagtgtcttccctggcaattttaatgaagacttcatgtatatcaatttttccacaaatataatctttctaaaaatatgttttttccacaatataattcagacgtattctccgaaatgttggaaaaacttaagtaggcatcaaagcatttgaagatttgtttaaaggttgtttttataccagttttaaattgtaatttaagggtcataaaataggtgaaaattaaatcatttttcagtaagggggcaagaccacttaactcttggaaaatacaggaaacgtagatttctagaggccaagaaggaggtagggattattttgtaactgcccccaaccttctaacctgtaatgaaacaaacactgaaggcccttaaacatttttaggcttaattggctgtccttgtacttagggcacatctaaaaatcctgaggcaaccactcaagagaacatgcttttgttaattcaaagggagctgtcctacgagtgtccagaatcctctgtagtcttgggcctggtgcttgagagacccaaaggaaaggtcaatggaattacagcttagtgttagagctttcatgcatcacactaattaattaatgtcataaaggtctctctcctgttatgggaaaaagcagcaaataggaacttctggtagggtgcttaaagttggtttgatattttttattagcatttttaactaatacaagtaatacatgcttatggtagaatgataaaactgaaaaaaaaggtatgaaaatttagaagttctcctactcatgacctcaccccttctttcactcccagtttcactcctcagagggtaaccacagtgactagcttcttgtgtttggttcctgagattttctatgtatatatattgttagatatatgcatggtatgttttcaaaattcctgttacactataattactgttctacaacttaattttttcacttaattaatagaccttatatatgcttttccatatcggtatatatagatctatataagttttcttaaaggttgcacaactttcaattgtatggctgtcttgtaatttactttttgtttcccttactaatggatatttcatgtttccctaactcttttgatattaagagtagtgctgcaattaacatccttgagaggcagtatatatggtgtttaagatgaatggttctggagccagactactttggattgaatattggtgccaccaattccttgctgtatgaccttaggcaagttgcttaatttctttgcctcagtgtccttgtgtgaaaaaatggaggcaataatggtcactatccagtagggcttttatgaggatttagtaagttaataatgcactttaagaacttagttatttttagattaagtagtgaaggactatataattgttagtataattgtatacctttattatcatacttttgcatgtatagcaataagacaaattcttagatgtttaaccattggacataaggaatgtacgcattttaagtactggtagatattaccttttccctgccaaaaattgcaaatattggatattaactttttaaatcttagtaaatctgataagtataaataacagtttatcatcattttaagttgcctatcttaattttgtgtgaaaatgattatcttttcacatgtttttttggccatttatgtttctttccatgtgaactaactgttcctggccattgcctatttgttgttgctgttactatatggcttttcatctgtttcttattggtttatggagctctttgtatatacaggaatttagcctctatttatatgtgtgacaaatactttttccaatttatctttaaaatttgtttatgttttcctattcatcagtctaaaattatgtagttaaattcatcattgttttttcttatgactttagagtttggagatcatgcttcaaaggtctttctaggtggggatgatttaaatcatgtactggaagtatttttgccaaaaagactcacgaattatggatgttagagctaaaagggaccttagagatttcctagttcaaccaccttttcttcatacctttttaatttttctctgcagatgaaaagaagtttagtcctaaagaaagaaaagagtctaaaggttctccagtaagctaatggcaaaaatgtagactggaacttctagctcctgatgtgtatttcagtgatcattcaatttaaccagatggtttcacaaaaagagctttctactaaaaaataaaatacatacttaagcaactcagagaattttttttttatttttcagattaattttcacttagagattcatcagcatatgtactatacatgtacaaatcacctgtgtgttttggatatttagttaaacaaatgtgcaaatattttaaccaaaggagcatattcatttgtgttttattttcttaatggttttcgttatgaatgtgaaatgtgtatttaccttaacagaaattaagtatatttttggtctgacatatatgagaactgaaaagcattggcttggctgctaactgcattctcatctttctttctctgctttggcaaagtctgggattaaatctaataccttttaaactgtttgggacttcagccagagtgacctgtcttgaattcagaactgcgcagatcattccccattctaaggccctctcatgcctcctcattgcctgtaggatgagatccaagtaccttagcatagcttatgcactgtagtcacttgacctctagcacctatgcagtcttccagtcttatttacacattcctttgcacatgctgtttccccgtgtggggcaacttttttcttgcctgtctgcctgcctaagccaacttaaataaacatcatttctgtaacttctgtgaagccttttccaatctctccactccaagacgaaggtgtttctataggcatgacttctggaatggcagatcaaggatctggtggaccctctactcagtgaaacaaccgtttaactagtaaaaatgatcaatcaaccatttaaaatcttcagaaaatatcctaagggcacatagcaaaaagagaaacatttattcaagaaaagctattaagcctcagtaaaaacagcaagagtctatggcatttgagtcatgacctgttcctaatccttcccttatctccattcttcaggcaagtgcaaccaagaagatggaggcttcctctctctcaaaatcttactccatagttataatttcacccacaatggggcagaccacaagcatctcttttttttcccccagccctatattacagaatcactgttctaggaaggcatagcttagaggattggagattccttccacacccactttctacgtatgagggctttgccccagggatggtaagtcaagaatacagggatcctgcttgtgcctgcctcagctcatatataaggtaaagcttccacactaggaaaggcaaattaagaggactagggaatataccgttatccccagggtccacttgtagaacaggggtgtcattctgggagaagcaggtcactgccccacttgtggaacaggggagtcactcgtcactgtccctggttcaaattctattgcagtgacagaggttctgtcccagggaaaggcaggttgttaggatggagaactccacagttctccctgaggtgactgactttatttggaacagagcatgaagaagttcatgcctaagggcactgtcaaaaataatggagatcttggtggtgagcaattaagagtggattggtagctccatgatactagtaacaacaagcaaaacagcagaccagcatggaggataccagagaaccagacaaaggaatcactaagaagagcccttgtggaattgcactcactgctgggtgtgtggaaagttatgcatgtgtgctttactgtaccctctcaaaagcaacctaaacaggatgtggggtaggctctaaagcattcctcaagccacacatggatccatcagtaaaatgtggagggcttaaggataaaaaggcttaagtacaatctctggccctacattttctaaatgttatgccaccctgaccaaggggcaactcctacaaagccaggcaaaataataaaatcatatttgtctctagtggaatggataactatgcctaaaactgtgccctttgaaaagcaactagagagataatttctgaagtgtttgtccctacctgaatgtgtggcaaaattctaaactccctgaagtgtgaaagtggtttccaagccacatgcacatccagtagtggtaaagggtgaaaatctaactggctaagagggcttcatagcaacattaaccaaaaagtggtttatgtagtctttgcctgcttcataattccctaggcattctatgctattctgtactcagaaggcttaaagtcaggttagggaaaggaggcctatgaggttactgtgcagaggcagtgctgggaaataaatgaagttaaataaatttaggccatcgtggtttaaagaatggattgtggagataagaaggataaaggaaacccagagtcaagaaaaataaaacttttcattggtgccatgccaacccatatccgagcctgaggcaaaaggaaaaatgtgctccctgatatacacttatacaaaatatcaactaattttatttgttggactgaatagaaaaagtcaacaaaaattaaaaataaaaaaatcatgactatatttttaataagtggtttatgtaaacccagagttgaccaatgggatgccagtctcaaccataaaaacaaacaaaacattgtgagtaacaacaccagaagtctcaaagtgtcagggaaaccaatttcacagaagcagttcagccaagtcactaaacaaacaaacgactaagcaaaaaacaagaatgagtctcagaaagggtcaagtcagtatccagagttgttacaatatagtatctaaaatattgttttgaactaaaaattttgaggcatgcaaagaatgaggaaagtatgactcatacatggtattatatgaaaaaatcaacaaaaaactatccatgaggaaacaaagatgttgaaattcactagggaaagactttaaaaaccagctatttaaatatattcaaagaactgaaggaactatgtctaaaatactaaaataaagtataataacaatttcttgtcaagtagagaatgccaataaagagatagaagttataaaaaaagaaaaaaatggaaaatctggagttgaaaattataataactgaaatgaaaaattcactagaaaaggtcacaagaagatataacttggcagaagaaacaatcagcaaattagaacatagatcaatatagattattcattttgaagggtagaaagaaaaaaagaatgaagaaaactgaagattcccaaagaaatgtaggacatcttaaagacacatcattaggagaagaaaagaagggaaagaaaagagcagaaagaatattttttaaaaaatggataaaatcttccaaaatttaatgaaaaacatcaacctacacatcaaagaaaatttttttaaaacttcaagcaggaaaatgtaacgatattgatacttagatacatcatagtcaaaatattggagtcaaatataaagagaaaattttgaaattagcaagagaaaaatgaaatggaaccacaataagattaacagctgattctcatcagaaataacagagagcagaaggcagtgcaatcccatattctaaacgttgaaagaataaaaaaactgtcagtcaagaatcatatattcaacaaaactatctttaaaggtaaaaatgaaatgaagacattcctaggtaaacaaaggctgagagaatttttcattagctgacatgccttgcaagaaatactaaaagcttcctagacagtagctttaatctgcatgaaaaaaaattccaataaagggaaatttgtaaataataaaaatacatcattatatattcttttccacttaacttatttaaaatcaatttcttaaagcactatctgtaaaattgtattgttatttgacaataaaatgtaaaagaggggagtgggaattaagctaaattggagtaaggaaatggtatcacatggtaaattgaatttacagaaagaaatgaaaaaattaagtggcaaatatgaagagtaacattaaaaacttctataaattaattgtggcctcctttcttcccttagcttctgtaaaagacataagactattaaaaatgacaataattataaacacattgttttattagtaataaacatagacaaattatctacaacaattattattatacaaggagagggaatggagctgtagaggagtaaagtttttataacctactggaactaagtcagtataaatatgatgtcgattctgttaatttgagatatatgttagaagccccaaagtaatcactgagaaaatgatgcaaaaatacagttttaaaaagttaaaaacatagtttagcttatgtgtgcctagtactccattattatttttttattatattttaagttctggggtacatgtgcagaatgtgcaggtttgttacataggcatacatgtgccatggtggtttgctgcacccatcaatccgtcatatacattaggtatttctcctaatactatccctccccctgtcccctaaccccctcaacaggccctggtgtgtgatgttcccctccctgtgtccatgtgttctcattgttcaactcccacttatgagtgagaacatgcggtgtttcgttttctgttcttgtgttagtttgctgagaatgatggtttccagcttcatccatgtccttgcagaggacatgaactcatcctttttatggctgcatagtagtccatcgtgtatatgtgccacattttctttctgcttgttcccaggagaaagtggctgaagattccagagagaagctgaatgcagtttaattctttttgccataaacacgacaacccattttcctgcaagctgtgttagtttgctctcttcttggttcattcattcatttattcatagcttccataaatatttaacaaacactaattaggggccaagccatgtgctaggcacaggggataaaactgtgaacaaaacaagccccagctactcttaaggaactgatagacaaatggaccagcaaacacgctggtcctgttttgaaggcaaagcgcctggtgctcctgatctcatgagcacagagcatttagcctaagtctcatcctcctaaggcctcagaaataaggccttattttaataagtgcaagtcagtcatttgaagactaaatcatagaatcctagaaaactagtaccgggagcaaggcaaaagaatgggatgagcatgaaacatatattcagaagttgtggtgtgtaggtatataagccaagctcttttcttcacttgcttgctaagtcacttagcttttctgcctttttgtttgctctgtctggaaatggagttaatgaaatatatctacatgatagggatattgagacgattaaataagatgctgctgtcacccagtatgcccttaccctgctgtacttagaagtatatgaaattcattttctaaatttttgtatgagtgtttcatgcatgcccaccaccatggaagctaccttaagacagtgagggactttgtttaacttgtttgtactacatcctcagtctaatggtgtctggcttatggtaggcaccaaatataattttattgacagaaaggatgataatgaatgtgaaggcatttttaagtttatgaagtgttgtgcatattgttgttaattttaagctgttacgttaaagaacccctaatccaactctcttgagttttatagatatcatagaagatatatcttcccttgacatagaagcttcccttgaaggttcccttgactcatgtatttgcctcacagtgattgtgcagatcccacaagataaatttatgtgaatgtgctttatgtgcttgaagtgctccacaaatatgggttttataagatgagaaaatagagtcagggagaaaggtgactgatccaaggtcatgcaaagagttagtgtcagaatttataatggaatttcaggctcccaactcccactccagtatactaaggcagattccagagaagaaacagtggagagcaggcactgatgagggacaaagaaaagcaggctccgtctggctgcaacttgtctcttcatggcaaaaagaaactaggaaagtgctatgccagagacgacatgataactttgcagaatggaaagagcttgtttaccacattgaatactttatctgtgtttatctaacgacagttccaccagctctttaccacttgacttttgcctaattcaaaaatataccaactatgaaacattttccttctcagtttttattctagattacattttgttcaactttatcttaatgtgtagtgtagaaagagtaaggtaagagtatagcaagtggttattttccatttctactgaggacagagaaataatctaagggatttgtattagagatgaagaagtgcatggccaggacatgagagatactgtgatagaatggatattgtgaagtctttggtagtttttgaggggaaaaaagagaaggttttctttgtctgatatagtttagcaacgtcttaatttaggattcaaaagttgttcagggtccatcttggccttcaaattaagatgccctttgagagataacattgttgttttcaaactctgttctgtgacttaagaatgagaggagaaggaagaaaagaggagaaaatttgagggaaaagtgcccaagcagcgtcaaggctagacactggaaatttatcaatgaaagccacatggtggatgggaatcagatatgtgcatcaattatttgtgttccaatccatatagaagtaccgtataatgcaccaagctaataggtgctttgaaagaagaccatacaagtggagatgtgttcctattctatctagggatagagtcaggaagggcttcattgaataagtggtagcctcttgggctgagacctgagttatgagatgatgtggcaaaggagacagatggctgggggcaaggtggggtcattgaaattggaggcagtagcaatataagcaaagctacaggggcatgaaaaagcaaggttagattagtgaattgcaacagggtggtactgctggaaggtcacatggaaaagattgtgaaggtattgagataagaagctagaaataagctttgaatgccatcctagtactttgaatttgcatgctgtaagccaagtggttttcacttggtcatttaataaaattacagattctcaggtctcacctgtaacttcagattcagaagagtctgctaactgaaggtggaatcagtgttccatattgctaattagctcctcagaggattctaatatatcagtgagttatgaccactgctgtaagccataggtagttattgaaagctgctatggagaggagccacagaagcagatgttttagataggattcctctggggtcctgtgtaatttatggactggagaggatcagacaggaagcagaaagacttgaataagacagttgcagttattttggaggcaaagattctctctctctctctctgtgtgtgtgtgtgtgtgtgtaattgtaggaactatttaggcagtaaaattaacagatattagtcactgattgactgagtggatggcagtgataggtggggtgcgttgagggaagtgtattacattaagtccaggatgactcatggttttctaagttgagtcattggggattgccatccaatgtgagaaactatatagtcttatcatagttgatcttggaggtagacttgaattaaaatcttgaagccatcaattgctgtatgtgggtcttgggcagaacacttaaggtttctggacctcagttatttcttctgtaaaatgaggaaaataatgcatacctcatgcatttgttgtaaagactaaatgaggttaaagtatgtagagtgtagtttagtaactgggacgtatagtggtccagtaaacatcagctgttattattgtgctatatgttgtgatgtgtactggagtgagatggggtaggggattttttagtctctgccaatgactcctctccccatgatcaaaatcagaaaatcagtctcttatgtgttgaggagtgagacacttctcccaagtgtttaaggctaataccttgccttgttttgccttgggccagacctcactacacatctgtttaagagatcagggtaagctctgttcttggtgagtatctcaatggggctgtttttctagttcttgtagtttctttgggccaacatgaaatgtctaaccttggcttcttggttgtggattctcgtcaacatttcactgctacccaagttgtgtctgcttacatgatgctatcttccttcttttgggtttctgaagccctcagacacttggctgaacatttttcacatttcttaagctatatcatctgtgttttccctgccacagacaaagtcacaaaaggactttaagataggttttggttttttttttccccagggtttttatacattttgggtaagggcaagtggtaaatgctgcttttctgccttaaccagtagtgtctgacagaggaggtagcatgatgattgcagagctcactggactgaaagtcagatgctttacccgcctagactctagtaccaaggggaagatggagtgagatggggtaaatggggagaaattaccatttattttgagtgtgccaggccttttctcatgtattgtctaatgcatttgtcacaattctctttgggtttgaaatgtgattttcttcattttatagataaggaaacttatgggaagggaggttaggttcatcttgtgcccaactttacatggctagtgatcaataatagtgagattcaaactcagatttctctgccccaaagcctttgctttttcctcttttgacactgtaactaatgagaagatgtatttaactctgagtctcatttgcctcaactgtaaaatggagctctgtaactcttgctctgtatgacagtaaatctcctcagaccagacttatgataggggataaggatatttgtatctttgggcccctaatgtattgaaagtgcttctaagtgcctggcacatagaagggcactcaataaatatttaccacattttccagaaagagggtagctccataatgggtgagatacattttggtggctactgtagtgtttaatgcttttaccatctgttaaaatgattttggagtatagctagataactgatgatggttgttatatagattttttcataggttgcctgttccaaattctatgccgtggaagaagttaaatatccagaatttgacaggaaatattattctacaacagatccctggcgtaagaatgataacacctgtgttctagtctcagacttgcctctgaataactgtttctcctggtcaattctctgtctctatctaggcttgaaatttcccccaaatgatgaaggagttggactagtttagtggggttcagcctcgagtggccattaaaattatttggggatctttgaaaaaaattagatgcccagatttttgtcgttgttgttgttgtttttgtttgtttgttttttaattatactttaagttctgggatacatgtgcagaacatgcaggtttgttacataggtatacacgtgccatggtggtttgctgcacccatcaacccgtcatctacattaggtatttctcctaatgctatccctccctagtcccctaaccccagacaggccctggtgtgtgatgttcccctccctgtgtctatgtgctctcattgttcagctcccccttatgagtgagaacgtgcagtgtttggttttctgttcctgtgttagtttgctgagaatgatggtttccagtttcatccatgttctttcaaaggacatgaacccatccttttttatggtggcctgatattccatggtgtattgaactgctcactccagttcaattaaatcagaatacagaatgttgagaggagcatcagtattttaagaaggccccctagtgaagttcaatgtgcagccaagggtgagaaacactggactagatgattgataagggccatccaactttgatagtcaacaagagacaatgctatagagtatggtggacagagcatgggctttagagttagccaggtatgcattcagaccctggctctgttacttactagttgtgtgatcttgaagaaatcaaaatggagatacactatgtacctggcagtaatagttgtggggattaagcaccttcaccagagcttaggacataataagcccccagtaaatagcttctttaatatcagaagttcagatggaagatgtgagaaaaatattggttcagtaagatttaacaggtaaattaaaatcaagtatttgaaaacattttcctgtttctttagcaatggattccagaaacataatgtggaaatagctctcagtccttagatttgatgacattgcagaaagaaatctggctagtcgtcccatggctgattggctatgatggctagaaagccattggaaaaaaaaaattggctcacagaagacagcagatgtggcttgggaaatgcaaggacatgactgtaataaggatttgtctatccagccccatttatgagagtgattccaggagaaaaggacagatttgtattgtcagtgggatacgctgttaaaaaacacttttgctactaccactccagctgtcttggcatgtttgttggtgatgtaagctacagaaaatggaaatcaccaatagggctatagcaacctgatgcatagtgacaagtaattgttctattcatggttatgtgttgtacagagcacttgctgcatgtcaggtttgagacttgagtatgcattagggccatggacacccccatcttatctttaagtagatttcaaagtaaatatttgatgaatatgtaaaatatttagtttggtcagtcatagggctgagaacatggtggcagttacctcctagtatctgcaagcaaaaaaagttttttcttcctatagcaattgccatctcagccacttttgcagcatttctttttgctacactttgcattaaccatttgtgcacttgtcttagcctcaaacaggccatgaaagctccttgaggataggggctatgtctttttcatctttatatatgcatcatttagcagagctgtccctttataatgtactaattactgaatgaagggatgcatagatgaataaatgaatgaaaagtaggagtgacctgtcttctctctttcttcacgatggggactagtgtgtgtatataaggggataatttttgtgtcacataaaatataaccttacttagaaggcaagacttccagaatggtggaatgagaaccacccccccgcccccataaatccgccctttcatgaaagcagtgaaaacgctagcaaacgttgtgaaaattaacttttccagaactctggaaaggaaacagaggcttccaacaatctgagaagaatgtattcaagaaaaacttcggtaagctctctgatcacagtggaaataataaacaattagtaatagaaggatagttgggaaattcaccatttgtgggatataaacagtggatcaaagaagaaatcataagggaaatgagaaaatactttgagattaatgaaaatgaaaatacattgttccaaaacttacaggatacagccaagctaaagcagtacttaaagggaaatttgtaactgcgaaggcctatatcaacaaagacaaatgatctcaaatcaagaacctaaccttccaccttagactaggaaaggaacagcaaactacaaagaaagcaggaagaaagactaataaagactaaaagggaaataaatgaaataatagagtagaaaaacactagaatcaatgaaattaaacattgattctttgaagagatcaacaaaactgaaaaaaactttagtcagattgaataagaaaaaaagagagaaaattcaaattatcaaaatgagcaatgaaaatggggccatcactacctaccttaaaaagaattttcaaaggattaaaagaaaatgccattgcattagttcattctcacacaactataaaaaagctacctgagatggggtagtttatgaagaaaagcgctttaattgactcacagttccacagtctgtacagcaggcatggatcatgaggccttaggaaatttacatcaggtgaaaggctaaggggcatggaagacatgtcttcacacggcagcaggagagagagcaaagagggaagtgccacacacttttaaaccatcagctctcatgacaactcactcactatcatgagaacagcaaggggaaaatctgccctcatgatccaattacttcctaccaggtcccttccccaacactggaaattacaattcaacgtgcgatttggatggtgtgacacagagcaaaaccatatcaaccatactgtatgccaaaaaattagatgacctagatgaaatggacaaatactcagaaaaacacaaactatctaaagtgaccagtgaagaaacagaaaatctgagtagtcctgtaacaagtcctgtaacaaaactggattagtaattaagaaacttcccacaaagaaaagcccaggttcagtcttcactggtgaatactatcaaatatttaaggaagatttaatccttcacaaattatttcaaaacttggaagaggctggaaccctttccaactaattctgcaaagtcagcattaccctgatgccaaaaccaaagatatgacacaaaaataaaactgcaggctaatatcacatttgaatatagataactttctaaaaatctcaacaaaatgctagcaaacagaattcagcaacaaataaaaagggttataaagggtgaccaagtaggatttatctctggaatgtaaattaacattcaaaaacctaagaataggaggaaactttcttaactttgtaatggacatctctgaaaaacacacagctaacatcatactaaatagggaaagattgaaatttttccttgtaagatcaggaacaagacaaggatgactgttctcaccatttcaatttaccattgtattgtagattcaagtcaaggcaattaggcaaaaaaaaaaaaaaaaaaaaaaaaaaaaaagaaagaggtaaaaggcacccatattggaaaggaagaggtgaaaatatctatattcacagatgacatgatcttatacaaagaaaaccttaaggaatccatgataaactattaaaacgagtaaacgagttcagcaaggtttcagaatacaagattaatgtgcaaaaatcaattgtatttctgtacactagcaatgagcaatctgaaaatgagattaagaaaacagttcactcacaatataatcaaaataccagaatacttaaaaataaatttaacaaaagaagcgtaagacttgtatgctgcaaaccacaaaacactgtggaaagtaattaaaaatctaaataaatagaaaaacatcccttgttcatgtactagaggactcaatattgtcaagatggaaatactccccaaagattgaaggaaatccctatcaaaatactggctgttttcttagcagaaaatgaaaatctgaccctaaaattaatatttaaatacatggaacctaggataaccaaaataatattgagaaagaaaaacaaagtcggcgtacccatgcttcctgattccaaaccttattacaaagcagtggtaatcaagagtgtatggtattggcataaggacaaacagatcaataaatggaatactattgagaatccaaaagttaactcttacatttaagaccaattgactttcaaaagtgttgctaagacatttcaatgaggaaagaatagtcttttcaataaattgtactggaaaaattggatatccacatgaaaataaaagattttggaccacttcaaacctgcaaaaaaaataaaatgatctcatggtgtatcatggatctaaatgctatagagctaagatgataaatctcagaagaaaatatcaaagtaaatctttatgaccttgaagtaggcaatggttttttggctataacaccaaaagcacaagcaataagagaaaaaaaatttttttaaaaaaacccttgattattttattaaaattttgttgtgggtacaaagtaggtgtgtatatttatggggtatatgagatattttgatacaggcatacaatgttcaatgatcatattaggataaatgaagtatccagtacctcaagcatttatcatttgtgttacaaacaatccaattatactcttttagttatttttaaatgtacagtacattattattgtagtcattcccttgtgctatcaaatactatatgttattcattctatctaactatattattgtacccattaaccatccccactcccctgcctcccagctacacttcgtagcatctggtaaccatgatttcctcttatctccatgagttcagtagtttcagctcatggagatagacagaactaattttattagctcccacaaattagctcccatgtcagaacatgtaaagtttgtctttctgtgccaggtttatttcacataacataacgaactctagttccaaccatgttggtgcaaatgacaggctctctcttttttttttttttttttttttttgagatggagtctggctgtctcccaggctggactgcagtggtgcaatctcagctcactgcaagctccgcctcccaggttcatgccattctcctgcctcagcctcctgagtagctgggactacaggcacccgccaccatgcccgactaattttatatatatatatatatatatatatttattattattatactttaagttttagggtacatgtgcacaatgtgcaggttagttacatatgtatacatgtgccatgcaggtgcgctgcacccactaactcatcatctagcattaggtatatctcccaatgctatccctcccccctcccccaccccacaacattccccagagtgtgatgttccccttcctctgtccatgtgttctcattgttcaattcccacctatgagtgagaacatgcggtgtttggttttttgttcttgcgatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaataatgccgcaatgaacatacgtgtgcatgtgtctttatagcagcatgatttatagtcctttgggtatatacccagtaatgggatggctggttcaaatggtatttctagttctagatccctgaggaatcaccacactgacttccacaagggttgaactagtttacagtcccaccaacagtgtcaaagtgttcctatttctccacatcctctccagcacctgttgtttcctgactttttaatgattgccattctaactggcgtgagatgatatctcattgtggttttgatttgcatttctctgatggccagtgatggtgagcattttttcatgtgttttttgggtgcataaatgtcttctttttagaagtgtctgttcatatccttcgcccactttttgatggggtcgtttgtttttttcttgtaaatttgtttgagttcattgtagattctggatattagccctttgtcagatgagtacgttgcgaaaattttctctcattttgtaggttgcctgttcaatctgatggtagtttcttttgctgtgcagaagctctttagttgaattagatcccatttgtcaattttgacttttggtgttttagacatgcttttggtgttttagacatgaagtccttgcccatgcctatgtcctgaatggtaatgcctaggttttcttctagggtttttatggttttaggtctaacgtttaagtctttaatccatctcgaattgatttttgtataaggtgtaaggaagggatccagtttcagctttctacatatggctagccagtttttccagcaccatttattaaatagggaatccttgccccattgcttatttttgtcaggtttgtcaaagatcagatagttgtagatatgcggcattatttctgagggctctgttctgtttcattgatctatatctctcttttggtaccagtaccatgctgttttgattactgtagccttgtagtatagttagaagtcagggagtgtgatgcctccagctttgttcttttggcttaggattgacttggggatgtgggctcttttttggttccatatgaactttaaagtagttttttccaattctgtgaagaaagtcatcagtagcttgatggggatggcattgaatctataaattaccttgggcagtatggccattttcacgatattgattcttcctacccatgagcatggaatgttcttccatttgtttgtatcctcttttatttccttgagcagtggtttgtagttctccttgaagaggtccttcacatcccttgaaagttggattcctaggtattttattctctttgaagcaattgtgaatgggagttcactcatgatttggctctctgtttgtctgttattggtgtataagaatgctgtgatttttgtacattgattttgtatcctgagactttgctgaagttgcttatcagcttaaggagattttgggctgagacaacggggttttctagatatacaatcatgtcatctgcaaacagggacaatttgacttcctcttttcctaattgaataccctttatttccttcttctgcctaattgccctggccagaacttccaacactatgttgaataggagtggtgagagagggcatccctgtcttgtgccagttttcaaagagaatgcttccagtttttgaccattcagtatgttattggctgtgggtttgtcatagatagctcttattattttaaaatacggcccatcaatacctaatttattgagagtttttagcatgaagcgttattgaattttgtcaaaggccttttctgcatctattgagataatcatgtggtttttgtctttggttctgtttatatgctggattacatttattgatttgcgtatattgaaccagccttgcatcccaaggatgaagcccacttgatcatggtggataagctttttgatgtgctgctggattccgtttgccagtattttattgaggatttttgcatcaatgttcatcaagcatattggtctaaaattctcttttttggttgtgtctctgcccgtctttggtatcaggatgatgctggcctcataaaatgagttagggaggattccctctttttctattgattggaatagtttcagaaggaatggtaccagttcctccttgtacctctgatagaattcggctgtgaatccatctggtcctggactctttttggttggtaagctattgattattgccacaatttcagatcctgttattggtctattcagagattcaacttcttcctggtttagtcttgggagggtgtatgtgtcaaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcagtctatcaattttgttgatcctttcaaaaaaccacctcctggattcattaattttttgaagggttttttgtgtctctatttcctttagttctgctctgattttagttatttcttgccttctgctagcttttgaatgtgtttgctcttgcttttctagttcttttaattgtgatgttagggtgtcaattttggatctttcctgctttctcttgcgggcatttagtgctataaatttccctctacacactgctttgaatgtgtcccagagattctggtatgttgtgtctttgttctctttggtttcaaagaacatctttatttctgccttcatttcgttatgtacccagtagtcattcaggagcaggttgttcagtttccatgtagttgagcggttttgagtgagattcttaatactgagttctagtttgattgcacggtggtctgagagatagtttgttataatttctgttcttttacatttgctgaggagagctttacttccaactatgtggtcaattttggaataggtgtggtgtggtgctgaaaaaaatgtatattctgttgatttggggtagagagttctgtagatgtctattaggtctgcttggtgcagagctgagttcaattcctgggtatccttgttaactttctgtctcgttgatctgtctaatgttgacagtggggtgttaaagtctcccattattaatgtgtgagagtctaagtctctttgtaggtcactaaggacttgctttatgaatctgggtgctcctgtattgggtgcatatatatttaggatacttagctcttcttgttgaattgatccctttaccattatgtaatggccttctttgtctcttttgatctttgttggtttaaagtctgttttatcagagactagaattgtaacccctgccttttttttgttttccatttgcttggtagatcttcctccatccttttattttgagcctatgtgtgtctctgcatatgagatgggtttcctgaatacagcacactgatgggtcttgactctttatccaatttgccagtctgtgtcttttaattggagcatttagtccatttacatttaaagttaatattgttatgtgtgaattttatcctgtcattatgattttagctggttattttgctcgttagttgatgcagtttcttcctagtctcgatggtctttacattttggcatgattttgcagcggctggtaccggtcgttcctttccatgtttagtgcttccttcaggacctcttttagggcaggcctggtggtgacaaaatctctcggcatttgcttgtctgtaaaggattttatttctccttcacttatgaagcttagtttggctggatatgaaattctgggttgaaaattcttttctttatgaatgttgaatattggcccctactctcttctggcttgtaaagtttctgccgagagatctgctgttagtctgatgggcttccctttgagggtaacctgacctttctctctggctgcccttaacattttttccttcatttcaacttttttgaatctgacaattatgtgtcttggagttgctcttctcaaggagtatctttgtggcattctctgtatttcctgaatctgaatgttggcctgccttgctagactggggaggttctcctggataatatcctgcagagtgttttccaacttggttccattctccccgtcactttcaggtacaccaatcagacatagatttggtcttttcccatagtcccatatttcttggaggctttgctcgtttctttttattcttttttctctaaagttcccttctcacttcatttcattcatttcatcttccatcgctgataccctttcttccagttgatcgcattggctcctgaggtttctgcattcttcacgtagttctcgagccttagttttcagctccatcagctcctttaagcacttctctgtattggttattctagttatacattcttctaaatttttttcaaagttttcaacttctttgcctttggtttgaatgtcctcccatagcttggagtaatttgattgtctgaagccttcttctctcatctcatcaaagtcattctctgtccagctttgttccgttgctggtgaggaactgcgttcctttggaggaggagaggcgctctgctttttagtgtttccagtttttctgctctgtttttccccatctttgtggttttatctacttttggtgtttgatgatggtgatgtacagatgggtttttggtgtggatgtcctttctgttttttagttttccttctaagagacaggaccctcagctgcaggtctgttggagtacccggccgtgtgaggtgtcagtctgcccctgctggggggtgcctcccagttaggctgctcaggggtcaggggtcagggacccacttgaggaggcagtctgcccattctcagatctccagctgcgtgctgggagaaccactgctctcttcaaagctgtccaacagggacatttaagtctgcagaggttactgctgtctttttgtttgtctatgccctgcccccagaggtgaagcctatagaggcaggcaggcctccttgagctgtggtgggctccacccagttcgagcttcccagctgctttgtttacctaagcaagcctgggcaatggcaggtgcccctcccccagcctcgctgccaccttgcagtttgatctcagactgctgtgctagcaataagcaagactccatgggcgtaggaccctctgagccatgtgcgggatataatctcctggtgcgccgttttttaagcccgtcagaaaaacgcagtatttgggtgggagtgacccaattttccaggtgccgtctgtcacccctttctttgactaggaatgggaactccctgaccccttgcgcttcccgagtgaggcaatgcctcgccctgcttcggctcacacacggtgcgctgcacccactgacctgcgcccactgtctggcactccctagtgagatgagcccgctacctcagatggaaatgcagaaatcacccgtcttctgcttcgctcatgctgggagctgtagacctgagctgttcctattcggccatcttggctccagaaaaaaaaattgttaaattggacttcatcaaatttgaaatttttgtgctgcaaatgataccatcaagaaagtgaaaatctcacccacagaatgagagaaagtatttgcaaatcatatatctgataagggtattgaatttagaatatataaagaactcttgcaactcaatataaaaagacaacccaattttaaaatgggcaaagtatttgaatagaaatttcttgatagaagatatacaaatttaaaaatgctcaacatcattagtcattagggaaatgcagatcaaaaccaaattgagataccggtttacacctattaagatggctatagaataaaagaacaaataacaagtattggctttaatgtggaggagccagaacccttatatattgctggtaaaatgtaaagtcatgcagccctttgaaatacagtctgcaagtctttaaaaaattactatttgttatttggtttttcttcacttttaatttaggttcagaggtacatatgcaggtttgctatatagctaaattgtgtgtcacaggagtttagtgtacacattatttcatcacccaggtaataagcatggtacccaataggtagtttttctatcctcaccctcctcctaccctccaccatcaagtaggccctggtgcctcttgttcttttctttgtgttcatatgtactcaatatttagcttccacttatcagtgagaacatgtggtatttggttttctgttcctgctttagtttgcttaggatactggcctccagattcatccacgttgctgcaaaggacatgatctcattctttttgcatagtatactatggtgtacatgtatcaaaaatgttactgtttgacctagtaattctattccaaggtaaatactcaagagaaatgaaaacatgtccacacaaatacttgtacacaaatgttcattgcagcattatttataatagccaaagagtggacgacaaatgtcttccaaatgtgggctccaaatgtccaccaactgataaatggaaaaacaaaatgtggtatatccatgccatggtttatctgtcaataataagaaatgaagtactcatacatgctccaacatggatgaaccttgaaaacattatgctaggtgaaaaaagcaactcacaaaagactacactgtatgattttatttgtattaaatgtccataaaagaaaaatatttagagatagaaaggaaattagtttttccagggtctgggaggagacagtatgaggagtggctgctaatgggtacaggatttctttttggagtgatataattgctctaaaattagtttgcagtaatagatgtgagtatgctaaaatgggtgaattttatagtatgtgaaatataactcagtaagcccattaaaaacaacctaattaaattaaaaccaagctataacagaaatattatatggctttggcagtttagaatagtgggaaaatatggagtaagggtggggaaatagtcccaagtataattctggttttgtcactactagtgtatggacttggacaagtcatttgctttctctaagtatcagtttgcatatatgcaaaatagaggtaatgatacctacctcagtggtaccttttcaaaaccttgttcttcctcatctctcctctaccactttctcataatattattacagtaataaccatttattaagcactgtgtccgcagtggtgtggggctgctttacctccacaacttcactgaatcctcactgcagtcttgtgggatctttatttctttgcccattttacatgtaaataaattgaagtcaaatgagttgttcaaggtccttctgttagcaagtggcagagatggacatgaaaactagatcttctacctatgtgtctttccacttcaactaaagaatttattaaagagaattgaaaagctatgaactaaatttcggtaatacttttaatagtaaacattgctgccctcgtgaatgaacacacactaaatttcaaatctcacggtggcagggaataaagatgctacctatcttaagccattacttcaccaacttctccaccaaaatattccttgtaaccacaaataagtaagcacaatagatctataaggagagaataattgtgaactctgattttatcttaaaaagtcatgtagggatgtcatgttccacaatgtgattaataaaatatattttgttactaaacacaaggaaaaatattatgttccataaagatgtttggtggttgcctcgacctcttttagtttgaaaagtaggtatgtatgagaaagatatgtgtttacatgtttacccttgccttctctctgtctcttcccctctctctccctccctccccaacccctatgccctacacccccgcaacccccacatgtatttacctttctctaaaagctctgcatagccaagaaaagtgctcttttttatttttaggatattagatatttcattttcttatggtaagacaaaagattaaggcaaccaagacttacaatgtgcctaccatgtggcaggcacagaggcaagggcttttacatgttatttaatgtaattgtaattctcacaaaagccgtctagagttgaaaatatttccaactctaaatgaggcaaatggagcacagagagccttaattatttcacccaaagttcagtggtagaggcaggattccaacccaggtctggtgggctccaaatccttgttgggttgccattcctcttgctaacaaataaaactggtctgtgacttttgcatttcaccccgcttccacagtcactggtgggacttacttaagttaatcagattcttcaaagtatccccaagtcctcctttgaaaagaaagttgggggacaggaggaggagcagaggagaggagataaaaaggaaaggagtcagggagagagagagagagagagaaacctggtgatctcagctgggtgccaaggtttcctaagcccaagttccccatggttgagcctgtattgtcaggccaacagcttctagtaatccacttttatttaattaatagtgaaactgttgaagaattgcaagtggtgttctggttcagaaaccttccgttctatggggcactgcttttgcttcagattcataaaaccaaatgctctgcctcaagataataagtgaacgtgtaaccctcgggaggtaagaaaaaacacaatgtcacgtgcaaattctgcacttgttctcaaagcaaacctctcctgtgtttgcaattaggatgttatctaggagcatattcaaaacttttgaggtttttattttagtttttctttcattatgtgctgttttagtaatatcaaagaatacatgtaatatataatttatatgtcataacaataaaattaatgttgatgagcccagattaaagaatcaacaacattaacatcatgattgcatcaaccctattagaatggaagctctgtgaaggcatggatttttgtccattttgttcactgctatatccccaggacctagaggagtgtcagccacataataggagcttagtcaatattttaaaaataagagcataaatctacttatatcctctttcctcttaccatcactcccagcctcccctcagaggtaaccactatcctatatttgggctttattattcccttgcattttgataagttttcacatgtatattcccaaataatatattgcttgcttttgcttctttttaaactttatataatggaatcatattgtatgtatcctattgtgaattatgtcttttacacaacattagtatttgagattcaactatgtgtagctcgattccattccttttcattgctgattgtagtttattggatatgtgtgccataaattatttttctcctgtcagttaatgtttatcatttatgctttaataaacaaaactgctatgactgttcctgcatgtgcctcctagtacatatgtgaccaactttctctaggatataagcctgagagagggactgcagttggaatttacatttccaaagcccaaagtttagctcatgagtcagagctgcaatgtgccctttgtccacactaggtcaggatcagtgggagtgctacccaaaatattttgctagctggggagtcagggagaagcagagactgacctagtgaggccaggaggcactatctcaggtctctagtcaaaatgggttgcaattagtaaaagtccagattctgaatccccttcactatttatcttcctcttcctcctttacagttatttttgttcaaggtgcactttattaaactcatgcctaacaaacaaaactctaatgaatattttgtctttcattgattgtaaattcaattaattagattgcttgaaaaaattttaactgtattttcactttagtatggatgaaaatttcgatttctttaaaaaacattttttaataataacacaacataaagtctaccctcataacaaaatttaagggcacaacaccatattgttttttttttattttattattattatactttaagttttagggtacatgtgcacaacgtgcaggtttgttgcatatgtatacatgtgccatgttggtgtgctgcacccattaactcgtcatttagcattaggtatatctcctaatgctatccctcccccctccccccaccccacaacagtccccagtgtgtgatgttccccttcctgtgtccatgtgttctcaatgttcagttcccacctatgagtgagaacatgtggtgtttggttttttgtccttgccatagtttgctgaggatgatggtttccagcttcatccatgtccctacaaaggacatgaactcatccttttttatggctgcatagtattccacggtgtatatgtgccacattttcttaatccagtctatcattgttggacatttgggttggttccaagtctttgctattgtgaatagtgccgcaataaacatacgtgtgcatgacaacaccatattgttaactgtaggcacaatgttgtacagcagacgtctagaactttttcttcaggcttaactgaaactttatagccattgaacagcaacactccatttccgtttcttaaaggtcctttacaaaatgagctttctgcgtgtttccattttgtttatctgataacttttttttctttttttattatactttaagttctggggtacatgtgcagaatgtacaggtttgttacataggtacacacatgccagggtgtttggctgcacctatcaacctgtcatctacattagatatttctcctaatgctattccctcccttgcccctcacccctcactggccccagtgtgtgatgttccctagcctgtgtccaagtgttctcattgttcaactcccacttttgagtgagaacatgcagtgtttgattttcttttcttgtgttagtttgctgagaatgatggtttccagcttcatccatgtccctgcaaaggacatgaactcttccttttatatggctgcacaatattccatggtgtatatgtgccacaatttctttatccaatctatcattgatgggcatttcagttgttccaagtctttgctattgtgaatagtgccacagtagacataagtgtgcatgtgtctttatggtagaatgatttataatcctttgtttatatacccagtaatagaaatgcttggtcaaatggtatttctagttctagatccttgaggaattgccacactgtcttccacaatggttgaactaatttacactcccaccaacaatgtaaaagcgttcctatttcttcacatcctctccagcacctgttgtttcctgactttttaatgatcacgattctaactggcgtgagatggtatttcattgtggttttgatttgcatttctctaatgaccagtgatgatgagctttttttcatgtttgttgaccgcataaatgtcttcttttgagaagtgcctgttcatttccttcacccactttttgatggggttgtttgtctttttcttgtaaatttgtttaagttcattgcacattctggatattaattaacctttcgtcagatggatagactgcagaaattttctcccattctgtaggttgcttgttcactctgatgatcgtttcttttgctgtgcagaagctcttgagtttaattagatcacatttgtcaatcttggctcttgttgccattgcttttggtgttttagtcatgtagtctttgcccatgcctatgtcctgaatggtattgcctaggttttcttctagggttttcatggttttaggtcttacgtgactcatcttgatttaatttttgtgtaaggtgtaaggaaggggtccagtttcagttttctgcatatggctagctagttttcccaacaccatttattaaatagggaatcctttccccattgcttgtctttgtcaggtttgtcaaagattagatggttgtagatgtgtggtattatttctgagacctctgttctgttccattggtctatatatctgttttggtaccagtaccgtgctattttggttactgtagccttgtagtatagtttgaagtcaggtagcatgatgcctccagctttgtgcttttggcttagaattgccttggctatgcaggctctttattggttccatatgaaatttaaagtagtttttttataattctgcgaagaaagtcattggcagcttgatggggttagtattgaatctgtaaaacactttgggcagtttggccattttcatgataatgattcttcctatccatgagcatggaatggttttccatttatttttgtcttctcttatttccttgagcagtggtttgtaattctccttgaagaggtccttcacatcccttgtaagttggattcctacatattttattctgtttgtagcaattgtgaatgggagttcactcatgatttggctctctgtttgtctgttattggtgtataggaatgcttgtgattttcgcacactgattttgtatcctgagactttgctgaagttgcttgtcagcttaaggtgattttgggctgagagaatggggttttctgaatatacattcatgtcatctgcaaacagagacaatttgacttcctgttttcctatttgaatatcctttattgctttctctttcctgattgccctggccagaacttccaatactatgttgaataggggtggtgagagacggcatccttgtcttgttctggttttcaaagggagtgcttccagtttttgaccattcagtatgatattgggtgtgggtttgtcataaatagctcttattattttgagatatattccatcaatacctagtttattgagagtttgagcatgaagcagtgttgtattttgtcgaaggccttttctgcatctattgagataatcatatggttttgtcattggttctgttgatgtgatggattatgtttattgatttgtgtatgttgaaccagccttgcatcccaggggtgaagcggacttgatcgtggtggataagctttttgatgtgctgctggattgggtttgccagtatttttttattgaggatttttgcactgatgttcatcagggttattggcctgacgttttctttttttgttgtgtctctgccaggttttggtatcaggatgatgctggcccataaaatgagttagggaggattccttctttttctgttgtttggaatagtttcggaaggaatggtaccagctcctctttgtacatctggtagaattcatctgtgaatccttctggttctggactttttttggttggtaggctattaattacttcctcaatttcagaacttgttatagttctattcaggtatttgacttcctgctttaggcttgggagggtatatgcgttcaggaatttatctatttcttctagattttctattttatttgccccagaggtgtttatagtattctctgatggtaatttgtatttctgtgggatccgtggtgatatcccctttatcattttttattgcatctgtgattcttctctcttttcttctttagtagtctggctagtggtctatctacaaaatagactgtttatctgatatttattttgtaattatctaataataaccatcattatcatcatcagcattatcattatcatctcctttacccatacatacatttgtgtctttcaaataataatcccatctttgaagtgcatcctcatctttagcagtctgcactctgctttcttatatcatttattatcttattttataattatttatttccagtccttcttctctaacagatagtagtttcttagggccaaggaaatatctcgatcaccactatatccccagcacctaaccctgtgcctggtccatagggccagatgctaagagttgagttgaaccattgtacctaatcttaaccttcattagcacaacatggtttgtcagtggttaagaatctacactttggagtcagactcacccaggatggaatcctggcattgccacttattattaatagatgcgtgatcttgaacaagtttacttaattgttctgagcatcagtttcctcttctgcaatatagggatgatacacagctacctggtaggttgttgggaaaattaaatgggatgatatgtatgaaatggcctggcatatagagtgcctaaatacatgttcttctgattctatttggacagtttgtgttagtaacagaagtcaaaaaggtggagaaaggagaaaggtacttgtgaaaattttctatttcttctccatgtttcattcaggactgaggaagggggcacagtttttacccaaggaaatgacatttttagccaaaagaaatgatcttagcatttagctgaattatatattggaagtaagctccttccatgtggaacttatggccttgctagccttggtttgttggaagtgctcttgctggctttctagttagggtagggaaaggaaggcttgtggggaatgaagataggccatgatatcaagccactgggtttgcaaatcagtagaattttttattgctttctgttgtacttgggacttgaataaaggctgatatttgtgtcttgctggtaaagtgcttgtaaagtgagtgaaagttttctttgctcttgtcctgacatagctgttcacttggggttgaggggaggataacctttcatgttttttttttttcttcattctgatgactgtgctgaacattcaaaccaaaaggccattggtggaaagtaaaggtgagtggtgagaagacaatagggtaatggaaactgtgttggacttgtaatcaaattgtcctgcacttcccctctccaagtcttaacgtttttcatctgtacagtggatattaaaatgagaaaataagcttgtcttcacagagttttcgttaggtgttgacacaacaaacaggctcccattagggctcattttccttcattccttagtaaggaagaagtgcttataaaatatagcagttgtgctcttgtgaatgatagcatgggcagttgtcatctccctgaagcagatgtaacccagaatgtcacttgagttttgtttaatgcttaggcataagacataggaatgacaaaagctgacctttgggtagtgagaacaatgttccattttgttcaaacttgaattttttactataggagactgagaattaaccttccatgaaggttttaggattggctttctggcccttctccttcatatccacctgaaagagcttgggcgcagaagttcttgcagaaaggcagttagacaaggtgacttctgaagctccagtggccaagtattttgatggtagcctaaaagatgtccagaatcattgtacatcattttttcaacagaagcttcaggcatagggattatgcttggtactttatgttgtggaatggaatctggcggatgtccatgtgatctatagaaacacctaaggaaagtgaagaaatgagggaaaaaaaagaacaagacttttatgataatactaatcacgatccttgtgtatttattccaatggcattttatccattatctgatttatattaccactcacagcagcagctcaataggatgggagatattatctctattttatagatgagatttgaggctcacgaagctaaagcaaggaacatcaaatcactttgatatttggtctggttttgttataggtctccctttggatgaggtaaagttacaaacctgggttcatatcatttaattagtctgaaaatgttgcctggacaccaccttcagttagatatcttaacctcaggcttcctgccttcattgctcccgcatatagacatagactatgagattggctaatcccagagaacttccctaatcccttggcaagatccaaaaaggctcagtcacaccctacaaccatcatctttaggagaagtctcagaaaattcagcttcacactaactaacttgagcaatgaataatagtcatttatgcctgcaggttaatgctgaagacctgagacttcacttgcctatttctgccattcagtgacatgtgttgcattggttttttgtgtctttccagtttggagactgccagggaccatgttttgcccattgactattactttccaccccagaagacctgcctgatctgtggagatgaagcttctgggtgtcactatggagctctcacatgtggaagctgcaaggtcttcttcaaaagagccgctgaaggtaaagggtcttgcacatgcacttctctttccctttctcctttaccttccagagagagacactaacctttcagggcccaggattttatcatctcagaaatagagtcattggcaaggccctatcaaataacttaggagcctaaggaagcaaatttttgtacttgctagttccctggtttcagcagccttgtttgtacaggcaatttaggcagtgaaggtggtcccagctggggcttggggctcagtgggtcctagaaatgaaagaaaaattaatgatttgaaaagatttaatttcctcccttcttgttttctactctgctggctagtaaaggaaaaatttgtccttattagagaggttagaagtggagaaaccccaactgagtccccagcctgttccttgggatgaatatgagactgttccttagcaaaggcttcctggcctcggccccagaaagggagtgttctcactcttcagcagactatcagtctctgcacctgctccctcctgttgtggcctccttgggacctgtctttgcattaatagttcctaggtaggtaagaactcagagtgaagaaacacatttattctcctctccagagacctgatctcaaagcctgtccattagtccctaaccttaatctaaggtagcatcttatatctggctaaattggctcaagccctagctccttagttttatttagcttagaacaactcatgtctgctcaacctctagaggcgctcagcccacattctgcagtagaaactcccattttcaggcctcttatatacggtaatgtctccttcctctaaccacccagggcttaagcttcctgcttatccacttcaccctgtattgagggctttcttctcaaagagacattgatgaggagcccctagagagagatgctgtgctctgggaccagaccccttgttaaacaccagtattcacctctgccccaactttccccaaagaggtacttcctgccaaggcctttctctttcctctcactggctggaagtgttgagttccacttcagaaccagaacagagaacctttccttctataagagctataaaccttgagaacagtcttaaaacataggtatgtaggccacaccattcaccacgaatgtactgatactcatcagaatatggaagaagcaccagagagtttgaagcatctagagaaaaggtagaaagagaatgccctttaactgacctcctcagtgatagccaatcacaatgatgagtgttgattcatcattttggctaggtggcagaaatatctataaaacagaagctgccatgttgttttcttccagtcctcagggcctacaagaaggcagctatcatttggtattactgaaaacatgccccatgttcagctcatacccccaaattacccattgctactgtttatgctgggctaatatgaagcccagggccctaatgtctaggtctaggcagtaaggcctagagcagtgcctaaagagcctgagagcagtgccttcctttcttcagagtactcatgaaaggatggctgtcagaaaaggaaatgaggatgggttccagagacttcagaccaccccaacttccccagtgagaccctggcacctccccataccctctcacctagcgggccctgtctatagagcagagaatgaaacagagcactcatctagaggtagtgtgtcagcaagcccaggcactgcaccacagtaatagcagccatatcagatgggaaaggagttcaagtgaacaaacaagcaaattcaatagtcagatagattagattatacttgatgcttcctctgagttttacaaatatgggtcactaaattgttattttcagaaaacaggggaaatgctcaatcacattgtgaaagggaagattttgctgtcatatcatacatcccacatgggagctttctgcagaagttagagctgaaggagggaggcaggcagaagggcaactggcagggctgcctgggaggagctctgcaatgaggtggatcctgtgccatttgagaacagggaagaaaagaaatgaggttttggggagggaatcacccaactcacagaacacacagaaatccagcaaggtttcaaaacgctctacaccttagagtctgttaagttagggaaactctgtgagctcatagggccaaatgcacttgcctgcttgaaatatgaaaaatcagcaatggattccttgaaaaacaatgaaaagggaaccttctgagccccttggttattttgacatatggaccatagatttcagtcctgagccctttgaaggtaggagaaggtggtttagaaaacacacacacacacgcacacaaacacacaccagaatgaagcaaaaaaaaaattactggtgttttctttctcctcccatctgtgaagctgttggattgattttactgccatcattatccctgtttgaaggcagggggctgtcttattacccaaagaggacatttattgatttggttttctttttccatttttacaatgcatctttatcgcccatatggcctttctggaggtggttttcagtctggcttgttgaaacatcaaattatacctgtcttagagaaaatagaaacaaaaatctttctcttccttacttgcttgttgtagtcagttaactcggactgagtattcagagtcttgattatcacttaattcatagtttcataaatctctggaatgggcataggtacaggacttaaaagcctggcatctcagacagaaatatgtttttagctttggtggtttataacagatgggacttttaggctgtcattggtgcagggctcagcacagagtcagttgtaatctggacaggttttgttgttgaggaagagtgggaagagggagtcctacattttctccttgtcagtaatgttggagaattggggtgagggtgaggctgggcagggagggtctgcatagaaaaaagggtgcggtgagaaaaaataatgctactaagccatgagggtaaaatgaccaaattctggttgagagaaacttggtcaaagtgtgtatggggagagaaagttggtcaaagtctgtgtctgagtgcttggtgggatgaactctgggttagaaacaggcatggagggaaatagttggtttatggagtgggtaggatgagtggggtggtgaaagggaaggcattttggatgctaagagaccaggaagtcaaagcaaggcaatacacataaacagaggtaagggctcagagaggttttagttgtgtagacttggataagaaattttcccttttggacctcagttttccttgtttgtaaaacaacggacttgaactagatattttaaaatgtgcttccagcttagacattttgtgaccgttctacaaattacaaacataatcatcatcatttcagcaaactcacatgtatttatacctgcataagtttttggtcttgctttcctagaaggtgactaatcccagatcctaatcaattaaagaagcaatcttcagatggggatagagccagctgagagagtgtactatggatggagtgagttaaaactcaggactcagattttctccttgtgatcattgctgggtaacttcctttcttttctattttctcatctggaaaatcaggatatgaatccccatctctacctcattatgtttcaaagagggttaattaatccatcatgtgcattatgtgctcaagaatttactatttttcagacattttctagtaaaacattgaagattatatgtccatttgttttgtacacatggagtgctgtttggtacacatcataaaattgaaactgtagtttacattctgaactcaaagaattacaccatcctcactgatgtttacaataggtcccaatttagtttctttagcaaattttatgtaagtatggctttgattctctctctcactccaggtttttgttagggaagaaatgcaagtgaaccctcattgaactctttctgtcctttaaatccattctttcccacctcaactcatgtggaattgaatgttgcctctagtttggagtctagcagagagtttttggtgcatatcagtgtccccttcactccctgacttttcaagtaacatttcccagaggcaaattaactctgctaagaggatctgcttgcagcttcaacagagccttcatcaggtatctttggccaaggagttgactgatcctgactttgcgagtcctagagatcttttcacaaagctcctctcatgtttctgcctctgattttcttaaatgtcacagacagactttagatttaggggttggttaactttttttgtaaagggccatgtagtaaatattttaggctttgtagatcatatggtctctgtgtcaactactcaactctgcctttgtaggatgaaagcagccatagacaatactggaactaatgggagtagctgtgttccaataaaactttatgggcactgaaatttgaatttcacttaattttcacatgtcgtttaatattatttttcttttttaccatttaaaaatttagaaatcattcttagctctttgggcctcacaaaaacagatggtagagtggatttggtttatgggctgcagtttgttgacctgtgctttagctaatcacttctgtacttataaatctgcataggttttatgtttttccatctcttggtatcttagtaggccagtcaaagtttgaacaacttgttagcacagaatacctggcctagtggcttcttggtcctgagcttatttactaaacaagagaaaaaataaataagtctagaaatgctagaagaggatacttttttgttttaatgatctagtagatcactcctccttgcaatacccagaggagaaactgaaaatatttcaaacattttctagacttctgtgttgtaaatttgtggataactatgaactatatatgaatgaacttttctggatgacacatatattccagatggtaaaaaggaagggctttggggactctctggtaccaagtgtcatggaaaaactgtgtgtctcatagaaagtagatcccaggaggccagcagagttgtggatctgccatatattacctcatgattctgtcttcgcacactcaccggcttaattctgggcctccccataacacgactagaccacaggcttgcagaagaaataatttagctctgtaactcattgaagttggtgcccacccaagtctctgtcagtgcccaattcgggagccatgccaagaatttgccattgctgcttcatggtggccttgtgcctgcttatttatagcctgtgcattttatgaaacagggattaataagaagttgccatagcacttgcaccattatgtaaatatctgtaatgcttacataacttttgtcacttgcaagaccttttgagtccattgccttctgctaccatgccttaccaatttcctagtcccttattattatttttcaattcattatatttaacttctgtgatacacgttcagaatatgcaggtttcttatataggtatacacgtgccgtggtggtgtgctgcaaccaacaacccgtcatctacattaggtatttctcctaatgctatccctccactagcccaccaccccctaataagccccagtgtgtgatgttcccctccctgtgtccatgtgttctcattgttcaactcccacttatgagtgagaacatgcagtgtttggttttctgttcctgtgtttgttttctgagaatgatggtttccagcttcatccgtgtccctgcaaaggacatgaactcatccttttttatgactgcatagtattccatggtgtatatgtgccacattttctttatccagtatatcattgatgggcatttcggttggttccaagtctgtgctattgtgaatagtgctgcaataaacatacgtatgcatgcgtctttatagaagaatgacttataatcctttgggtatatacccagtaatgggatggctgggtcaaatggcatttcaggttctagatccttgaggaatctccacactgtcttccacaatggttgaactgatttacacccccaccaacaatgtaaaagtgttcctatttctccatattctctccagcatctgttgtttcctgactttttaatgatcgccattctaactggcattgacatggtatctcactgtggttttgatttgcatttccctaatgaccagtgatgataagctttttttcatatgtttgttggccgcataaatgtcttcttttgagaagtgtctgttcatatccttcacccactttctggtgtggttggttatttttttcttgtaaatttgtttaagttccttgtagattctggatattagccctttgtcagatggatagattgcgaaaattttctctcattctgtaggttggttgttcactctgatgatagtttcttttgctgtgcagaagctctttagtttaattagatttcatttgtcaattttggcttttgttgccattgcttttggtgttttagccatgaagactttgcccattcacaattgctacaaagagaataaaatacctaggaatacaactcacaagggatgtgaaggacctcttcaaggagaactacaaaccactgctcaaggcaataagagaggacacaaacaaaaggagaaacattccatgctcatggataggaacaatcaatatcgtgaaaattgccatactgcccaaagtaaattatagattcaatgctatccccattaagctaccattgactttcttcacagaattagaaaatactactttaaatttcatatggaaccaaaaagagcccatatacccaagacaattctaagcaaaaagaataaagctggaggtatcaagctacctgacttcaaactatactacaaggctacagtaacccttatcaattttttatgtgcctctccatattctgcagtcagaagcttcttcagtcctttcagggaattgctgggtgactatcaaactctggtagttcatttttgcagttggctgctgttgtgaggataagagttagactcactttctcttcagagatagaaattatgtattaattctctgggttctagacccacagcaaggagcatactgctcctcaaaataactgaattctgcgagaagccatcattgtaaaacaacaatatcttcagttatagtagccatgtgtgcaacttctggaaactgttattcagattttcatgttccttccctgtctcttcatagctaggcagctgctttcagccttgtacagatgctagtgagctttctacctacaaacctgcagaaaattgaactgagatttggaggtgaaagactcttgataaagggaacaaggtttagaattctcagtccctttgctcccaggctgtgttgtgactactgaggcactccagtgaaatcactattcctcctatctagactaatgcctgtctctgcagagcacctcataagaacaggcctggtagtaatatcctcatgcattcagtcagtaaatatttacagagtgcttactacatatagggtattgggctgacatatgcaagatacagggcctgcttccaggaggttatagcttattgatcataaatgtggcattttttttttttgagacggagtcttgctctgtctgtcacccaggctggagtgcagtggcacgatctcggctcactgcaacctccacctcccaggttcatgtgattttcctgcctcaccctcctgagcagctgagactacaggggctcatcaccacacccagcttttttttttttttctgtatttttagtagagacagggtttcaccatattggccaggctggtctcgaactcctgacctcgtgatccacccacctcagcctcccaaagtgctgggattacaggcgtgaaaatgtggcaatctttaaagctcttcagtggatgaaaggccaccctatctgctgtccttttgaacttcgcaactttcttggtacagagtgagaggttattctcttggttttccatataagtaaactgaggctttgccagttcatcaacaggtagtaaataatatatttggaatttgaacccaagtcttctggggtcaaaggcagcattcactctgctctgtcacagcagctcctcaaataagccaacatagaaaccaagtactatgcctaggcaacaagaaaggcagcaatgaagagcaacagcagagtcaaatatgagagaaggaagttaagaaagatgttaagtactgtggggagtaactgagaaaccaccaagtatcgctaacatcacagggaacttgtcttcctaagaaaattccaagcacttaaaaccgctggtagttcatcagcaactctcttcattagatgtgcgagggacatgtgggccatagtccttctactaacttatattcttcaggggaaagttctgattctgatgagacccagcatggtagctcttaattcactgttgtcacacgactatagaacaggaagcacaacttaacacctgtgctcatgagaattttgctccttatgaccaagctaaagaaagagcttagacaggatgtgtggctataaatgtagattaatggttccttggctctttggtttgagccttctcagcagagcatcccacggagtgttttccatggggccacgagcaagagaaatccacttccctcctcctcaatgtcagaaaatagagaatattgtctttcaggatagaattaaaaagtcatagaggcagcaacttgttttcctatattagggttttaaaattctgtttttccttcctctcctgggtcagatcattgtgtggatggaccttgatttcattgtggtatctgtatgtggaccctgaagaccatggacttctaacaattccttaagttacataagcacattcctacaggtcacaagctcatttacttacaggatggttgatttggtcacaggttatttcatgaaaatacttaaaagatttgcagtgttcaaaactgcagtatctttaaacactaaaacttgaaggaagggaatttagaaatcaaaaaatctggtcaaaccatttcatggaaaaggaaagtgaggctcagagagaggaaattactttcctgggtttgtatagcctataaatggcagaaatgagagcctccctgccatttctagttttctgtctgagagactctcctgcctaatagctaattagcagagtcacagaggtcattaccttgcaattctcaagaattatgtgaggcagcatagtaagcatttatggcccttggttcctagaaggagcttagtccctgatagtcatctctgcctttgccattgtgtgagactgtcttctgtaactgtatgtcttcctccctagtaagttaatgagtaataaaggtattctatagtgagaggactctgtaagacatttcttggtgtgaggattgttccaaggttgttttgtgtgtatgtgcatgtataaacttttttagggagcatattcatagcttttacatggatctcagaggctctataacccagagaagattacagaataccagtcttgtctttggtaaggattttatagacccatcctgactacagtgatatccaacatggctatgtaatgactggcactttccccacataacatatatttattccacactcagtgcctactgtgtacatgagacctataccgggcactgggataagagacatgaaataacagctaaaattgtttattgagcagtcagtatgcattagatgctttgtagtcattttcttattcaatctgtataccctcaatttacaaatgaggaaactgaggcacagaagagttgagtgatttgcccaaagtcatacaaatagtcagtggctatgtgatgaatagttaccaacataaaagagtgagattactgctgtactaaaagtaggtacataatcccctgagcagacagtatgagagaatgatttattttacctggaaagtttaggaaggcttcacagaggagttaagggttgatctgggtcttgagggatggataagagtttgccagatacaaaaaggtaggaagagaacttcaggaggagggaacaggctgagcaaagacacggcgatgtgaaagtgggaggcttgtttggggaacattatggaatctggaggttattgtggggaatctcatcagatgcagcaagctgtttgacaggccttcagttggctctttgtaccttgctccctccgcatgctgagctgtccatagctgccctaggctggtgtctgggattttcggaagaaggttactatccaggtagtgtaacaagatgcagtgcaaaagcaccagattggggctctggctctgctgctgacttaccacctggccttaagcatgtctagttccctctttgtacattaaaatctccattggaacagtaacatggttgtattaaatgatcttgaagattttacctgcacgttttgcacatgtaccctaaaacttaaagtataataaaaaaattaaaataaaaaataaaaatataacaatataaatctttaacaataattttagtagtaaatctctacaattttacagataatccagatgcatccattggccaatggttcactttgtatgcataatatttgggaaacaggcagacccaatttcaatccttagttgtaagacttaatacatatgtgatctcgagcaaatcacttttgtatgcctctataaggataataatagctcacagaattattttaagaactaaatgatgtgtaataaagctactggtactcagtaagttttgtatccttttcctagagtgagtcttggtcataggcatgcgtatacttgcagcgtccctgggtaggccgaaagagcaaataagagatggtatctatggtattccccaggtaaaggaggccttgggttggcataagatttcacttctctttagagttacttaattagggaccagaaaggccatcagcatttgtatgagaatataacaaaggtcaatctcttcctctttactttttacctcccagtacactgtgagtaacattccccagccagcccagccagcacgtgttcattgcctctcttgacttccagactttggacttgaaggtgtcagagctctctgtgtatctttgtccccaacaagataagtctgacctccccagcaaattcaagtcctaagccactgtccaggagaaaagctagcaaggtcataaattattctccatattttccagccattggtttcccttgtccagccagaggtgtgtctcaaagtatgctgaggccagattcaatagaaacctgagccagcacctgtgtaaataatttttaaagctccttttcctgaagctggatgaatatttttaaaaactaagctggattgtcttttatctagcatgccgtctcctacattcctagtgctatggacctcttggaggaatgtggtttggttatagtggtattgtcttgtctgttgtgggggagggagacatttctttcagaagcaaggtaatactttggtctggtctatgactctattttgtttaaaatgaaactatggcagtatagtggtattcattctgcttcccataggttaactttacatccctctgtcttcacccactcttcagttctgattcttttaaaagcagccaaccaaaaccagcaagtacatactgcttatctctgacttccaccagaatcaacttcagatcttgtccaaagctccatctgaagagaggggaataacacccagccaagagccctcagggcccatcagtaagtagacatcctgtccttgaggttccttaactctgctcagcttcagaatacagaaggggttggttcttcatttgtgttgtttataactaaaagcctcctactccccacttttttgcatagcttcttctgccatcccacctgtgtagcctcttcaactcccccaaaactcctctgtagcccatgtcacttggaaagagttttctttgtctcttttgcaacttgacaatgactagccagcaagtttaagttcaaattattgttccatgggagcagagatagatataggaaacaaaaaaaagggatatggaggtatagagtgatttcccacctacctagtgagcactactgagatattcaagtactctctacccaagaattctattgatataaaggtaaaaaacttgatcttaggtctaatatccgttagtagtgtgaccttgggaaaatgataccacccccaaaggcttagttttcttaactgtaaaataggcatacagatgaccacccccagaggattcataaggataacatgagataaggcaacttgaaatttcctagcatagtgatagactttcgaaaataaaatgaatcaaacactgataacagtacttcctagtacacaaatgagaaatcagtccctcatcaaattacagcacattttcaatgctccaattatgtcactgtagaaatgctaatgtggattaaataatttgtctgttgctatttatacggataatttgatagtagttatttttggacatggatagctttgaagccttacagatgagtccatccccaagtacccaaaactaaagaaagttggctagagtgatgacaaggtggcagcacagagctccctgcgttctgggccctgtcccctagctagagagaactccaggctataagcatttgtattctcatagtccaatggcagggaagaagggctggaggtgagtagttttcactcatttattttttcaacaagcatgtatggtatcaggccttgtatgcatccagagacaaatgtgaactagccgtgtcctcaaggagattccagtctggtgggcctgccttccaaggtcagttgcagctttagcactataaagagcacctacctgcggcagatacaatgtgatgggacatgacagagaaaaaatctataagcagagcctccccattcccaggcattgaaacaatcctaaccaagactggcatagtacaatgagcctgtccctatcagcaggtttggaagccttaacaacaacaacaaaaacaataataatggtgatgataatcatagagcctaatgttaccaaacattttccatgtgttaagtactatactaagtgcatacttaatcctcacaacaatgctataagatagtagatactcttactactaccctgattttacaaatgtggaaactgaggcacagaagactaagagaacaggaatacacctaattcacctcagttcaacaaacatcaagcatctgttttatgtcaggcctcgtgctggatggcagggagagagagatgagtaaagcatagtttcagtccagtgggagcaaatgacagcacacagtggggcaggtatattgcagcccttctgcttgatgctaagaactcagtgtcagtgatgaatgaaacacagtcattctctcaaagatcttaaagcttagtaggagatatctgtgtggaaacaaaaattaaatactgctgtgataagtgtcataagagataagtggaaaatgagagagagagatcactgtagcaattgattggtttaaatcaaagcccccaaaaaaatgttattgagaattataaaacaactaattgatttaaatcaaagcccaaacagaagtgtttgctaattttatttcaatttggttgataatttggttgaaatgaatttatttcattttttattccatccttacaatggaagattagtgcttgtttcccacccaaggataccaggatatttcaggggctgtattacaatatagttaaattattcctttatctcaaagcacatccacactttcccctatccttacctttactcagggtatctcttctgcctcaggtgctttttctccacatttccatattcttaagtcctaccttccttcagggcctcactcaaatgcctcctcctccatgaagcattcacccgactgaaaggtaccccgccctctcctgtactccacatcacttcatgggtgtctccacttcctgctttatctttcagtaatacacttacagttctctttcctccactagactgagctcttcagaggaagactcacttggctgaaaccatgattttactttaaacacattgaaaacctctactggagtgcattgtgtctggtgggcttcaaccttaattcttaagtatgtgaaaacacatcacctatctggaggtttacactttctgctaatgactttatttttaagcccaccaccctaacacaacaaatacttaaaacttgtcttcatttcctttaggtctggccctcatgcatgcatataatttatagagtcactgttttgctcggttgtcctcatgcctctatattattggaggtttagattgtttccatatactcaggttgtattcatgtcctttttttctttttaaatttccttagcatccatttccaccattggaaattcagggtcaaaacaggggtttgggattggagcatgtctatcacagataaccaatcatgtgttatgacttaagaatttatgaaagggccctctacctgaagatatcttgctactgatgctgtctcacagtgtctgaaactcccatcatatgtggaattgttttggaaggctttgcctcctgggacacattcagccataatcaagaaatagtattgagcattagactgtcagtatgtccattagcaagactgtggaggaatggaatcaccaatattatattttataggggatacagaatacaagagaagttctgaagagaaaattcttatgtagaataggaaggcttagatacagcatgaaagctgcaggctttgaggagccagaggtcaaatgaaagcattgagtatttgtttagatgaaagaacagaaagggaaaaagaagcagaggaagggatagtagagagaaatgtataagttttatccatttaacttgtaattgtgtttggctatgggcacaatagaagcagtgagatcactttattttattttattctttatagacagggtcttgctatgttgcccaggctgcagtgtgcagctcttcacaagtgtgatcatagcgtactacaccctcaaactcctggactcaagcaatcctcccatctcagcctcctgagtagctgggactacaagtgcacaccaccacgcccagtgagatcacttgaaactagggagagatgtgtgagttctgggcaaccagtagttggctttacatagaactgtaggggtcaaggccaaaggggacgtcctgttccaagtcaccttctttggacattagaaaaccacgaggggtttggaaatcagaaaaccagcagaggcaggaaaactcagggcagcatgggagattcagtatatacaaaaaggttcacaccagtaatcaaacagaattttaactgctgatgtggagtagaggcagctttgtctgctgtgtgataaccaaacctttacgaatagtaggtgtatatggggaattggagggagataggtggctgtgtttagtaattggttgacttcactgagatggtttggggattgtggcttccagatgatcagattttcttttttaggtagagactccaacatcattacagaactataaattacatgtggaaaagaaaggcctcctatgttagaatagaaaataaaatgctgtggggttgagggacagaggtgctgtctaggaagtcagatagcgttttccagttctgtccctcagagttccttgtcctcattgagactcaatttctcttacttttttttttatactttaagttttagggtacatgtgcacaacatgcaggtttgttacatatgtatacatgtgccatgttggtgtgctgcacccattaactcatcatttaacattaggtatatctcctaatgctatccttcccctctcccctctccccaccacaggccctagtgtgtgatgttccccttcctgtgtccatgtgttctcattgttcaattctcacctgtgagtgagaacatgcggtgtttggttttttgtccttgtgatagtttgctgagaatgatggtttccagcttcatccatgtccctacaaaggacatgaactcttcattttttatggctgcgtagtattccatggtatatatgtgccacattttcttaatccagtttatcattgatggacatttgggttggttccaaggctttgctattgtgaatagtgccatgataaacatacgtgtgcatgtgtctttatagcagcatgatttataatccttagggtatatacccagtaatgggatggctgggtcaaatggtatttctagttctagatccctgaggaatcgccacactgacttccacaatggttcaactagtttacagtcccaccaacagtgtaaaagggttcctatttctccacgtcctctccagcacctgttgtttcctgactttttaatgatcaccattctaattggtgtgagatggtatctcgtggttttgatttgcatttctctgatggccagtgatgatgagcattttttcatgtgtctgttggctgtgtaaatgtcttctttgagacgtgtctgttcatatcctttgcccactttttgatagggttgtttgtttttttcttgtaaatttgtttgagttctttgtagattctggatattaccctttgtcagatgagtagattgcaaaagttttctcccattctgtaggttgcctgttcactctgatggtagtttcttttgctatgcagaagttctttagttgaattagatcccatttgtcaattttggcttttgttgccattgcttttggtgttttagacatgaagtccttgcccatgcctatgtcctgaatggtattgcgtaggttttcttctagggtttttatggttttaggtctaacatgtaagtctttaatccatcttgaattaattttagtataaggtgtaaggaagggatccagtttcagctgtctacatatggctagccagttttcccaacaccatttattaaatagggaatcctttccccatttcttgtttttgtcaggtttgtcaaagatcagatggttgtatatatgcggcattatttctcagggctctgttctgttccattggtctatatctctgttttggtaccagtaccatgctgttttggctactgtagccttgtagtatagtttgaagtcagatagcgtgatgcctccagctctgttcttttggcttagggttgacttggcgattcaggctcttttttggttccatatgaactttaaagtagttttttccatttctgtgaagaaagtcatgggtagcttgatgaggatggcattgaatctataaattaccttgggcagtatggccattttcacaatattgattcttcctacccatgagcatggaatgttcttccatttgtttgtatcttcttttatttcattgagcagtggtttgtagttctccttgaagaggtccttcaagtcccttgtaagttggattcctaggtattttattctcttagaagcaattgcaaatgggagttcactcatgatttggctctctgttttctgttattggtgcataagaatgcttgtgatttttgcacattgattttgtatcctgagactttgctgaagttgcttatcagcttaaggagattttgggttgagacgatggggttttctaggtatacaatcatgtcatctgcaaacagagacaatttgacttcctcttttcctaattgaatgccctttatttccttctcctgcctgattgccctggccagaacttccaacagtatgttgaataggagtggtgagagagggcatccctgtcttgtgccagttttcaaagggaatgcttccagtttttgcccattcagtatgatattggctgtgggtttgtcatagatagctcttattattttgagatacgtcccatcaataactaatttattgagagtttttagcatgaagcgctgttgaattttgttaaaggccttttctgcatctattgagataatcatgtggtttttgtcgttggttctgtttatatgctggattatgtttattgatttgcgtatattgaaccagccttgcatcccagggatgaagcccacttgatcatagtggatacgctttttgctggtattttattgaggatttttgcatcaatgtttatcagggatatcggtctaaaattctcttttttgttgtgtctctgcctggctttggtatcaggatgatgttggcctcctaaaatgagttagggaggattccctctttttctatttattggaatagtttcagaaggaagggtaccagctcctccttgtacctctggtaggattcagctgtgaatccatctggttctggactttttttgattggtaagctattagttatatcctcaatttcagagcctgttattggtctattcagagattcaacttcttcctggtttagtcttgggatggtgtatgtgtcgaggaatttatccatttcttctagattttctagtttatttgcatacaggtgtttatagtatgctctgatggtagtttgtacttctgtgggatcggtgattatatcccctttatcattttttattgcgtctatttgattcttctcccttttcttctttattagtcttgctagtggtctatcaattttgttgatcttttcaaaaaaccagttcctggattcattgattttttgaagggttttttacatctctatttccttcagttctgctctgatcttagttatttcttgccttctgctagcttttgaatgtgtttgcccttgcttctctagttcttttaattgtgatgttagggtttcaattttggatctttcctgctttctcttgtgggcatttagtgctataaatttccctctccacactgctttgaatgtgtcccagagattctggtatgttgtgtctttgttctcattggtttcaaagaacatctttatttctgccttcatttcattatgtacctagtagtcattaaggagtaggttgttcagtttccatgtagttgagcggttttgagtgagtttcttaatcctgagttctagtttgattgcactgtagtctgagagacagtttgttataatttctgttcttttacatttgctgaggagtgctttacttccaactatgtggtcaattttggaataggtgtggtgtggtgctgaaaagaatgtatattctgttgatttggggtggagagttctgtagatgtctgttaggtctgcttgacagtggagtgttaaagtctcccattattattgtgtgggagtctaagtctctttgtaggtctctaaggacttgctttatgaatctgggtgctcctgtattggttgcatatatatttaggatagttagctcttcttgttgaattgatccctttaccattatgtaatggccttctttgtctcttttgatctttgttggtttaaagtctgttttatctgagactaggattgcaatccctgcctttttgtgttttccgtttgcttgataaatcttcttccatccctttattttgagcctatgtgtgtctctgcatgttagacgggtttcctgaatacagcacactgatgggtcttgtctctttatccaatttgccagtctgtgtcttttaattggagcatttagcccatttacatttaaggttaatattgttatgtgtgaatttgatcctgtcattatgatgttagctggttattttgctcgttagttgatgcagtttcttcctagcctcgacggtctttacaatttggtatgtttttgcagtggctggtaccggttgttcctttccatgtttagtgcttccttcaggagctcctgcagtgcaggcctggtggtgacaaaatttctcagcatttgcttgtctgtaaaggattttatttctccttcacctatgaaggttagtttggctggatatgaaattctggttttaaaattcttttctttaagaatgttgaatattggcccccactctcttctggcttgtagagtttctgctgagagatcagctcttaatctgatgggcttccctttgtggggaacctgacctgtttctctggctgcctttaacattttttccttcatttcaactttggtgaatctgacaattatgtgtcttggagttgctcttctcaaggagtatctttgtggtgttctctgtatttcctgaatttgaatattggcctgccttgctagattggggaagttgtcctggataatatcctacagagtgttttccaacttggttccattctccccatcactttcaggtacaccaatcagacatagatttggtcttttcacatagtcccatatttcttggaggctttgttcatttctttttattctttttcctctgaacttctcgcttcatttcattcatttgatcttcaatcactgataccctttcttccagttgatctaatcggctactgaggcttgtgcatttgtcacgtagttctcgtgctgtgtttttcagctccatcaggtcctttaaggacttctctgcattggttattctagttagccatttgtctaattttttttcaaggtttttaacttctttgccatgcgttcgaacttcctcctttagctcagagtagtttgattgtctgaagccttcttctctcaactcgtcaaagtcattctccatccagctttgttccattgctggtgaggagctgcattcctttggaggaagaaaggcactctgatttttagagtttccggtttttctgctctgttttttccccatctttgtggttttatctccctttggtctttgaagatggtgatgtacagatgagcgtttggtgtggatgtcctttctgtttgttagttttccttctgtcaggaccctcagctgcaggtctgttggagtttgctgcaggtccactccagaccctgtttgcctggttatcagcagcagaggctgcagaacagtggatattggtgaacagaaaatgttgctggttgatcattcctctggaagttttgtctcagaggaatacccggatgtgtgaggtgtcagtctgcccctacttgggggtgcctcccagttaggctactcggggttcagggaaccacttgaggaggcagtctgtccgttctcagatctccagctgcatactgggagaaccactactctcttcaaagctgtcagacagggacatttaagtctgcagaggtttctgctgccttttgttcggctatgccctgcccccagaggtggagtctacagaggcaggcaggcctccttgagctgtggtgggctccacccagttcgagcttcccagctgctttgtttacctactcaagcttcagcaatggcgggcacccctcccccagcctcgctgctgccttgcagtttggtctcagactgctatactagcaatgagcgaggctctgtgggcgtaggaccctctgagccaggcacaggatataatctcctggtgtgccgtttgtgaagaccattgaaaaagtgcagtattatggtgggagtgacccgattttccaggtgccatctgtcacccctttctttgactaggaaagggaattctctgatcccttgtgcttcctgggtgaggcgatgtctcgccctgctttggctcatgctcggtgcgctgcacccactgtcctgcacccaccatttgacactcccctgtgagatgaacccggtacctcagttggaaatgcagaaatcacccatcttctgtgttgctcacgctgggagctgtagactggagctgttcctattcggccatcttcacaaaaatcttactttggtttctagtgttaccacccactgttctttctcatctcaaccctgagtataagtacagatcacattccttgggttcttagaaaataatagaaatgaactctcattcatcaaaatgcccattagtaaatactgagggagaacaaactagaaatccagtatagaaaataaaaataggattatattccttggaatctcagaaaaaaacaatgaagagctttctttgggcattagacactttcccataaggtggctgactctcttttagtcatgtcagcttggcccaatcttcacttggtagcccttctttcttcttcattaatccatctcctatgctcctatggggtcctagagaaatgcccatcatgtacacacacatctaataacacaaagatcactctcgactagcaagcccttttatgatggtgtgagcatttgacacccttgttgctagtaacatcagtgagtgacctgacccatttttggaacagaatatgatcagtatgttgcctcaaggaggccctcactgttctaggaaatataattccagagtttgctgactcacaccatggaatatatgcataaaatggatcctgcagataagcctttctctgactagtttcagacatttttttctgggtaattttaaagttattttttatttttgtgggtacaaagtaggtgtatatatgtatgaggtacctgaggcattttgatacaagcatacagtgtataataatcaccagagttaatggggtatccctcaccacaagcatttatcctttctttgtgatacaaacaatccaattatattcttttagttattttaagatgtataataaattattgttgactgcagtcaccctgttgagctatcaaatactagatcttattcattctaactatacttttgtacccagtagccatcccacttcctcccctcccactacccttcccagcctctgataaccatcattccactctctatctctatgagctcaattgttttaagttttagctcccacaaatatgtgagaaaatgccaagtttgtctttctgtgcctggcttatttcacataatataatgtcctctagttccatccatgttattgcaaatgacaggatctctttcttttttatggcttaatagtactttattgtatgtatgtaccacattttcttcatccatttgtctgttgatagacaagagttgcttccaaatattgactattgtgaatagtgctgcaataaacgtgggaatgcagatctctttgatatactgattttctttctttagggtgtatacccagcagtgggattgctgggtcatatgatagctctatttttagtattttgtggaacctcaaatctattctacataatggttttactgacttacatatccaccaacagtgtatgaggatactcttttctccacatcctcaccagcattcattactgcctgttctttggatgaaagccattttaactgtggtgaaatgagatctcattgttgttttgatgtgcacttctctgatgatcagtgaggttgaggaccttgtcatatatctgtttgtcatttgtatgttttattttgagagatgtctacccagatcttttgcccattttttaatcagattgttagattttttttttcctacagagtgcttgagctctttatatgccctagttactagtccctggtcagatgggtagtttgcaaatagttgctctcattctgtgggttgtctcttcactttgttgatcgaatcacttgctgtgcagaaggtttttaacttgatgtgacctcatttgtccatttttagttgcctgtgctggtgcggtattactcaagaaatttttgcccagattaatgttctggagagtttccccaatgttttcttgaagtagtttcatggattgatgtcttagatttaagtctttaatatgttttgattttatttttgtatttgctgagagatagggctctagtttccttctgcatatggatatccagtttttctagcaccttttgttaaagagactattcattctctaatatacgttcttggcacctttgttgaaaataagttcactgtagatgtatggacttgtttctgggttctctgttctgttccattggtctatgtgtctgcttttatgtgaataccatgttgttttggttgcaaaagctctgtagtataatttgaaatcaggtaatgtgattcttccagttttgctctgttctttttcctcaagatagctttgcctatcctgggtctcttgtggttctatataaattttaggattattttttctatttatgtcaagaatgtcattgatattttgatataaattgcgttgaatctgtagatagcttcaggtagtgtggacattttaacaatatcaattcttgaaatccacgaacatggaatatccttctattatttggatgtcttcttcaatttcttatattaatttttttttagttttcattgtagagatatttcatttatttgactaagtttattgctaggtattttattttatttttacctattgacaatgggattgctttcttgatttcttttttagattgttcactgttggcatacagaaatgctactgatttttatgtgatgattttgtatcccgcaactttactgaatttgtttatcagttctaataggcttttggtgcagactttaggcttttccaaatataagatcatattatctgcaaacaagaataatttgacttctttcttttcaatttggatgcctttcatttctttctcttgtctgattgctctaactaggacttccagtactctgttgaataacagtggggaaagttaacatccttgttttgtttcagatcttatagccaaggccttcagtttttctgaatttagtatgatactagctatgggtctgtcatatatggcttttattatgttgaagtatgttccctagttttttgaaggtttttatattttaaggaagataaaaattgaactttatcaaatgcttttcatgcaacaattgaaatgatcaagtgctttttgtctttcattctgttgatacgatgtatcacactgattgacttgtgtatttagaaccatccttgcatcccgtggtaaatcccacttagtcatggtgaatgaactttttaatgtgttgttgaattcagtttgctagtattttgttggggatttttgcatcagtgtttatcagggatattggcctatagttttccttttttttatgtgtcttttgggttttgttatcagggtaatactggccttgtagaatgagtttggaatgattctctcctctattttttgaaatactttgaataggattgatgttacttctttaaatgtttggtaaaattctgcactgaagccattgggtcctgggctttttactgctggggagacttttcattacagcttcaatcttattacttgttattggtctgttcaggctttagatttttttcatgaatcaatcttcacaagttgtctgtttctcaaaatttatcaatttcttctaggttttccaatgtattgtcatccagttgctcataatgccctctaatgatgccttgaatttttgcagtaaccactgtaatgtttccttttttaatctctgattttatttgagctttctctttttttcttagtctagctaaatatttgtcaatgttgtttgttcatccacaaaaccaacttttcatttcactgatcttttgtattattttttccttttaattttatttatttctattctgatatttatcatttcatttcttccagttatttgagtttggtttgctcttgcttttccagttctttaagatgcattgttaggttatttatttgaacttttttgatataggtgcatattgctataaactttcaccataatattgcttttgctgtatcccataggttttagtatgttgtttagtatgtttccaatttggtacatttcaataaatttttaaattttcttctttatttattgacatagtcattccagagtatactgtttaatttccatgtggtttgtatagtttccaaaattcctcttgttattgatttctagttttattccattgtggtcagagaagaagcttgatatgaatgcaattgttaataatttttttaaaacttgttttgtgacctaagatatgatctgtcattgagaatgatccatatgctgaggaaagaatgtatattctgcagccattggataaaattgtctttaaatatctattaggtccatttaagacataatgcagattaaagccgatgtttcattgttcatttttctgtctggatgatctcttcagtgctgaaagtggtgtgttaaaatctctaaatattattgttttgggatctttctcttctttcaactctgataatatttgctttagatacctgggtgctccagtgttgggtgcatatatacttaaaattgttgtatcctcctgatgaattgacccctttatcattatataatgaccttctttttctctttgtgtagtgtttgtcttgaaatctattttgtcggatattagtattgctgctaatttttttggtttccatttgcatgaaatatctttttcattcctttattttcaggcagcgtgtttctttatatttaataggtgaaatatgtttcttgtaaataaaaattattattttaaaatatttttaaaataatactattttttaataagaacaattattattttttaaaaaatttcattagttttgggggcacaagtggattttggttaaatgggtgagttctttagtagtggattttgagattttagtgcagcagccacctgagaagtgtacattacccatatattatatatatactatatatgctttatatatatagtgtgtatatataatatatatacaactacatattgggtaatgtacacttctcaggtgactgctgcactaaaatctcaaaatccactactaaagaactcacccatttaaccaaaatccacttgtgcccccaaaactaatgaaattttttaaaaaataataattgttcttattaaaaaatagtattattttaaaaatattttaaaataataatttttatttacaagaaacataattcacctattaaatataaagaaacacgctgcctgaaagtaaaggaatgaaaaagatatttcatgcaaatggaaaccaaaaaaattagcagctatactaatatattatatatatactacataaagcatatatatagtatagtatatatataatacatttataaagcatatatatagtatgtagataatatatgtttatatactttaagttctgggatacatgtgcagaacgtgcaggtttcttacataggtatactcgtgccatggtggtttgctgcacccatcaacctgccatatacattaagtatttctcctaatgctatctttcccctagccctaccccactccctgacaggccctggtgtatgatgttcccctccctgtgtccatgtgttctcattgttcaactgccacttatgagtgagaacatgtggtgtttggttttctgttcttgtgttttagtttgctgaggatgatggtttccagcttcatccatgtccctgcaaaggacatgaactcatcctttttgatggctgcatagtattccatggtgtatatgtgccacgttttctttatccagtatatcattgatgggcattttggttggttccaagtctttgctattgtgaatagtgctgcaataaacatacgtgtgcatttgtctttatagaagaatgatttataatcttttgggtatatacccagtaatgggattgctgagtcaaatgatatttctggttctagatccttaatgaattgccacactgtcttccacaatggttgaactaatttatgctcccaccaacagtgtaaaagcgttcctatttcttcaaatcctcaccagcatctgttgtttcctgactttttaatcgccattctaactggcatgagatggtatctcattgtggttttgatttgcatttctctaatgaccagtgatgatgagctttttttcatgtttgttggcagcataaatgtcttcttttgagaagtgtctgttcatattcttcacccactttttgatggagttatttgttttcttcttgtaaatttgtttaagttccttgtcgattctggatattagctctttgtcagatgaatagattgcaaaaattttctcccattctgtaagttgcctgttccctctgctgatagtttcttctgctgtgcagaagctctttagtttaattagatcccatttgtcaattttggcttttgttgccattgcttctggtgttttagtcatgaagtctctacccatgcctatgtcctggatggtattgccttggttttcttctacagtttttatggttttaggtcttgcatttaagtctttaatccatcttgagttaattttgtataacgtgtaaggaagaggtccactttcagttttctgcatgaggctaacgagttttcccaacaccatttattaaatagggaatcctttccccattgtttgtttttgtcaagtttgtcaaagatcaggtggttgtagatgtgtggtgttatttctgaggcctctgctctgttccacgtgtctatatctctgttttggtaccagtaccatgctgttttgggtactgtaccacttgattggtgagagagggaatccttgtcttgcactggttttcaaagggaatgcttcagcttttgcctattcagtatgaccaatatgtagtcttttattcctcaccctctctcaacaccccacccccacggagtcctcaaagtccattatatcactctgtatgtttttgcgttctcatagcttagctcccacttataaatgagaaaatacagtatttggttttccattctttggttacttaattagtataatggcctccagctccatccaggtgtcttgtttttcatccattcagccagtctataacttttgcttggagagtttcgtccatttagattcagcgttatgattgataactaagggcttactcctgccatttggttgttttctggttattctgtggtcttctcttccttttttccttctttcctgtctcccttttagtgaaagtggttttctctggtggtgtattttattttcttcctttttatttttttttgtgtgtatttgttgcatgttattgatttgaggttaccatgaggcttgtacataatattttctaactcattatttcaaactgatgacaacactctatcgcataaaaaaacatggaaagagaaaactaataaaaactctacattttaacttcatctctctgcttgttgtcactttgtcgtttctatttacatcttattgtactgtttatgtcttgaaaagtagtttcagttattacttttgattggttcatctcatagtctttctactcaagatatgagtagttcacacaccacaattacagtgttacaatattctgtgtttttctgtgtactttcaattacccatgagttttgtattttcagataatttgttattgctcactaacatcctattctttcagattaaagagctccctttagcatttcttgtaggaaaagtctggtgttaatgaattccttcagctcttgttgatctgtgaaagtctttatttttccttcatgtttcaaggatattttcactggatagtctattctagggtaaaagttttttttttttttttcttcagcccttcaggtaagtcatgccactctctcctggcctataaggctaccactgaaaagtctgctgccagacatatatgagttccattctatgttacttgtttattttctcttgttacttttaggatcctttctttatctttgacctttgggagtttgattattaaatgccttgaggtggtcttttttggattaaatcttcttcgtgttcttgtacttggatattaatatctttctctaggtttgggaagttctctgttattatccctttgaataaactttctaccaagatctctctttctctctctgtctctctctctctctctctctccttcttaaggccaataacttttagatttgcccttttgaggctgttttctagatctcgtaggtgtgcttcattgtttgctattttttttttttttttgtctcttctgactacattttcaaatagcctgttttaaaactcactaattctttcttttgcctggtcaattatgctgttaagagactctgaggcattcttcagtgtgtcagttgcatttttcagcaccagaatgtctgcttatttttttttagattatttccatctctttgttaaatatatctgatagaattctgaattctttcttagtgttatctttaatttccttgaatttcctcaacacaactattttgaattatctgtctgaaaggtcacatatctctatttttccaggattgctatctggtgctttatttagttcattttgtgaggtcatgttttcctggatggtgttaatgctagtagatgtttttcagtgtctgagcattgaaaagttagatgtttattgtagtcttcacagtctgggcttgttcatacctgccctccttgggagactttccaagtattcgaagggatttggatgctgtgatcttagtctttggtcactgcagccatatctgctttatggagcatcccatgctcagtaatgctgtggctctttcagactcatagagttactgcctgcatgctcttgggtaagagccaggaaaattccctggattaccaagcagagactcttgttctcttctctcactttcccccaaacaaatagagtctctctctctctctctctttctctctctctctctccctctcattctctgccgacctgcctgaatctggggtagggatgacacaatcacatttgtagtcaacaccattgggactgtgctaggtcagacccaaagctggcacagcactgagtctcgcccaacgcccacagagaccactccctgggtaatgtctgtgtttgctcaaagcctaagggctatacaatcagtcagtggtgaagccagcctgtcttatgtccttcccttcagggtgatgagttcctcaagcaggtccagggatggtgtccaggagccaaggcctcgagctgtgactgagctggcacccaatccataagacaaagattttttccacactttccttccttgtcctcaagcaaaggagtctctccctgtggccaccaccacccccatgttcatggcaagtattgtctggctaccaccaatcttcactcaaggcccaggggttctttagttagcttatggtgaatgctaccaaggctgagtctctcccttcaaggaagtgggctcctctctggcccagggcaggtccggaaatactatccaagagccaaggcctggaatcagtttccccaagagtccatttggtgctctacacccactgtggcagaaccagtacccaagctgcaagacaaagtcctctttactcttccttctcctttacagagactctccctatagccaccacagctgggaatatgctgggtcactcttgaagcaagaacagctctgagtctcactcaaaactcctggcaagtactgcctggctatcacactgattattcagggcccaagggctctttagtcagcaggagatgaatcctgccagtactgattccttcccttcaaggcagccggtttctttctggcccagtgtgtatctagaaatatcatttgggagctagggcctggcatggtgacctcaggactctgcctggtgccctgttctactgtggctgatgtagtatccaaattgcaagaccaagtcctctttactctcccctctcctgtcttcaagcagaaggaatgagtccgccctggagttgggagctgcattgcctgggattggaggaggggtggcacaagcactctcttggtcaccccagctggtgtcttactaggtcgcatgttccccaagtccactggctctgaggctagcacaccaggatttgaccaagaattgcaattcttgtggcttacactgcctttcaagtttatttgagatcccagagcactttagcccacagtgacagggcttgccagaatttagtttctgactgctgagatggacaatttgcgtctgattagggctggtctaagtgctccttctgtgggcactggctgagttctgctccatgttgctttctgctgtgacagggcaacattgagtttcaatgcaagtcccacagtcactgcaatcttcctctcccaagcctgctctgaacaccatgtggttgctgctgggggctgggggagggatgttgtaggcaattcaagaatgtctttcctacccttttcggtgcttctttccttggtatgatattaaaaccagttactgtgattgctcacctgatttttggttcttatgaaggtgcttttttgtgtggatcactgttcaatttgtgcctgcaagcggggatgggggacaattgctggaggcttctctttggccatcttgctccacctctaccctagtattagcaatttcaaagcagttgggatggaggtagaaggaaagggcgcttggaatcagaaaatccatgtcttagctttgagccttagaaaattcatttgacccttgtaagcctcagttgcttcatctgtaaaagagaaataatataatggctgaaaagatcaaaggtgataatgcttttgaaaacactatagaaaatgacaaaatatcacatgagtattattttctagtttctaggagtctccttaccattgtacaggacaaccatgtctatttttaaataaattattatttgcctctgagcaaccctgcaaagagttgcctgtaggagaaacagctttacttgcaaatcactccactgttttctttgtgcacagcttattaatacataaggcacatgtcctccagcctgcagtaacattggaatcattacctctttggagtacctaccagagcttctcaaagtgaattttgtttatcaccacaaaaaatagtctgttgcagagataacctccaaattcaatgacaatatttccaatcacttttgcatgatgcagaaatagacaaatatataattttgcttatagagacaattattgtctcccaacaagtgatcagtagtcagaaaatggccaagaaataccatggggtgtgccttcccataacagcttatctttgtgttttagttgcaaggttactaaaagcctgtgcagggtttatggcaaaagtaaaacttgctccaggagcaagcccttgtttcattgtctaatgttcttaatccccagcagacaggatttggatctggcatttggtaacagggcagtttccaaagttgctgtacgcaacttgaggaagagaggtgatattatcggaatgaatttctttgttgtaagttataaatgtatgggcttttccaatcccatcacccttaaaactttatttgttttctgcagtgagggtgtctccgttgtctttaatatgcttgctttgagttcatggatgaacattcctgcctggctgacatgtggactctctgaaattgttataaggtctttttctttgtttttttcttgatgcccaagctgccaagggtagtactggcagtggtgggcagacaaggaggtgatagcaaactttgtcctctggcctcccttgacccattccattcattatctaagggactccaagccagcattccacagagtgccctcaccaaactcactaagactgaaggcgaaccaggattccaaacagccattatgaaaggaaagagagagagacttagggtttgcaaaataagataccctgttgattctttttattccatacagatactactattctttaggaaaacgttaaaatcacatgatcttccaggacctgggctgcttctttaagaagcatgttacagaaagctttattggccaacaacatattgaaagatagattaatcaatcattcattcaaataaggtatattcagaattgaggtatattgtagccagacagtgagactacaaaaaaagaatgcaccgtacccttatctcttgcacaatctaacgagggagataaccactctttcaatttatagtgacctataacatttcgtacactgctgaatatctttacatggtaataacacaatggaaagcttgcaaaatagacagaggctaggggaagaaggattgagtgtgaatatagcctcttataaatcgagaggaatggtctgtgtcttctgatcatacagagataataaatatggaaatgatttcaaactaacaaagcaaatgtgcagaaaatactgagaatatagtgggcaggatacctgagttttggttccatctctgttattgactcattgtgtaatctgagtcaggtctgttctgctctctggatctcaccctttcctatctgtaaaatgagattgttggattagatgatctccatagaggttctcacctattctgacattcaaaaggactcctaatttttcttatataataataatatatatgatctgtagagtgctttacactttatatgatatttttgcatctgttatctcatgtgagaaaagcactggactgctggactggcaatgaggacacctggattcttgtctctgttttgacactgattcatggtgtgatcttcaagcaaattctctgagtttcagtttctcaatctgtaaaataggggggtatgaagattggactaaatcagtaggtctctaaaatgttccacaaagccctggggtggggggctcctacagagtttcgctaaggcaaaccacaacgctaagcctgcatggaagaggagaaaaagagtggcctgacaagagaagttcccagtttcctatgccaaccccaggcagattacatttaattttatctgatttatatagagagtttctatgtaatgttttattcttaaaaatagtttactataaaaaactcaactggtttgatttttaaagattgcacatataagtgagatcatgcagtcagtatttgtctttctatgcctggcttatttcacttagcataatgtcttccagcatcatctatgttgctgcaaatgacagacttttcttttcattaaaggctatatagtattccatcgtgtatgtacaccacattttctcttttgtaactttcattttaggttcaggggttcatgtgcatgtttgatatataggtaaactgcatgtcagagaggtttcttgtacagattatttcatcacccaggtaataagcatagtatctaatcaatttttttctgatcctctcccttctcccaccctacaacctcaagtaggccctggtgtctattgttcccctctttgtgtccattacaccacattttctttatccacttatccatccatggacacttagtttgcttccatatgttggctattgtgaataatgctgaaaaaagtcaaactcatagaagcagagagtagaatggtggttaccagggactgggaggcagttgactgagctaggaaaagagagataataaaagggtacaatgtgtcagttatatagaaggaataagttatattgaactattgcacagcatggtgaccatagttaataataatgtattatatgtctcagtattgctaaaagagtaaatttaaatattctaaccacaaaaaattattagtaggcaaggtgatggatatgttaatttgcttgatttaatctttctagaatgcatacatatatcaaaacatcccactgtaccccataaatatatacaattattatttgtcaatttagaaatttaaaaacttgatttagatgagctctaaggccttaagtattaaagtattaagtattaaagtgatatgtaaccaagtatattgtttggtaacttcatttttgttattattttaacaaaccaatatattgtgaatatacttccaagtgaaaagaaaaaagacattgcagtcatcactaataactgcaaaacattcctttgcaagaatatggaataattcatttaatcattcccctaatgttagacattcaaatgtttccaactttttctatttaaataatgctacaataaacttctattttgtgcttattgtattattttcttacaacacatccctagaagtggaattcctagaagtttatacacatttccaatttttttccaaatatatggcaaaatttctctctaaagtatttttattcctaccagaaatacctcttcaccaacacgtagtatttaatctgtaccaatctggcttaagacaatgatatttaatttgtatttctgtgatttctagctaaattaaataatcttcatatgcttattggtcatttgtacttctaactgctttctcctgtctgttgcccatttttctattgtgctgtttatttttatatatcgaatatattgaccattggttttacatacttgatgctaataattattcttagtttatggtttgtctttgagttttataatggtgtttatttcacataagaaattataaatgttttctaatgaaatttatcaagtctgtcttcacttatgttttcttcattgtcaataacttaaaatgaccttttctacctttaaaaattttgaaattttcctctgtattgtctaatagtacttacatgatttcctcttttaaattgacatatttaatccatttggaatttattttgattttaactagtaatttaactttattttcttctccaaatgattcactagttgttctgacattatttagtgaataattcatcctttcttcactgaattggaatggcatattccatatactgtgtctggttttggcttttctgatctcttccactgatcaacctaagctggagccagtatcaaactgttgtaatcattatgcctttagatactttaaatgtacagcagggaatgtcttattactcttatttttcacaaatatcttggcattgtctcatgttttattccttcagataaattttgggattattttgtcaagattttgtttgagttgttttaaatttttagatttcattgggaaagaactgaaatccttgaaatattgcttcttcttagccaggaatatggtacaactttgcatttaattcagttctttccttaaataccaccatgaagttttttgttttgttcatataggtcctgcattaacaccatatatataaagtgtgagaaatactacattcttcaggattctctgtaggttaacaatgaagatgatgactcaaccctttctttgtttgcataatgtgatgccactaatagtgggtaacttctctgccttacctcctctgttccaaacaggatttttcagaatgaacaaattaaaagaatcataatcagacactaaccccaagccatactgcatggcagcaccaatgggactgacagaaaacaacagaaataggaagaaatcctacagagaaacaaacttgaaagctgtctcatggcctttgaatcatacttaagttttatgatggaaggatacgactatgaagaaagacacagagcaacatcagacagtcaagaatttcagagccagctggcatgcagtggacctcatgccagcccattttatgactatttaggtagtcaagggtttaagatttttctaataagacagttattatgcatttcaatgagtgatttctttgcagctctagagtgtggccttacctacttcaacatgagaagatttttgtattttgtcagtcatttcacaatgacttttagtgagcccttcattatagactgtggatacaactttgctgttggaaattaacagtgtcaaacaactgggtataatgtttgtaatatctgaggagggggagctgcctaggaagttgtattccctgtgttaatttttcagtctcttaggttatagaggaccttctagaaccaccttacagcaggattacatcccatttacacagttctctgtcacttgaatacagagaagggatccacaaggccatatgcttcctagacaaagagaaaagatttctgccacactcagaacgctttgtcttcagactataatcacccacaccatatttcctttggatccactttccagatttttgtgctggcactaacaccaacttgctgtggcttggggcatgtaatttcaatactttgtgcccattttcataagtgaagtgtcaggcatcacattggacattttaagattctttacagcccaatgattctgtgtttctaattaggcccaatgggttagagctaaaaggaaacagtgagtttcctggaaggaaaggacatataacacagtccagaggtaaaatgggctgtattcaagaaaagataggacaatactttgcagggatgctgcagagaggattcaagccttgtatggaggaatggatgtgatacaaccaaaaagtctttaaaaattctttccaactaatctgagatttgtaaccttatggactgtgatttgcagcaaaccaaggatgtgataaagactagtattgtttctagaatgcaaggatggttcaacatatgcaaatcaatagtattaacagaatgaaggacaaaaactatatgatcatctcaatagatgcagaaaaataatttgacaaaattcaacatcattttatgataaaatctttcaagaaattgggtattagaaggaatgtttctcaacacaataaaggccatatcagacaagcccacagctaacattatattcaatgaccaggaatgagataaggatgctcactctcaccacttctgtttaacatagtactggaagtcctagccaatttcatattaatgagcctcattttcttcatcatagaatgaagtatataataatccctgttatacttactttgcacagattattattattatttaattattattttgagacagggtctcactctgtcacccaggctggagtgcagtaccacaatcacagcttacttcagccacgacctcccaggcataaaggatcctagcccctcagcctcctgagtagctgggagtacaggtgcacaccaccacacctagctaatttttttttttcatttttttatagagacggagtctcactatgctgcccaggctggtctcaaactcctgtgctcaagcaatctttccaccttggccttccaaagtgctgggattacaggagtgagccactgcacctggccttgcagattattattaaactttgtaaactaatcaaatgagagtgattattgttactgttaagaactctgatagcctcatccatatatttggagaaattgaataaataataggaaagaaataatagcatcccaatgattttaccttggctctaccatcatttggggaagtgataattcagataggagaagtgacttggaagcagtcttgagagattgcctgttccatcccctatctttgtccttaaaccaaattgtacagataaataaggtcttatttttaggacttacagaaaaaagattcctttcatatccatctttgcaatcctcaaccacttctgtcactattatgtgtcatttcaaacattaaattcctcattctgctttgaaggaacacatgtgtcatgtgtacccatttgtatgttttggtgtgttttatgctttatgtgatcacccacatatgcacagataattccaaaatccagtgtgtgggtgttgtattccctgtgttaattattcagtcacactcaaacacctatgcactcacacatacatgaatacacacatgtacattagcatgtttatgcttatgttgcatgtgactggcaacatcagtgcctttctaaggcaatgttaactaccttgagttttgggagagctttagagaacaaagacaagagactaaatgattctagatgtaagagacaatgttgcaataagttactatcctaaaaagacagaatacagggacaagagactattattttggatagtttcttgcttaccagtaatacttaagtcctttacattaaaaaaaaaaaactctgtaaatatattgcagaagaaatccagacatccttcaagattcttagagctggaaaagattttaatgactttccagtccaatctatctcatgtaatcaatggggcccagagaggcaaaaggtcttgtccaaggtcatatagtgagttagtgataaggctgaacaaggattcagatgttggggcttccagcccactgctctttctctcatctgggatttgtgtatttttgttcattagagattttcctctgtaacctcaatatccaatgcagggccttgcacataatagattatcagtaaatgttaaattaatatgtcatggctttggttgtactgggcttttgcacttactcctgagtaaattgtaaagaatatctacgttttaggttgccttgttttagaccaagaggtacccagagaaaaggtgtgaactatgctaaggaaattatccgagttccaaattgaaaaaaaaaaaaaatcatgcttttccgctataacctctctcattcacagagtgattctctttcagaagggcaatctagaactattatgggagccatattccattggtggtgcaaccatttcttgacaaactagggtccaagaaagtattttcctggggaagatgagatttctcaaagaaggcacgcactttctaacctaagcttatttcagtaatcaatgtaacaagctggtcttgatgattgcagcagtaccaatactgtgggagtgtaccagttctagaacagctacaacattggaattgaacgcactagaattggatacaggacctgtttttgaggagctaacacccaaaggctgaacagcactcgtagcaccgtcctttctgtgcacatatggtagtcctcagtttgcaacagaaataaagctgttagcaaattatgtgttctatttatgcaaataaaatcttgtggtatgctagaaagagcactggcctggagaccttagttttctcatatgttaaaaacccctaacacaggcctggttcatagtaggcacccaataaatagtagttttcttcctttgggggcctccgattcagtgtgcttcttcaggtaagtcacttccctggaactcctccttggaatgagagttgtactgttgtgatttttaacagttccttcaagccaagcattttggaatcctttcataaagggagaaaggaaggaaagaagaaaggaaaattaaaggaaaaagaacaaataaaacgttaaaaaggaggaaaggaaaaaggatcctttactacaataaaactaatcttatgttcttgcaagtagcactttaagtaaaagaagttctttgctgacctggttactactgaacctactacataaaatagcctactataatagatgcatttatgtgcctaatcttcactttttaggcttagtaaagggagaggaaagctgatgtatagttaaatttatgtttttagttgtttttttttctactctcaaatatcaatcactctttagtttctctttctttttccgaccacaagcattcttcctctgcttaaagaagcttccctaaaatcccagtctatccagtaagccaaagcacagcaataaatttgaggaaaaaataccagggacttagagacagaaaggagtgaggggatgcagaagctgaagctggagcacggttgcaagcatgagaagttctgcgtgtttcagagcagccaaggatgtatttttgcctattcctgctggtgactctgtgtgtctatgcatccatctgctatatttacatgtttagtcagtcaatccacgtttgctgagagcctgctgtgtgccaggattgtgctagcgtaaaggagcaaagtattgagcaaaatatgtttgagcagctgtaattctgaggatctctaggtctgagcatgtgtatgtgtgtgcgcttctatgtatctgtgacaactccaggtgttcatgacagtgatctttgttactctgttggcttcatcgaacttccttttacttgctgtgattcactacatagagtgggctttatctctgatttttataacctgcaagactgggggtatgatcaccagcaatctaaaaacagttagaaatcccatggagttatcttttgtagaaattttcctctactaatattatgaaaaataagcatcttattagctcgagtgtaattctatgcatgattacaggtatcaataggaagaaacattgactgagttcaaatctcttctacgccatgctaaaggggtgacaagttccacaatggatcattttctcatgggcatttctgacttttggtaaaagtagagcaccttattttaaaaaccattgagtagtcctaatagtggagatatcatcaggatctgaattgttcatccctaaaaaaaacaccaatggaaatcaaacaatatagtgccaaattaaactgtttgaatatttaggttctgtatgatcaaattgtttggtgccatactctgtccacttttttcatgtggtaggatataatttcatatcttttctgttctagaaatacccgaagaaagagactctggaaactcattatcaggtctatcaactcttgtatttgttctcccagggaaacagaagtacctgtgcgccagcagaaatgattgcactattgataaattccgaaggaaaaattgtccatcttgtcgtcttcggaaatgttatgaagcagggatgactctgggaggtaagatacttttctttctcttcctcctccttcctctctcccccttctccctcattttctagtctctctttagaccagattttcttctttgatgcttccaaggggaccagccatgctctagacacaggctgaccctttcataggcaacgtggccatcagccagctggtgccttttttttaatccttatctataccaatccccattccggggctcagcattagagcaggcggtgtgaagcagggatcaggagccaacagaaggtgagtgaggatgcatctgactgggcagggcccccaggggacttaatgatactggcctgatgttgttcagtggtagctaggatgagagaactaagaaatccagaacagtcagaggtgcaggatgacccaggcataggcgcaggatgacccaggcacaggctgatcctgaacacctgggaatatcccttagctaactgctgcctatgttgtagggccagccacctcgaatgagaagctacttctctttggagcctgtgactaggctgccacacagagccaatttcctatcctatctctcccaaagatgagcaggtgttttaataatttccttttctttgcaaagctattgaccatttccaaaagcattttttttcagtagcacagtaacgtgatagatggaagatacagctctttcaagggcgttcctctatcataaggctctctgtcccacaaacctgtctaccatgagtgttgtcaccattccagaaaggcttgacatcagttgattgagacttatattttccctctccaaactcccccatctcttcatgtttacatctgcccaatgccagggtcctcgctgctgcctgctacttccaaaaagatgtgtctttcatgagaaaaacaagatcattaatccacttcgatttggaaatggaatttgaagaaaggcaagcctatttctgagtgcctgcaactgtagcctcatacccaattattcattattagcctggaaaacccaagtgcctagaatccaaccctctcccctctcctcttaagtctaatttagaccagttgtctatctctggctttctgtgaggtgttcaataccttgtctgcctatgtgcacatttatagacaacaactagttctcttatcctggagcagggccatgtgtggatcttcatatagataactatatcctccccatcctcacagggcagtagtattatttaaacagaacaaagtacctcacatgaattgacccaggctggatgagagacaatttcaaaagaatcatctcaagtagcgtccagtactcccaaacatcacaggtagatgttctgtgagtggctttccaagcatccacatcaaatgagactcagatatctgagaaaactcaaccttgttttggtttgcttggtgcaccccaaagaaatccaacaattgaggtctacagtggagaagaagtaggactggggtcagggagtacagaggcaaaggcaggaagggtgacaaagtgattgacaagaaaaaatgttctccatatgaatgttgcagccccatgttgagggttcttatacactcaactgtcaattatttagccttctgtgaattatgtatagtataaaagatagggactctcaagtagggaacctcttggcttgccatctggcaatatgaattgcaagtccactttgatgcaggtaaagtttaatggtaacaaaagtcctcataacatttggatgcaaatcttaacattaattccatgtctcagccaacattctccattattaagcagcctgtgatgtgattacagtgaaccacttttgaaaaggagcctgtgtataacagatagtttcactatactatataaccgtcagatgcaggcttgtaaattaatttgttggtgacaatgtttcagtacattttcaaattgattcattggtatagtactcaaatttgagtgggcttggtgaacacaatgaagacaagctgagaagtgctgtgactggccttcatttcagttgcaggcccatgatattttgagtgtcttccatgtacaaggcaccatgctaggcattagagcttgaggctggcaaacttcaggaagtgttcacaagataccaggattcttgatgttgtgtaaatggccttgcctttagagtcaggcagatctagtttaaaggctcagctcctttatttactgtgtgcccctctgagcctcaatttcctcatctctgatttagaaataccatcctcatagagttataatgagtatcagatgacatgatgaatgtgaacatccttgataaatagcaaaatgctagacaaatatgggggcttaatatgacattgaggtcactagtaatttagctggaaagtctgtaacacagcacttcccgatggcttttaccctaagtaacttggtatgccatataatatgtaacagcaccaacaggcagagaatcgccagaaaacactcttgattacctcaaacgaaaaagtaccaccaggatcctgttcagaagctaattttagtaattaagggaatcatatgctatgttcaaataccatgccagtaaaaacccaattgtttaccttcttaaatcactgcttgaagagcaaatctttccattttgctgaatgaacttatctccacgttccctgccctactgacacaaccccctcccaagtttattgttaacttacacattcaatgcacagcacacctttactcaaacaatggaaaagaaagaaagtgtcaattcaaagtggcccttgtctattccttaaggagtagacttccattttcatcagatttggatttagcatagacatattgattaccttgaagaagaattcatataattttatcttctgattcccatcactcaaatcaaaattacataatatattccaaaatggcaactaggaatgtggccttgggcaagtcccttctctcctctgatgcttggttttcccatcatagaactggaattgtggcttcaccgaggacctttctggtgctaacattttgtgattctatgtaaaaagccacacagaaaggattgtttttcagccctttcttagattgtctgttccctgctcccagaagtatagatagtgagacttgagtgctttgatacatcgtaattgtatctacctccattcacacctacttaagatatctgtctaaaagtagactagacagattattcagagagtggagggcagaagggctgtctctgtatcttaaagaagctggcactcttcagctgatggctgcttggtcttgaggcctcaagatctttaatctggctttctctatagtgtttcattcactgtttggtgatggaatctcttcagttcagagatacttaatagatatagctttttctttcctgcttccaggcctacctacctgtttcttgcttttttttctagcagctgttgttgtttctgaaagaatcttgagggtgtttggagtctcagaatggcttccttaaagactaccttcagactctcagctgctcatccacaacagagatcagcctttctttgtagatgattcattcctggctgcatttgaaaaccacatattgttaattgcttgacgaatttaaatcccttgactacttttcatttcagaaaa

SEQ ID NO: 4660 - DNA, 180245 bp, human
gagatcccggggagccagcttgctgggagagcgggacggtccggagcaagcccagaggcagaggaggcgacagagggaaaaagggccgagctagccgctccagtgctgtacaggagccgaagggacgcaccacgccagccccagcccggctccagcgacagccaacgcctcttgcagcgcggcggcttcgaagccgccgcccggagctgccctttcctcttcggtgaagtttttaaaagctgctaaagactcggaggaagcaaggaaagtgcctggtaggactgacggctgcctttgtcctcctcctctccaccccgcctccccccaccctgccttccccccctcccccgtcttctctcccgcagctgcctcagtcggctactctcagccaacccccctcaccacccttctccccacccgcccccccgcccccgtcggcccagcgctgccagcccgagtttgcagagaggtaactccctttggctgcgagcgggcgagctagctgcacattgcaaagaaggctcttaggagccaggcgactggggagcggcttcagcactgcagccacgacccgcctggttaggctgcacgcggagagaaccctctgttttcccccactctctctccacctcctcctgccttccccaccccgagtgcggagccagagatcaaaagatgaaaaggcagtcaggtcttcagtagccaaaaaacaaaacaaacaaaaacaaaaaagccgaaataaaagaaaaagataataactcagttcttatttgcacctacttcagtggacactgaatttggaaggtggaggattttgtttttttcttttaagatctgggcatcttttgaatctacccttcaagtattaagagacagactgtgagcctagcagggcagatcttgtccaccgtgtgtcttcttctgcacgagactttgaggctgtcagagcgctttttgcgtggttgctcccgcaagtttccttctctggagcttcccgcaggtgggcagctagctgcagcgactaccgcatcatcacagcctgttgaactcttctgagcaagagaaggggaggcggggtaagggaagtaggtggaagattcagccaagctcaaggatggaagtgcagttagggctgggaagggtctaccctcggccgccgtccaagacctaccgaggagctttccagaatctgttccagagcgtgcgcgaagtgatccagaacccgggccccaggcacccagaggccgcgagcgcagcacctcccggcgccagtttgctgctgctgcagcagcagcagcagcagcagcagcagcagcagcagcagcagcagcagcagcagcagcagcagcagcaagagactagccccaggcagcagcagcagcagcagggtgaggatggttctccccaagcccatcgtagaggccccacaggctacctggtcctggatgaggaacagcaaccttcacagccgcagtcggccctggagtgccaccccgagagaggttgcgtcccagagcctggagccgccgtggccgccagcaaggggctgccgcagcagctgccagcacctccggacgaggatgactcagctgccccatccacgttgtccctgctgggccccactttccccggcttaagcagctgctccgctgaccttaaagacatcctgagcgaggccagcaccatgcaactccttcagcaacagcagcaggaagcagtatccgaaggcagcagcagcgggagagcgagggaggcctcgggggctcccacttcctccaaggacaattacttagggggcacttcgaccatttctgacaacgccaaggagttgtgtaaggcagtgtcggtgtccatgggcctgggtgtggaggcgttggagcatctgagtccaggggaacagcttcggggggattgcatgtacgccccacttttgggagttccacccgctgtgcgtcccactccttgtgccccattggccgaatgcaaaggttctctgctagacgacagcgcaggcaagagcactgaagatactgctgagtattcccctttcaagggaggttacaccaaagggctagaaggcgagagcctaggctgctctggcagcgctgcagcagggagctccgggacacttgaactgccgtctaccctgtctctctacaagtccggagcactggacgaggcagctgcgtaccagagtcgcgactactacaactttccactggctctggccggaccgccgccccctccgccgcctccccatccccacgctcgcatcaagctggagaacccgctggactacggcagcgcctgggcggctgcggcggcgcagtgccgctatggggacctggcgagcctgcatggcgcgggtgcagcgggacccggttctgggtcaccctcagccgccgcttcctcatcctggcacactctcttcacagccgaagaaggccagttgtatggaccgtgtggtggtggtgggggtggtggcggcggcggcggcggcggcggcggcggcggcggcggcggcggcggcggcgaggcgggagctgtagccccctacggctacactcggccccctcaggggctggcgggccaggaaagcgacttcaccgcacctgatgtgtggtaccctggcggcatggtgagcagagtgccctatcccagtcccacttgtgtcaaaagcgaaatgggcccctggatggatagctactccggaccttacggggacatgcggtaagtttttccttccagaaatgtcgcctttcggcccagggcagagtcactctgtgttctggggtatctagcggctcctacctgcgcgaacactcagattgcccctgggagagctcagcagggtaaacctagagctctcccgtggactcccggcctgccagaggtttaacctgagctctcctaatttctgctgcgtgccctgggtgctgattcctgccctcccagattcttcaactcccccaaccgccccaaattctcactacctcctggtactcgaggtcccaaacagaaatcctattgcacgggccaccttcagagataaagctcccaagccctccactcttcctttcctcctgtcctcaaagtctgagaacctcaacaggaatttgggcaatttctcctcttcaggtctgttaggatttcactttcagcctgcgcagattagagtcaaaaagaccggcccaatagcttctcagcgggtatcctccagagaggtaaagtgaaattctcggttagggaaagaaagtggtctctgggtgctgaggtctgctgtgtgaaagggtgaacttctttctcctgaagcaactggggacttgctccagggctggaggtcagtagagataatccaaaccgtcatgtttagagtaggcagaggggcaactttcttggtaaagacttcacaggatttgcactcacagtttctcaacgttggttgactatgttgaaagtagttgcttgggtcggttttctcttgtaaagtgtttattttctctgtggattataacagatccacagccccctacttcaggtttgcatcagatctataaagaggagaatattcttttaatgtacaatttaattaggcttgactctgacttacaaaactgttggaaaacatttttttgtaaagcatttcctgctatttcagtgtgctccaaaatctccactggggagggtggagtgaggttttttattatattcctttatttttaggacatgtttgcattttagaatatgtgcagttagctctaacaaattgagtaagaactcttaatgacctatgagccgtaatcttaccccaaagttttaattagcatatgagaaaagtggcaggcaattgcatcgtgcttattaaaaattattcctcaccgcagttgttgagcttcttggagaccatgctgaagattttctcccccagcaaattaagatattagtttatctgctgagggaggacagactgaattggggaattaactcctcaggtaggccaggtgctgatgtccctgtggacttttgtcttattctttgtttctatggctgttttcttttacctgtgacttctccgaaatttctttgttagccttaacatctttgtttggggacttaaatccagcaatttgccttctttcactgatgctttccttcttacaaggtagatagcacagtgttagtaaagaaagaaagaggagggtaggatttcatattatttcgtgggctgttgaagaaacagcttcttaccaggctttacattccattaggtttttaatgtttgacttacaagattttcagagggttcatttgatattgtcaaagtcttttccagttaatttagactcttcatttttgtaatgggtttatgctatgggacaaaaaaagtattcttcattttataagaacaaatttacttggtagggttaattttttttctagggctgtcactagacggtggagcccctcttctactgtaaacttttcttgggggaaaatgtctaaggtgcattttgacctgccatgatactaaacccagacactggaaccttccatcttctgcatgcctcccccacaacttacttacttaacagggaaaaaactgatggttccacatatttgctaaaaaatgtgtgccttcaaagacaaaaccaaaatttttagggaataactatagagagcaaaagttactcccatcaagtagacaacgagcttggtgattttatttcaggtcttaatgaaaaaagcttctttatgaggaaggttatcatatcttggtgcctccttgacagtccgcttaaattaatgacataaactaatgagaatttagcagttcctgcagaaagtacaagtttattttttttttctggtttgtgattgctgcactgaatatgaggagtctagttaaagggacaactggtgttcctgtcttgtgagttgacgaagactttccatttctaggatatagaaaatccttaagccggtttattgaaaattaatcaatttaatcagaatgcaatcaattccaatacaaaagttagtattttctttctttttattgaaaattaatttaatcagaatacaatcaattccaatccaaaagttgatattttcttactttctctttttttccctcattttgtagggatacaatttggtgaaaggcaagagatttcttaagccaaagcaagagtgtcttccctctctgtgttgcatgcattatgtgccatgtttgagctaaaaatctcaaaattgggcaggcttccaatgacctgttgggtccctccctttaccattcatgtgtgtgtttatgtacataattttgtggaggggtttttttaaaccttagtaacatctgcactcactctgtgttcttatacatttacagtgtttctgctgagaggagggaagatgcaaaggtggtctcttttacttaatttagcatgtggtttgaacagaaggaaaaataaaaagtgatggggcttgtgtgcaaccctgatgatattttatggagctgtctgtcttctctctgagatcaaacaggactacaactttgttaattgaccactggctcccttggcaaaagtagggcttcttatattccagcaagcagcacaataatatgacaaaaatttattcttgggagttgggttctaagagagtgcatgccagaattagagtttggggtttagagaaattatccagatgccaaaagaacattttaatttttctcttggtaatttgttctggtctccatagtaggtagtattttagtagtgctttgatattgacaagtcttgctccctttctctattagatttttcaaaataaggcattttattaattcctctttccttctcctctctcctctcagttatcaagcatttttatgactatcttacaagcaacagtttgtcttgtaaagcagaattttcctttgaaaccaagacagattatttctgcccataggcttcaggaaccaatattttggcaagaagcatcttttctttgtggtcagcaaataggtggtgagttctgtctggatcccaacaatcaacacctgaggaccaaatagccacactgggtggcaccccattcggaagtatacacaggaagtagccctcttgcttgttcacagctcaagtcagccaaagattaacactggtgagagatattttcaaagaagtttgcaggcttccaattgcagggtcattttggggtgctttcttgcctgtactaattttatctcatcaagcttccattctttgagctgtaaactttgaaataatatactggatttgctggtacgtttaattttctttgttaagtgttttcattcccatagtaatttttcatctagtgtacatatatgcatttaaaacaaaaattctttggtctccttatgcgtatatgcactgcggcttgtacacgtacaagctacttggtgggattatgtgaactggagttagaaatgtggacaattttattatgattatttttaatggtgatatcaagatcaccagtttcattcggaaccttgcataagcagggagcagaatgcggactgggtgtggcaaagcaagggcttattttatagccaaacctgaaatcacaactctgaaaaataaaaaaaaaaaaaaccaaacaaaaaaatcaagttttgtgagcttggtcagagaaggaaaaggaaatctctccctaccccccacctccaccattttctctttgtctgcagcttcctcaagtgctgcctgtccccgattttcttttattccactcctttcatgtttttgacattgaaatacagactcttctttccacttctcagggtatttttcttattacacctgtggcatgctcctaaagaatttcttttttaaaaaaaatctgtagagtagtagattagattaaccccagtatctctcccttaagactagatgacatgaggggattgcaaaatgaatagctgggtttttttttttttttttttttttaccttgaggttaaagcctggttcaacagttgctgagagagttaactagattgcttgaggacttggcaatttcataaagtattttgtcttatgctgtctctgtctctgtcttgatctctgtctctctctgtctactgtaatgttggctactttctctcagagcctgagagacagctctgagacacttcccaggtctgttcggttcagacctcagtagctggatcacaagcagtacccaatatgcatatgagggtgcgtgctgcaagtgtccggctgggctaatctgcttaagcttcataaaaattaatcatttgaaaacaaagaaagatattaaagaaattattctatctccgacttcccctatcagcattccatcaagttctgggatgttaaattcagagaaagttaaccttatcttaaacacaaagttgacttttaaacaaaattgcttataaagttctgtacagttaccagcattggttgccctttgtcgtacggaagagaattatgaaatctcatatttacatagcattcttccaaaaaaagagacggtgttttccagtttattcactgcattcgtgtaagtgtgagtaggccaggaggggtgcttagtgattacccttttgctaggtaacaaagtagaaagttagattttctatgatatttgtttaccacgtaggggaacctctctagagcaatactcccaagctttttcttcttgaaatttcccacctgacagataatactttagattgttgctcttaaggacttctctcagtagctgctacatagagatgattgtccgtgaattattgcttgcacactcatgggtgatgctactccctctctctcatggcaattcttgctgccaacctgcaggccacaccaggattgagggcagctcatctcgataaatttatagcattaaagtgctgggtcatttgagaatgttgtcaatttaggttacttagtacctaagttttattctttaaataacagctttattgagacgtaatttacaatccatacaattcactcatctaaagtgtacagtttcatgctttttagaatattcagagttgtgcaaccattattgcaatcaattttagaacattttaatcacccccaaaggaaaccctatgcacctttgtgttcatccccctatattccctcagtccttagcaaccaataatctacttctatctatggatgtgcttattctaacattttgtatgaatgaaatcatgtaatatgtggtcttttgtgactagcttctttcacataaaatatgttttcaaggtcatccatgttgaagcacatatcagtacttcactattttttatagcctaataatgttccactatatggatataccacattctatctatccatttatcaggtgatgagcattacggttgtttccaccttttggctattatgaataatactgctgtgaacattcacgtgcaagtttattgtggacatattcagtccacatattttggacattttcagttcttttggatacatacataggattgaaatctctgagtcatatgatacctctgtgtttatccttttgaagaactgtcaaactgttttctaaagtgtctgcactgttttacaatcccatcagcaacctatgggggtccatttcttccacatccttgccaacacttgttattctctgtctttttcattatagctatattagtgggtgtgaagtggtacctcattgtggcttttatttccatttccctaataacaaataatgttcagtatccatgttcttattggccatttgtatatcttcttttttgagaaatatctatttggatcctttgctcagtttttagttgggttttttattattgagttttaagatttttaaaaaatatattctggatacatgtcctttaatagattgtgatttgtagatattttttcacattctgtgagttgtcttttttactttccttttttttctttttacgttcttaatggtatctagattgaagcacaaaaatgtttttaagtttgatgaagtccaattcatctatttattttctgttttggcttatgattttggcgtcgtatctaagaagtctttgcctaatccaagatcacaaagatttacatatgtttccttctaagagttttatagttttcgctatttacatttaggtctttcatcagttttgatgtaatgtttatatatgactgaggtaggggtccaacttcattcttttgcatgtagatattcagttctcacaatattgttgttgaatctttcctcacttaactgtcttggcaccctttgtgtaaaatcagttgaccgtaaatgtgagggtttaattgtggactctcaactatattcagttgatctatatgtttattcctatgccggtaccacgttatcttgattattgtaggtttttagtgagttttgaaattaggaattttgaactcttcaactttggtcttctttttcaagattgctttggctcttgtgggtcccttgaattttcaaatgaattgggataagcttgtcaatttctacgaagaagtcagctaggattctcacaggaactatattaaatctgtaaaccaatttggggagcattgtcatctcaacaacgttaagttattttcatccataaatatgcgatgtcttcccatttatttaggtcttccttttgtcaacaatttttattgttttcagattataagttttgcagttctttttaaaatttattcctaagtgatttattttttgatactataaattgaactgtcttattgattttattttcagattattcgctgccaatgtatggaaatataattgttttgtatattgatcttgtatcctgcaaccttgctgaaaatacctgagttttgaatgcttctgggacttatggggaagagggcttctgctgctgcactgaaagttaaagcttacttcatttcatcctgtatgaaggctgcatggggacattcttctcagttttactcagctataaattcgaactggtaatcccatcccctttcgggatgaataggagagtgtttttaaatgttcatctctttagagaacagcaggaaagaagcctagtaaggtttgggtagtttataatcccttttttagaatttggatttgggaactattagcaaggcagtgagtaataataataatttctatatagaaaactaacatgtagaggtgacaaatgaaatcactagctatattaggcttatgtttaggttatcgtaagcagctaaaatcataattttatgtttttatatgttgtcctttggacaaagtaaattccagtactccttctgatgtgcatttctagatggggaaaggattcatttactctcatataatttaagcttctttttagggatgtactccatagccatgaagcaaagataaaattcatctatacacagactgaactttgtcttcattaacactctaggctaagggtcatagctaatcagctacaactgtaatgtcctgataattgtgaattaactgcagggcacccagcaaaaggtttagttataatctaatagctgtctgtagagattagcctaataaagggattttttaaaaaagaatctggccgggcatggtggctcaatcctgtaatcccagcactttgggaggccgaggtgggtggatcacctgagatcgggagtccaagaccagcctggccaacatggtgaaaccccatgtctactaaaaatacaaaaattatccaggcgttttggtgagcacccacaatcccagctacttgtgaggctgaggcaggaggatcacttaagcctaagaggcagaggttgcagtgagccgagatcatgccactgcactccaggctccgtcaaaaaaaaaaaaaaaaaagaatctatcaatcaaccacttttcattaagcacctgctatgtgcccagcatgtgctaggaagagataaggtgaaaggggacacaattcagacagaatcttcttgaggtaactgcttacgaggagcttatagccactaaaaacaaaaacaaacaaaaaccaaacaaccaaaaaccaaacagaaatgcagtatcatcatgccatgatgcctgtatgagatcctggattgtacggtatggatttcttaaaatgtagatattttaaaaaaaaagaggaatgaatcaatagaggctgaagtggtcagcaatgttacctgtggctgcttttaatccttcgtggaagtaagtaggagcatgtctaaactcaagcaatagattaaagatcttgatgtatattttaaataacagaagttagtaccactggaaagaatgaactggaggaatgggttgaaatctatttctgcttattcaatagtgcaccccagtcaagttagttgccaatttcttcttcagtttctttggctatatcattgcacttggtgggtacatgtttatgatgtctttatctgaacaagtcagcaataatatgagtaataaattaaaattgaaggtgattaatggctctgaatttgacataagagttgttttcctgccttctaagtttccattgatcctgatgaattgcacaaaccaaacaattcggggagtaagggggcacatgatgatcttataagagctttgctgtattagacaacgtaacattctgaaatggcctaccacctaacatgggctctgttctctgcaggttgagtaggttccttgcttgtggaactgtagtcccgctatttggccgctagggggactgcaagtgccccgtggcaggatttccctgggaatggtgagcctccattgatggtttcaacacacagccaaggccctatcgcaggataacttgaaccagaactgcctagcaccagacaataaataagctactatggtacttactgtttcatttgggatgttgtttctcgaagtggcaagcattttttagtaatattttgactttttaatacctttctttgcatatggagcagaaaacagtgacactggatatattcaagtagcactgtccagtttatagagaagtttcatattccattattgcatttcattcttgtttctaccttttacaagtaactagagtttggagtattataatagtattcatactattacagtactattattcccattataaaaattgtgcaaagagtggttaagttacatgtttacaatcaaacagcttcaaagtgactgatctggaatttcagtcccattctttcttctccagatcatgtgttccctgcttttatctcacagctctttttaccttatagatgggaaacatgagagtcagagaggcaaaagaaccacaagtggtatcaatactagaaatttatgaatttcttaaggcttctaggtttgttacccatccaccagactgatggatttggttgtgtgagagttctgggtgccaataaccttgccattctactttacagactgcatatattcaataaatgcttattaagcatctactatatgccaaattctgtactaggcaccaatgatgtagtggtgaacagaacagacaaaaatctcttcgtggagcagacagtttaatgagaggagacatgtagtgtacatctgagcatgaaaagtgccatgcagaataacttcacagagtgtagggtatagagattgatggtgagagggaatattttatatttgctggccagggaaaaccttactggaaaagtaaattttgagtagtgacctgaaggaaattaggaaatgagctgctatttggacatctggagttagaatattccaggcccagggaaccacaggcgcaaagggcctgaggcaggagcacacttgctgtgatggaggacaaagaggcccatatggctggtttaaataagtgaaggatggtagacaatgagatcagagttaatgaggttgcatggtaggtcttccttaggactttgaattttactcctaagcaggttgtattggacggttttgagcagggtaacatgacctgacttacattttaacaggctccctcctcttcataacatctgtcactctgatatattatacgtttgtttgtttacttactgtatgtggggggaagagactgtgggagcaaggggggaagcagggaaacaagtacactgcagtgatctgggtgagaggtgaccgtgtctcagactaaggtggtattggtggagaaggtaggaagtggctgaattctggatgagttttgatggtatagccaacagcatttactgacagattggatattcactgtgaaaaaaatagagatgaggatgattgccaagtttttggtctgagtaactggaaaaatgagattgccatttactgaaatggtgaagactgtatgtagagcaggtgcatgggcagggtagaaatcaagagtttgatttttgacttataaagtttgaattatctgatgaacatcctgatggcttcttctcagttagttctcatgcagtgccttcagctttgctgttcttcaagaaaattaaaaaggaacttagagatcgcctaggctgtaggtaccctctcccctctttccttttactttatagaggtctatagaagggtagggacttatccaaggtgaaacagtgagctggcgacagaactagggcacaaacccagttctcttgaattctgaatcagtagattttctttttttagtgtgattctgaggactcatttgggcaagagtgagttttttgttattgttttttgtttgtttctttgcccaaacctaaaaccaggtaattaaactaaatagtgaataaaactgggaaactatacaaattggttgctctccccaatcacactgaaatattattatttttactgaaccacataccaaaatatttttcctgtaaaaacacagtaagtgaacttttaaaggcaattgagcttttaacaaagctagaatctacagaggacctggacagaaatggccttaaatcctaggaaattagagttcatggaacctgggagaccatcttgtccagctagctcattttatgggtgaggtgcctgaggcaccaagatggaaagggacctggctaagctcatacagcaagctagtgcctgagcctagtcagagcctgttttaagggttagtcgtatgttgttttcttgaaaaaagttacattggaaaagtgaaaattctttggtccatactgagaacaaagaattatacataatcatatataataataatgatagcacttcctgaatgtttgctgtgtaaactttggcaccttgcatgaattgattcatttaattctcatgtcaactttaggaagcaggcctagagaggttaaggaacatgtccaagggtcacacagctaggaagtagcagaacttgtgtgcactcccaggaagtctggcttctaaccacaaggttctaactactgtgcaataccaggagcttctcagattacccttcacctttaccaacccaaatgactggtgacgtaggtgacttcattatgctctgcccctattatagtccactgatcctcaccaaataggtgggtggcctagaggttaaagtagaggcagagtgatggaaaggggtggttagaagaagttgatgactcatgatagggattggaaaacaggactacaggaattattgaaaagggcctagagatcccaaggaggttgatctccgactgctacaaacctgggcaattcaatgcctgcttaaataggagagttaagataagaaaaataaaattgccaatttttacagtcagacattgttttatttattttacatgtattaattcatttaatcctcaaaatactccatgaggtagctacaattatcatttctatgttgtagatgaagaaacaggcacagagcaattaaataacatgcacaagattagagaacaagtaagtggaagtgccaatattagaatctaggtagttcagctccacaacttatgttattttccactatatttatggaatgaggtaattttcttataacagaaagtttttaaaatgcaaaaacattgtgcctgaacttcaaacactgaacaactcatatccttaatatgcaccagtttcttttaagcactcttagaaggaaggatacttaacctaatgtcacatggtgagtaagtagcagaaccggaacttgaatttgagactccggactgccagacctctttccactctatcacttgggctcccttctaacattgacttgtctccctccattcctcctccgtattgttctgcccttcaccttttaattacctgtctccatcaacaagattggacagagaattgggagagtgagcagagtccatttccttccagagactggacaaaaggaacaaaatgttaggaaaaaatgtcagcatgtgggatttgtgggatttacactaaataagaagggacacttcccaggactgacaagatgctacctccgtccctctaggccccaatgtgttgtgcaggatcccataggaagtcatgaatgtggttgtcagataacctttttgttactgtggaaatggaagcaggctactgcaaaaatctgtctctccaggttttcttttaaagaaggtagtcttgctaaatgataactatttcagcatttatttgaaaatgggcagtgcaggagagaaagaatttttccaagcttgtcacattgggccacctctctgaagcattgtccaacttctaattagatgaggagactgcataaaccaagagttgagagtaaagatggaaacacttgatgtttggtgtttgggtgcagaaaggattccagaacatgttttgggtctctttactctgtccatccctccttccctttcatctttgtttaaaaaccacagttagcaaatgtgtagtctgtttgcaattgttcatctgaaaaatttgtttgatcagccttttgaataaaaaagaccaaattagactgagatatttcagtcaccaactatctaataatagaccaaaaattttaaccatgctcatactttcatatggtatgtagtttgctttagacattttctgggcttcagtgaggtgctagattgactcaaaatatggcaggtcagatgtgggattgagcagggtggactcttctctacccttcccaattcagagttccccatcaaagatgatctcatagtgtttgaaaaaccaagctgaaggctttgggaattagggtgctgaagggatatgctgtttcccaaagccttctcagtcattccttctccccccagttcagattcttaacacctctttccaggattagtgcagtgatcccacgtcctttctctctagctctctctgctactctctaattcctattgtatttgtgccaccagatctttccaaagtttagctccaatcttgtctgtatactgctttaaatgtctattagtctttaagctccttaagggtgggagtcctgtcttattttttccctattcttcgtgcttaatgcaaaggaagccttgctgtatagttgtgtaatgcatgattacaatttcagcttctccccattggcttatgggttaaagtccaaattatttaaatctggtgttcaagtccttttatgatctgcttatttttccagcctgaattcctggagttcccttacaaaactcttaaaacccagccaaaaggatctagtcactgtcactttaaaccatcctcactctcttgttttttgaacatgttatttttcttataatccctttgaccttgaaggctatcccaatttcaatactatccattcttctatgacagccccctacaaaatgaatattctcaacctcccaacccaaggagaagtgatctatatgacacaatatggttgaaagaatgttggcttcacttctttatctgtaaaccaggggctagaaatctctagtttataagattttgtggagaggggatcatatgtgattatggatgttaggcacaagtcaagagtgcataagaccttttggatttatcccttttttctttctccatcaatatggtacttagtcccttaaatcagaagtacttgtgttaatgtctgataacgtccttctaaatatacctctaaacatctgtctctctttagggcaaaggttggatatatctgcaaagattctctttggatataagatatccacagcacataacttaacagtggtgtacacagtaggtattccataagtatttctttatgaaatgattcagagtcaatagtagtaagtaactgccaaaaacaactgatggattgtaagttccattaacataaatacagtcagccctccatatccatggattccatatccacagatttaagcaactgcagatggaaaatatattttagagacacagtaaaaataacaattcgacagtaaaaaaatacaaataaaattatgtaaaacaactatttacataacattgtattagctattacaagtaatctagatataaatgaaatatatgggggatgtatataggttaaatacaaatatgacaccattttatatgttttagttaaggaacatgaatatttttggattttggtattcatgggagtgggggaatggaaccatgccccttcaaataccaagggactattatatgggacacagaataaaggagttgattgtcttgctctgttaaattctggtcagacacatttgcaatgtattgttcagccccagtattcatggagcatctccttttgtaaagcatggaggagctgtgagagagacatggagcagtgaacataactattgtttcaacgtacctgaaggattatcatggaataaagaagttagatgtttttctgtagtaccccaaagggcaaaagcaatgaggacagattacagttcagtaaacgaaagaggtttttttttttttttttttttttttttgagatgggagtcttcactcttgtcgcccaggctggagtgcaatggcgcaatcttggctcactgcaacctcgcctcccgggttcaagtgattctcctgccttagcctctggagtagctgggattacaggtgtataccaccactcctgggtaattttatttattatttatttatttctttatttattttagtagagacggagatttcatcatgttggccaagctggtctcaaactcctgactgcaggtgatccgcctgcctcggcctcccaaattgttgagattacaggcgtgaatcaatgtgcccagcctgaaagatattttcttagaatagcttctttcacccttcatcagaagttgtcaacatggaccatatgagttttgtttggtctatatggtgtatatgtgtgtgtgtgtgtgtgtgtgtgtgtgtgtgtgtgtgtatgtgtgtgtgtttattgaattacttgctaacattttacttcaaaattcagatttccaccatagggaatgaagatctggcaatacaggactttcattcctacatggtaatgaccagctgtaggtgaaaagcagctgatcctctggatgggccatgcactttgcagtttgcccaggcagcactgatccgctttattcatttaagttacctgcttgactcttctagtcattcgagtatgtcatccccatcagatcagagacctaagcaaatcttgggtcccttgcttactccaagggctttcactcctcgtataggaggagctaaagaaatgtacaagcagcaccacaataggatcagacctggctttcaattctagcacggccacataacatagttggatgacctcaggacagtaacataacccctctgagcctctagatcttcattatctgtagagcactcttcttatagagttattataagaatgaaataaaacaactaggataaagggcatggcacttagtaggtgctgaaatattagttcccttcttctaattcaccacaccatatctgtctatctattggctgaatcacataaatagtaaattcacattcactgaagacattcaagaagagtctggaccctttgggaaccatgtatagggcaaaggtttgaactcatagtagatgatttttacagtcactttttaacaatttaaaagcctatagatgactccaaaatgcccatttggatgatatgaggcatactttgtgtagttaaggattttaaatacataacagagaggctgaagggccttcgggaaagaagctggggtaagagtcaaagtgtagtatgttgaccgatgttcaggaataggctttggcatctgacagattttgttttaaatactggctctgggtcttactagcttccagttctgggctgcttcacctctcttgagtttcagtttcttcatttctaaaatgaagatactaatgcttcctttgttgggtttttgtgaatataagtgagataataaatgtaaatatctagcccagggcctggtgcatagtacaagcttcataaattgtacctattattattagtagtagtagtagtccagacaaacagagcttgggaaaacgctagactctggctgacatacatgggcttttccccaggccactgctgcctggcttccccttccacaaagctttgagtctccaaaatgctttggctggaatgtaagcgtgaggtcattgcagataacaggggagcatgatttgcttcggtaatgcaagttattaagttacttccctcagcccagctgaaatctcttattggttgatgtgtgcttcaaagtgtgagacagagctagtctgaggagagagggagagtgagaagattcctcttcttggccagaggtcatggtcttccacaaggaacagaatgactcaatgcaaattatgggacctctttgagtttggggcccctacatttaaactagtaactccgttgcacatattggcacccttcccccaacaaaattactgggcaggaattttcttgaatccttccgtggcctggaatgatctcccttctcatccttgtgatccacacagctggcaaatggcaggcagcagaacaaaaacaagcctcttagcatatagggagagaaagagtcacagcagtactgaatttgcttgggaacctaatgttaacaaaggaccttcctctcaacaccccaaacagattaaaacatttttttaacagcaagttgtgtctcggagcagctctttgcttgggtatatttaaagatctgctgagtcatttaagagcaggctggcatatcctaagaggcaaggactataccccagtctatgggggagtaagttgagaggtgaaatctgtttggctttctcccatggaaacaaacaaggtgatccacttccatctcccacgactctggagagcatctactaagccttcttattctatcaactttgaactcctcagtgtataatagagtaagggtgagagggaaggagcagtcgtaccagtgtcattattggtatgttcaggagttcaatttcttcctgattcagtcttggcgggatgtatttgtttgggaatttatccattttttctagatttttctagtttgtgtgcatagaggtgttcataataccttctgatagttatttttatttctgtggtgtcagtggtaataacccctgctgtctgaaattgtaatggccctgctattggtagctgagagtagcatggaagtgtcaggttgatgggttcatttaattcttttcttttcagtttcagtcacatgcattgttaccatggcatatgacagttgctagaaagtgaaataattttttttctactttattctccactgcacttctaaatttattagtggagaaattagcagttaccaactgttcattataggtacacattggggtttccttagagccaattttccccctggttttcatcttgtaaatctgtaatcctaaaaattagcaaaacctagagcttctctttggtcctggcctgtttgaaccctgttccacagaccccaatcttctttcttgtttgaggcaactatccttctctttgcccaccgccattttccttcatctacttttcccttctctagcacctcagactgtcttcccacagtggcacagcctcccactccactttcactgtgccatctccttgccatcaaaaccatcctcacagacccttctgaaaccacttctaggaagggaaatcacaatggatccatgaaggatgctttctggatgactttaaaagattggtattaagatattttatcagtggtagcaacactgacttattcaggcagccatgccccggatctataagaaatcaggtaagctaaaagttgcttgagctggcaggagacctagttctcttttttcctttccctcttgcattttgtttatcgatggttttcaaaggacttagaggctggctttgttatagttagttggtaagagaaatggtggaggaccggaaaatgggagtggaacgaatgagcatgtttgagactaagttattacaattcctaggatgtataaattgcttgaaatctaccaagtactttcagacacattatcttttttactcttcaaaatcaacttggaggtaggcacaacagggatcaaatccttagttcacagatgagtaaactgagactggaggaaattaaaggagattccaaggtaactcagacaataagcaacagaaccaggatttggtgaattttttggggggtgggaggtacagagtctcactcaggctggagtgcagtggcaaggtctcgtctcactgcaacctctgcctcctgagttcaagtgattctcgtgcctcaacctcctgagtagctgggattacagacatgtgctacaatgcctggctaatttttgtatttttagtagagatgaggttttgtcatgttgcccaggccggtcctgaattcttggtctcaagtgatccacctccattggccttccaaagtgcagggattataagcatgagccactgctcccagccccagaccattaatttttgacagtaagtccaacttttttcaagttcacagctcagatttgctattgaatgaatgagtatatatgtcatttgggaacattctttccaacttttggttgaagatttgttttatcacttgtgaaaattttttttcattcttagcaatgtcagtttagttaaatgagcatttcatttgcgaattcactaattaattattttattcatcaatacatttcctgagtaccaactttctatcaaaccctgtgctggattctgaggctacaaagagaaataagataccatctcaggcctctaaaatctcacagactggggactgacatctcagtagtaaacatatgaacagcaacttgtgaaacgccattagcaaaatctcaagttatattcttcagtgactatggccatcctaaaaatggggtgtcttttatttggggtaaatgaagatgaagccttatgagaaattgcattttaatctaatcttgtcttgctaagaacagaagtggaatgtttcagcctctgtgtgtgtatttgtgtgtgtgaaggttgagtgtgtgatgatggatggggctgcgagattgttaagtaggatctatggggggccttaaatggtcctggtgagtcccaactttctggttatgtatttgagtagagtatgggggtgacaaagattgttgtttaagagttgattttagattttttccaagtaaatggtcagctgacttggagcatcatcattccacttgctttgaaaacctgccacttaaggctccttccagtcataggttaactctttctggtcaagtattactctttttgagcatttacctgtcagtgacaggtacaatgttagatgttgtctctctgttttcttgtttaatctttactttgatcctaggtagctcttattagttccactttataggtaagaaactgaatttcagagacttgaatgacttgttcaagatcacatagtatagtaacttggtagtttgggacttgaattttgattgttcagttttttgtttgtttgtttcctggcctccctgctgttttcactattccacaccacttcagctttatttttcatagaggccattaaatgtaccctccatcagccaaagcctcttgcctcccttcaacgtaactcttctctagcgtcctcttaataatcttctgaaaaggttttacagcctttctgggtactgggacccagagtcttaatccaggctcttaagtgccttatttaactgtaatatggaaaatcaaagtcacagctaattcaggaaaaatgagtttgggatgtgaatttcctaggcaacttgtcatctcttttttacttccttagcttcataaacttacccacaatgttccctgaggactaagagtaatggagggtgatgaggaaaggctttcctcccttcctttccgagagtcctttagccaaatgccacacctcctcctgtttccctagtctccgtgcagagatggaagtgggagatagacatgggttcctttcagccctgagttcatgccagggttttctttccctctagctggactgaggtaggaggagaggttgaagtccaccaataagaccatgagtgaagaagactaaagtacttgaaagagcagcagacctacgcttaaaatactagggtttgtgtccagactttgtgggttactatctgtataattttgggcaagtcaacagttctgagtcagagttcccttatcagcagattggaagataaattctaattatatagatgaaacattaagtctagaagtaatttgtaaattcagaaagggcttatagatttaaagtgtagccgttttgattaccacaaactaaatcctatacttcagggataaaatcttctcctgttttttctaaaagcctgtgcatgtgtggtgtaaggggtgggttttcccttgtaccagcaacttagcaattgtagtaacggggctgagggcagtggcatgcttcttcattgagcaagtgtgaaaagagggttatgcattcaggggtcagcagatggcaggcagagtagcccctccaaatctccctcccataccacaaagccctcttatttattcaaacttaacattagaagctcatttcaagtaggcacgtctgtgtctgggcgtctattttccttctttgtatatagcaggcatttgtcaacttggtgaaaagcattactcttctttccatttctgaggactaattgtgcttcttcgctagacacgagttcaaaacagtgggttgaaagagggcaagtttatgccaaagaatcagaaatagtcataatttagagagaattctagaggtcagttccctttcgtatggactgggcaactgaaacccagacagggaagggaattagaccaagttcacaagcacaaacactttactggcacattcagattggaaatcgagggcttctgctcccaggtcagaactaaatgccctttctagctagggtgttctttgatctcagtgattttgactctttctactgcactctggggacagtgggttctgcggtaccaactccaattaaagtgggaatatgtaccagcccctccccttggtttttatttttcagaggcctggcagtcagagggattctgatctctatatgcaatattttcacactactgtacttattgaaatcacatttgaatcttggcaattaacaaggcagtaattggcatcaggagggtatgttagtttgcttatctgcgccgtccctcctcttcccaacccactgtgtattgcagaatgttttatcagctctgatttgccaagttgctctcttctccagtaggtgctgcgagcagagagggattcctcggaggtcatctgttccatcttcttgcctatgcaaatgcctgcctgaagctgctggaggctggctttgtaccggactttgtacagggaaccagggaaacgaatgcagagtgctcctgacattgcctgtcactttttcccatgatactctggcttcacaggtgggaggttcttcaattgaaaacttagaactcagtttctagggtagtgagtgttgtaaggtttggactgtgacctaatattacgcagccatgacattatctattaggcatctagactagcttgcttgaatatcttagcatgttgactaatttggggcagaatatagtgtgggtgggggattttgtgtgtgggggggggttgggggttgagcaattcattattattaaaatgcaaaaagcacttaattcgctatgataagattgcctttttcatgcatactggcctacctgcaagacccctagagacagtaagcagcatacatggtgtcttccagttttcagcctttgtgcaaggaacaactgtgggtttctgcacatgtgttgtggtttgatgtttgtatgtgattgtgtaccagggtatgtgtgtctgttattgtgagttcatttctgagcagttgtgacacacagagatccagaaacagtgtcttaccctgtgtgctttgctagtgggaacgtgtcttttcttttgtgctcgtatctctgtgtaatcgagtgtcttgctaagtcaatgtgcctctgtctctttttaccagttctgtctttgtgtctctgtgccttcatgtattttttcccctgagtttgcacgtctctgtctatgtggatatctctcactccaggccactgtatcactgtgtctgtattacagctgtttatttctgtcggtgtgtggatttctatgtctgttttcatcttaatttgtgtgtctaagcaagactgttttggggtgactatttcagtttatgtcatagccattctttgtgtgactgcttctaggtatgtctttttctatgcccctattgtccccatctccatgtgtctctgtgtgtatatgttctaatgtatctgcctacttatcttagtttgtatttctctgggtgtatatccctctcttgcagttctgggcctttgcagtttttggcttatgtttttgtatatatccactagaattggcttcttatcttttttgtgcatgttttagtttgtatgagtgagcatatccaactctgtctttgagaagcagaactgtctgtgtttgcagtcagttgtgttggctgtccctgtgtttgtccctgtgtgtgcatttcattgtatgtgtacgcatccatgtatctttctgcttctctgtgaccagatatttctgtgtagctgtctatgtatattggcttctgtctgtgtctgtgttgttggctctacgtctgtgcatatgcacccaccgggttcataaaaagctcacctgctctccaaggaatctaccagattattttgtgaaataactcacgtttcgtttttttacttgccagctgctatggtacttaaaagtgtgttggtacgtaggtgtgcataatttattcatgtaggatgtcaaaagagtcagttaaaaattatgcacagtgtgtctttattaacaggacacttgtgtgtagagaatccttgagaaatgagtggttagatgataaatcttttcatattaatttcatgatgtcagtgaagtaaatttgcaagatatgggctgcataagaactatgttctttttaaaactcagcatattgatggtggagaaagcatttatttgtactgcaaagtcttatttctgataagacatcacaaataagaattattgtgatgagacttatcacaaataagaattattgtgataattcttatttgtgataagaattactgggttagaaggtgttacttttctggttttgtttgggtttttgttttgaagtgttactacagatggtgtcttagggacaaagagctctgaggttgacttagaacacatggagtacagataaaaaggagaatgaaaagtaacagagagatgggcatattccttgtttgaatggagtcatccaggggctcaggatggagtgcacaggaaatggagaggtgaaggtcatagagagaagtttagcaggaccagatctttccttgtcctgggctgctgtgaccatataaggaaggcagtaaggggaggggtagggatgaggaagagaccagctctcctctttctttctgatggaaggttaccacctctatttaaaacttctgttcttttggtttctctttctttctttgattatattattttctggacttgttctgccaaagcaagaaggaaattccacatgtggctcactcatttattatacttgtttctttgcacgatattaaagacagcttgttaagtgtcactgcaaacatcatacacactgatccactgatatgggcagggggttctttatgccagttctgctctcttcccagtgtatctgtggtgcttaatgggcgcaaccatgatttttctgatgtcagtctgtgatgtcagttgtccagtgtgtatgcaggctgcttaagagtacatacagttccttcacaattatggtagtccctgagaaggaagtggtcattaataaaagactaggttcagtagaaacatgtaagttgtctaggtgttggaaattaatacagtactgtgctaagggaacatatatctagaagttaactgaattatgctcaataaaaagagtacaaatgtttcataaatattttgacctaatcctcctgtaagattaggagagggatatttccgatattcaaataatttttttaattggcaaacaccttagacatactatttacataaaattgacatgacaaaattaagtcattgtgtctgttttatgataaaacaggctcttttgatttagttagaattattgaatgtaaaataatgaaaattaaaaaaaaaacaaggaggaggaatctatcctattttataattcagaccgttgaattgagtttttcttttgttgtattgatttaaatgcagagaagtctatgatgctggattccagtcagaagataaacatttgtatgtgggctctacattgcagccaaccttgataatttcaaacctcgattttctcatctgtataatggtaataataaagcctgtctcagtagctaccaaatgattgcatatgacaaacttctcacttatttaagggaaaaaataagaaaaagaaggacaatagggtggatttttcatatagtaaaatttattcagttagggtaatattctgagattgtcttctgaagcaaaccctgcaaaccctggccattctgttttgtttaggaaagaattcatcagttctgattctgccttttctggggagggaggctgagtattggattgaagaggagtcactacttttctgagatgatatatccgtggtaaaaattattaatgctttgcacatgcaacatagagtgttcaattttgttagtcaacaaatatttaagtggcagctgttatgacctcaggggtgtagtgacttccttattgtcctttaattattaaaaaagaaatctatatcagaatatcaggtaaactcttattacatcaaatattataataaagatactttttatattctctaaacaaagtagagatctcagatgttggttcatttatcaatataatattagatttgaaaattccagtatacaaaaggaaaaggacagcttcttaaagtttatagtgattttctatgaactatcaattccgtttttttctgttttactggtatgatggaaactaaatttcgagttgtaagtagtagataattagactgcagggtaagccttgagattacttcttttcaggtaggaaactctactgtgtatttggctagttcaacctatcatgggtagtcaaaaatagttacatatacaagtcagcattttttaaattgttcagttgtgcttaagattggtcctttccaggaacaatccagctttatcaaaaaattattgcgtacatgtaaagtgttctgacattttaatgctcacaatagccgaatgacgtgggtaagaatcttcgtcttcattttatagatgaagaaatgaagacacagagacataaattaactgggccagggtcctaccactagaatgtgatagatgataatttgagctcagcacatagttatttccctataatatttgttttatgattgtatagatgtctgctgaccaaccttaatctctgctccctaagattaaccattctacaaagcagaaactggaggtcattcaaatgaaagctctacacttttagagggccattaacaatgctcaagttaaagaaaagcaatcaaagacaactaaaatactggtaccttcaaacagtacttatgaattatttaaccttagataatttggctttgagttagaaagatagagtaagatggaggaaccaattcttccctgggttgatatttatttatcttgctcttttgaagtctaggccaatcatcctatttattctgaatggcccgttaacgtttatccatttagggacagcaggtttggcacaaatggattggttttctgaggtcttatgtagagggctgcactgactgacttctgaaagtcccccctaacccttcaaatctcagggtcatctggtctcaagccttcaattatgaatacatttctattgcctttttgagtaacagcacaacactgcaagctgacccactgggtggatggaatggggctcttgccctaccaccctttggcaaacaatttgagggtggcattgtcactacctcattgtatatagggtctcttgaggcccagaatggcaaaataattttcccagtgtcacacagcgagttattgtcagagtaaatatcaattttgaatttgtagaccacgtggttttacctcatcatttctgtttgttatgaaagttttacaaataattagaagtagaaataatgattaaaataaagcataactactaaaaaatagtttattgcagcaccacctaaattcatctcaccactctaccagtagcatacatttcacaattgggttaacattgctctggatcttatagctgttgaagaagacaaaattctttccattctccagcttatattttccccatttgtaaaacataatggaagtgtacggaaaataggagttgataatttttaaggcccttgccagcacattagtacataggattcttgcaagtggtggtttacttcacttcaactatagaaggcctatgcgacaccacccatagagggtagtttgaaagaaaatgctagtgactacgtgtgtttccttcctgacatattttatagaaggtgatgagttccagcattttttcagacttggatctggctttcattccccttctcctcccaccctctaaaacaacagaggcagcaaccatttacacactttccagaagtaagtaagtaagactgtattccagaaacaccctatatcaaaatggaaatatactcaagtgccccaatgacccattgggctagtttgaacgtgtgcagtctctgtgctccccgttttagcttaagcctactccctaacctgtcatatgtcacccagccatggagcctagggcaatgactgccatcatatctgactttatggcctctcagctttcaatgactagctttgtagcagaagtttagcctctcatccccataactttggaagtagtgttgagataaagaaacgttgaattgaaggttgtgttttctagatttctttcaattgctccttaggctttagaagataaattctcctaaaagagaggtgctacaattaatccaagcaaagggaaagatgtcagtaaaactgccccttttcatagaggtgtggcaactgctgggaaggaagaaattagcctgaggccatgtgattactaataaactcaaagcggcatttttttacttctcaatatgaggttgaaactataagcttaaattgctgactttctggcagcaccaaacagtaaggaaaccacaaagataaacccaaataatagagccaattttctttttttccgggggggatgacttctaactagtgatatgaggaaggataagaaaatgtttctttgtaggacatatgatctttgctaagtgcactgaatgtatgtagaggagacaagtctgctgagggtatgagaattgggccaagatttaacacattttcaaagctccatgaagaagcctactgagcagtgggagtggagcaggttggggatagtgaagtatttgtaattcatttttaaaaaggagagggagagagaaaaggaaaaactgggccacccatcctttgaaaagaaaccttgaaagaggtccaaatatccttagaaatccttgacttcttaaaagtgatgtttgttttttccccctgacaattatagaggtcagagagtttttcttttctattacaaaacattgagagtgtgtagaaataattgtaggtagcttagccttggctgtagtcagaacttttgtactgtgactttaggatctgtatggaatcgtatgatatgcggatacaccaaaaactctatgggttatcaaaatgggatagcattaaaagaaatagtgcttttgtttagaagaagaaatgaaatgcttgtgtccagatgcttaaaggaaggcagtgcagactttcagaaactagactttaagagctgtactcagatactgagaagggctgatggctgaaggaggaacaatttaaaagaataaccgtctctcctctccctgtatattggacataaaagaatatcccattcttttcagaaatgtaatacaacagtttagcttgctagtaacttcacatgctatttcctttacctcttatatttgaggtgtctatttggagtgggctgtgtttctagctattctgtttatctggtttgtttttgttggtgtaggaaactggtataaattttatttgggtaaatatcacctcaattttcaactaaagctttatttaagtttcacatgaaaaagacaaatgaggcaaaggaagagaaaaatgcattgtcagaatcagaattatgagaaaaaaagtcaaacaaacatatttgaaatgtccagaaaacctgtgagtttttatgtatactatacaggaaagatattctgtcatctggttgccaaactatggagggtgggagacttcgaatttttgtcaaaaagtattctttcattagaaagatacatgggtgtgcttccatgtcagcaacatgactgcagaccaggaagtcctcacggagagctggaatatgggtattttggactctctggttagatgcagcttttacttcacatcctcagtggtactactgtaaattttcattttcctgtggaataccctatttggttccattgtatatagttgacaactagaattcgttcgctgttgcttgagcccaactataacttcttggcactatacctatcttctgatgtgcctgtggaagagctaccataatgaatgtgtacatggacaaaaaaaaagagagagagagagagaattaaatcatgagtttgtgccttgggagctacagtttaaacatttgctgtttttctcacttaatgaaaaatttatttgaaaataacagcacagaaaggaagaaagacaggctggcaagcatcctcctcctaatacacttatccacgtttggataccttggtctcagcctcagaggtcatatttttagtaaaatggccaccagaaataaaggattttattttccagactttggtgtttggagctggtgtgctgagagctagcagagaaagccctactcaggtagatgtaccagagcaggatggttgctggtggatatggtggaataccttttatgtggttatctcctccttgtaactcttggctgcataacccttattttcttttctatttttattctctctcttggaaaaaaaattggtggtaaattttcatgtgagccatattgtctttttaaatagttttattaatataaaatgtacgtaccataaagcatacccatttaaactgtaaatgtcaatgggtttctctctctctctctctttttttttttttttttggatgctcagagttgtgcaacaattatcaaaatcaattttggaacaatttcattgccccaaaaggaaaccctctgcccattagcagttactccccatttcccccaccccctgacccttcaaccctaggcaagcacaaatgtactttctgtctctatagatttagccattctggacatttcatgtaaacagaatcatgcaatatgtcaccctttgtatctggcttctttcacttagcatgatgtttccaaggttcatctgcattgtagcatctgccaatacttcattccttatttatggctgaataatattccattgtattaatgtatcatatttgttttttccaatcatcagttgatggacatttgggttgttttcatcctttttttagctattttaaataatgctgctatgaacgttcgtgtacaagtttttgtatgaacatctgtttttatttctccttggtatacacctaggagtggaattgctgggtaatatggtagcttaacatttaatcttttgaggaactgccagatttttccaaagcagcagaatcattttacattttgaccagaagtatatgagagttttagtttctccacatcctcaacaacactcattattgtcattgtccttttcagcttttttgataatagtaatctcaatgggtgtgaattgggaccccatcatgcttttgatttgcatttccttgaagagtaaggatattgatcatcttttcatgtgcttattggccgtttgtatattttttgatcctttgctcatttccaaattgggttatttgtctttgcattattgagttgtaagatcttacaatatattttggatgtttgtcattttagggatgatacttcacagttatatgatgttttctagcaagcatttgcgttgttctactggtgttacatatcttagctgcattagccactttgctgggtatgaatgccagcagaatctaagtgaccttggcttcactactgagaatgcaacccaagaacagaaatttgtcagaaatttagcactgaagccccccacttcccaaacttatctgggacaaggagaatctacatttaaagctctatactttgtgttgtgttttttttactttagcttggttggatttaggatcttttctttttgttttgccttatgcatacctaagcagaggcaagggaggaaagggatatgaacctggtagaaaagtaagtaagctttattcagattggcatatccatcttaatatggttcaattggctgaagaagtatctcaactaaaactctggaatactttgaagtaccagcaatatgtaccaaatgtactttttatttatgtttggtctctatgtacttgtgtgtgaaacaatgagcacaaataataccctccttgtttttaagcaatttatattggtgatttaaaaataaaataaactcaagtgggaaatcatgaaaccccatgtaaaaacaataagagcatgttttaaaatcccacagactttagtttcaaatagtggttttgctatttcttagctgtgtgtcactgtgcaagttactttgtttctctgagtctttattggtgatatatgtaaaaacccaccttctcaaattattgtgaggacaaaatgaagtaattaacataaagttcctggtgtataataagtgttcatattttgtatttgagcacagggcaactgggtttttgaaactgcacattactgttgcagtcaaatctggcatgaaattagtgcatagacagaatgggctgggaaaatgaaaggactttgaacatttatattctgctttatttaggcataagtgcttaataattattgatagtttcttctggttatctgacattttgaagatactattacctagcagaaatttcttgtaataataatctcttacacttatatactgttttgtgcctttagaagtacttaatgctctttatttcactatctgttcataaacattctctgaagcaagcatacagtcagtatgaattccatttttcagatgagacagctgaggctgaaagacatagagttacttgtctcaattcacaaagtaaagtgccagagtttgaaccagagcccaggtcttctctctcaacgtagctctttttctccttcattatatcaggcatagtagcaacgtattcttttactagctttttatcttgaatatccttttagcgacttgcctttggtgttagtgtgcctataacattgtcgttgaatatcttaatacatttagtggtcttggcaagcagttttgtcttcagaaggacactgaaatctgtggaaaggactgcagaagattgggtgggcagacacctatcactttcggggctggtagactttctattgaagcaatttgcaaggctactttgtattgtctaaaagcactacttcagaaaagggttgtgatgtcaaaataggcactttgagtgaagaaagggctgtaagcatgggtggaaaatgtggtagatgattgtcttgagttattttctttaatgtcaaacaggcagtccttggaatgctacttcaaaaagtgttgtataatgttgaagatacagttacagatttccaacacgaaactcataaatatgcaattccctgtcctcctaggcacatgaaggaaaatttatgagcttcaggtttctatgcagctattaaagcatatttaatctgctttgagctcaagctcactctcgttggctctcttcgtttcttcctcttacatgagcaaactgcctttctttttgtttaaaaatagtaagtaggtttgttttcctccaggtgtcatgaatgcaaacattgtaatttctcatctgttcagcctttttgcacaacaaaatggcagcacccaggaggttgaaagggttaaattgttccttctctgagtagtaccataagttgttagtctgctactctttctcccagttggcacatgaccctaacatccaatcgctagtggtgtggccattttttggtcttattttggcctttcctcagccaccactcatcagttctcatgcgtatttgtcagatcctgctccccaactccacagttcttagttcatcttaagcatatggctgtctgtcttttctctaaagatcctcaagggaaaaaaaaaaaagcatctccagggggaatttactgcctcatagccctgacagagatttctgaccaaaccctaacgaaaaaatttcttccctccatttgtcttttattgtttttacaggggagatatgtaacataataacaattatattgcacataataattacttctacaaataataatctgttgtcaaaaatatacacagctttggatttccttattatggcccttcattaagttgtggtttaagaatagctatgattattacttttgtgataattataatccataatatggaaacttataaaattacctttaaagtgttactattattctggccacaggatggaaagttgttcgctagttactcatttataacctgaatgtactttttactgaatctaaaggtatcatctttgcttggcaattcccatgacttgtctttctgactcttcagatctcagcttaaaagctctcccttcaaagaagccttccctgaccactctggttttttcttctttttttacctctactccttttcccattacttgctgtcatagcattctgtttgtttcctttgaagtgcctattccaatttgtcattatgaatgagtttttttgttctgttgcttattatccattttccccactagattgtcaactctgtgagggcagagaccatgatactctgttcactcctatatacattcccagcactatcagactttttggcacatagaagatactcagtaaatatttgttgaatgaataagtcataaagaagagtttatattttaactcttagttgaataatctaagccaagaattatcaacctgggttggacgtgagaatcattaatgaatctttaaaacaatgacaaggcaatctatttattaattatctccaggtctaaactttagcacgtatatacattttaaaagcccataagtgattcttacgtatagccagtgctatctgtctcttctcctgtcctttcccctcctctccttactcctctctcatagttttaggattagcatggccccacaacaaatctttaattcacatggcaatttctaggatttatcatggaaaatgagccaaattgccttcaagaagtttttacgtacctcttatatagaatgtgatgttttatatgtacctcttatagaatgtgagcttttaagaggcatatcttattgcaagaaatttcaatgttgaaaaaaatattgaatatttataaagtcaaaaatgcaaacttttatatgattttcaaacctatgaagttatatcatgttcaggccttctttccagcatgtggctctcagccctggtactgtccttaaccataaacctcatctttgccctctatagggagaggtttatggttataattactcattttaaatagtgtatattagtaatgtacactatttgtatatttgttgactgcctcctatatgccaaccactatgctagaaattttgtaatattcttcacgatattcaagatattaacatatccgcattttataaatgaggaaactgctctcaaagaggttagtttacacagccagtaagccgctaagcctagattggatggaaggtatgtgagaaaaaagcagcatccataaggttttcattctcctaccctgtacgacagaggtaatagaaattattagttaaagaaataatagaattttacaagactctaggaagggagaatgtgaaggatacagttctcagttactggaatgagtgccagagtaccagtacatggcttgccttggggtttggactacctatcttaactcctttgctcctcccaatcttgatctcatttgtttgaaagatcatctgcccaacataaaaatgcatttctaattctgtaatttaagtcagtggcaagatcagattcagttaaagtttactttcctgacagctttttagtatcatatctattttgcaaaactctagtgataaatgtatgcacatttacacatacagcatctcttctgattctgactaagatattactgggttgtgtagaagtgatgggctctttagaagaaaggtttgatatactactaatctaaggactgaattttctcatctttgtctttgccccttttgactgatgaccagagcaggagcacataacattcttttgtgctaacagtatctctgcatcacattgatcaggagaattggcatctccagagccctgggatggtaacttctctgttgattttcaggaaagattaggtgatattttctccatgggaagaggatgtttgatgtgtgttggctttagcaaaaggaagcttgtggagtcaactgtaagtagacagaattgcctttgacttaatctgtttcagtcgttgttcatactcaggtcctccagaggacctttaagcatttttattgactttgtggtctattacacgaaactaaagatactgattctcagtcatgagtctgctccaaaattgcctagggaatcaaaaataattgtaccagttcctattcctggacattatgattcatttggtctggtatgaaggccaggaatctgtatttttaaaattcactcaagcaattttcatatatagctataattgaaaatctgtggctgaacttctccactcccgtatccatcgcaatacttccccaaggtggcatttaagatgggcctagagggttatataagatttcaatattaaaacatggattaaaagtgaagacttttcacatggagataatttggaagaaaaacttgcaaaaatgtgagagcattgagaacttttctttcccaaggaaagaagtggcagcttcatttttggtcattgcaaacagcagtgccatacatgaaaggaaagtggtggtgctcatcaactttgaataactttgtacagaacccttgagactcctctctgcttataaagaaaaagtgtcaactgtaaagttgatttatttatgaaccataggctactatgaaatctctgttcccagctagaggcctgggagagtaagataactacttgtttattccacggagccacttattagctttttctatagcacatacctcaaatgaagcatttcaataaaagaaccacattctattcacatgcttcattttattctgatttatgtaaaaattcccaaactcctcaagcagtgtttctttgtaaggcaataatcttcagttctgttgcaaaggtcaggagtgatagaatgaaaatggtactagatacaacagctctttggtatttgcatggccattacattgccatggggctgcaagacttgtgagtgcttgatattttgcttgttgatgaatgagtctgtgtttgtgctaatggagtgatttgagaggtagttctccactgtcagtcaagaggttggttttgaaagctgattgccaatggtcattctgctaaccactctggttctcctttagatagagacttattcagattcaagtcttcatgtactttgtggcataaacattgtacacaccagatgtattcaacaaccataaaaaaaaacaattaggactcaagtagtatgtcagagtgtagtcactgatgatatataattctccactaccaagaagatggaagcacactgttgagtagctacatcctacatatgttggccagaatttaggaatacacatgtgatctatacattttgaggtattgtctgacccctagaaaatcctggtgaagtttttctggtgtcagtttggtcttaatgtttaggaaatgcccacagactactcctgctttctgcttattcacatagtaaacgcaaagcacaggactagtttgtcatctggatcaaggagaaatgagttagcagatataaaataaatcagaaaggaggtagttctcaaatatttactccatgaatagttgctggatgttcattaactctatagcatttgttactacttattggggatcctggaaagaaaatatattgtctatatccactgttcactgaggccctctccctacccagaaactccctgtctccatcactcactctccacattcattgacccaggggaacagttcatggatgagtgaacttgagctctatcttaaaggatggagttcgatttcaaggcaagaggtataagagaaagttcagagacaacactggctatggtctttgtgaagaaaagtgaattgaataggctcctgtggagatcttaagtaagtacttctggagataaggttgaggaaaagtaggtttgaatcttcatccagaggtagcccctaaatgtgttgagtttattgaaagagtacttgacttggattcagacagatctgcatttgactcctgttttgccatttataagaatttgagtaattattgtttctaaataagagtttattgagccaagcactcagtaaatgtttgaatgggaaaattaactgccctgtttttctattgtcagatggtcctcttcgttggataacttggtaactgttgataaccttttctcaggaatcagaaggtagaaaggttgggaaaatataagaaacaaaaaggcatattcctatttttattttcatattgtcttccaactctcccaggcttctttgtttgcaaggctgacttttataatactttttgggtagagcaggtccttctttggtttggggttaaaccgtgagtaaccttattttctaggtctcagccaactttgaagggcatgaactcacagtagcctcactaggatcacttcagcagtgagaatttatctttcttgtataaaagtgtaagagttgatggcggccaggcgcagtggctcacgactgtaatcccagcactttaggaggttgagatgggtggatcacctgaggtcaggagttcaagaccagcctgaccaacatggtgaaaccccatgtctactaaaaatacaaaaattagttgggtgtggtggcacatgcctgtaatcccagctactcaggaggctgagacagaagaattgcttgaacctggaaagcagaggttggagattgcagtgagccgagattgcaccactgcactccagcctgggtgacagagtgagactgtcaaaaaaaaaaaaaaaaaagagttgatagcaaaataactatctgtagcataaacctcagtattctttatcattcagtatcaacattattactgaaaacaataagcaatatggactgagtttctgtggggtggaaatgtgaagtggatcatagcatgatataacttgtcatttggcttcctttataaacattatcaactacctcagctctatcaatcacttggcagtccgtagtgaacattataactcaaatgactagtcaggtctgttcattgcccatgtaaaggcatatacctgaagtgagaagtctgaggtaacttagcaataagcttgcagtacagtgtttagtgaagccgaggaattcaaggatttgagtcatgccagattgctccataaccatagcctatctttgtcacaagtaagaaggtttaaaaatcaccataccattattggtcacaacgtttggagatagggaagagtttgtggatggatcatggcagtgcatggacagtgattagcccataacacaaccagtgaacactgttgtacccaaagcacataaatcaccacatatactattaatatatttatggatgacaacagacactataattttatgtcagtgctttctgctgtgaaaaacaaagaaagttaagggtaccttttttatatttgcatcatatctccagaccttttcctttatctccttcttgcaagttcttctttctttcagctgactatctgctgttcctgctatggctcccagtggcttttcaagagggtacttgttttttaagagaagacccttgaaggacagagagagcctgaatcattcaaaataatgaattactcaggatgaaatttcaataatttgcaagtgtgtggagatagatattttgaggaagcataattttctatgtacccctcaaatcgtggctggagatgacagcctcttccacctccatataagaccatttcatttccttctacttttttctccctccttcccccaaacacacaaacatacacatatcctgtgcttcagtcacacagaacttcttactatttcatttcaattctctatggctttgcatgttctgctccttctgcctagaatgctcctttccttttttcacctggaaacatcccaattcaaatgtcacctcccttatttataccaactttgtctgtaactcctttatcacacttcttcctgtgattagtcaattcacttgtctgctgttacacctctatgagagatgaaaattccttctccatctctggaactcatgcccttcgcatatagtaggcaatctgtaaatgtttgaaggttgagtgaattaatgaatgaccttcaacctttcaggcttccaattttctctctgaaaaggacagccaaatgaaaactcataattttagaagatgaggttagacggttggtaggtgcatgcagagaccagttattatttaggtattatggaagtttatagttcttgtatgttgagttcagtgtaagagtggccccaaacatagttaatgaccactccagacccagttgttatagagttggccccagctgtattgcttctatttaagactaggataagaaatgacactttcctactttttaccttattgaaagggtagaggctcactgttatcaatctcagttcacttgttgattgcactggcttgccaagtgagaatattagcacctctgcacatttctatagctctgccacttatgagatctttccttcccattgtcatatttaataatcaggatagccctataaaatatgcattctcatttcccagatgaggatactaaggctcaagtaggagaacttacttgtttagtaagatcatacagctaggaagtgggagaggcaagagttgaacccagatcttcctagctcctagtccattgttctgtctactgggtcacactggaccagccaggaggcaggaaaatcagctggggaatgtggtgccaacgtgtgatgtttgcctaaatgtgtgcatccttgctggaagccagccatgattcatgctgcataagtattcattaatgttcatttcatttatttggctatccatatgctttccagggcgaaggcaagctaggacaagggcagacaagcagccttaaagtttgggtgctttccttcgaagttgagctgcctgtttgaaaatcacactttttggtgatagaagatggttccagtacagattttatttattactgcatctacatggatagacattttccaaagcatagctgaaaatatgtgtaagtcccagaatattttctgatttagacacagactttgagcatgataaccacatttagcatgttaggaaattctgtcagaatgcttctggaaaggctacctttccagaatgaaatgaaaaaagaaaaggatggactttgaaactggctagatttgggttatacttactcatagtgtgaccctggcaaatgatttaacttctccgaatttcacttttcttattctttgaagtgaaattttaaaatgccatcttgcctgatttttgtgagaatgaaaatgagatcccacaccaggaatttagaagctactcagtaaatattgcttctctcctttccccttccccagtcctgtcccccgagacattcagtagttattcacaggcatgcattctgaagtctgcctactgctccatgttgaaatgcactgctcttgcaaggactgattatctatttttctgtcttccaaggccccctgtgttccactccaccctcccaattctgggggcttccaaagtgggcaggtacagaatgttctgtggagcatcggaggctgttactcaatatcttggccagcactctcaactgctctttgcacacactccatatgaaggcaaactccagatcttggagcccatgtgtgtgtcatgcattgtactgcttcttgtacccaaatccatctcaagggtgagtagaccaggctcagacttgtcctgggagcagatttctcaagctgcccatgtccccacactgtttgattaaaaggaggtgcttcaaactctttggctttatatagactagaatcagaatgattggtggtgcctctgttctcaaggtatcccaaagcactttgtaaggaaatatgacaagcgctgaggccatgcaggccagtacaacagccgccacccagcacttcacaattagtcatgcccagcctgggatcatcaagcctgtttttattggaagagcaagagagagagggaatgctagctggcaatttccccaggtaccctttatgaaagtgcccttggctcttccaatttcatctgaataaccagctcaggcaaattttcctctatcaaaaagcagaatgtgatagtgacaagctgatgcccggctgatgccccaggacattgactaaatagacttggcctcacaattggtttttattctctatctcctttcttcccttttgttctttttctgtgtttctttccccattgccatctgcagagtgttctcagtcagaagtcagctgtggggtggacagtttgtcattttaagatcatccctattctgtctacctttcttatccctcatatcattgcttttagagcaaggacaattctggaagtgaaactacaataacactctgggctcctttccctctagtagtactcaacacacttgtaattacatgttcaaatttgtctttcttatttctacttaggttcatgaaggcaagggacatgcctgtgttgcttactttctcttggcaggcacatacagcaagtcttcaaaaaatgcttgttaactacaaattaagtgtttaagaagtccactgttaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaagaagtccactgttagtatcttttcccctgcctagtttgtaagcaactggcctcttctatttgtaagttacctgttttcatttccatatgccccaaagcaaactttagctcacggccttacagagtgtgtatgttagtatgttaaaatgaaatcaactttcctctcccaggccttctaattgacatgaatttgggagtagacttgcattggcctttgtcctgacagccaacagagtcctcttctgttgtattcactgttgccttccatgaggatcccatggagaaagtttgtcattgatatacattttgagggcagactcaacttgagtaaacctgattgagctttccccatctgcctcccagagatcactgcctgtgctttgttaaaaagagaattataggagtcctctcaaggcagagaggcctaaaattagacatggcagccatgcctttggtgtgcatggaggttggatacaggcagccagtttcccctctgttttctcccttgcttacacagccaaggagtggagccaagcctcaaggggaggagctgtatactcgagcatgccctgtggttcctggccctgactgagggactattttatatatcccaatagagaagcgtggaagacatctaggttgccactgtcatttgaaattggaatttttaaaagagaaacctgaagacttgaagaaagctttcttttgcctccccttacagttgatttttgagcttcttaaagctacctagtccaaagtacccacactcttattcttttgtctttcctactggttttatttttttttcatcttcccaggtgtttgatgatcactaagagcttcaacattgctcaccctgaccaggtatgaagccaagagtttggtttagggcataaaagaatgtcggaactcaaggactaggttgaggtggggaagggggatgaaggcttctttttttcttgggttaagcagaaataacttagatctcagagtgaaagccttgaattatcacatatatcactggaaaagactagttctttgctatgataacaattgttcatcatctctcccctgaggatttggggtcaaggcctggctacaccttttaatgatttcagtcatgtgacttaacctctttaaacttggattttcttcatctttacaatggaaatgatgacaataatcactacctcacagatattgataataatgatatctcactaggaagagaattaagtaatatgagggataaaaaggcatttgtaaatggtaaaatgagattatgattttgaaagctattattattttcctttcactgtctattatctcaactcttctattttcttgccttttgtacagcatggataatttagatgtgactctggacagagggatggatcagatgacttcttaagttatcttccagtttaggagttcgtaaactatactttctcctttccagactatcctagtaagaaaattctcttttaagacagagtagaactctggaattcatcagttttgatgtttcttaaagtgtaatctaagatagtgctcctgtattaagttctgatgtctgaccattgttcaaataaagagtaaaatgcaaatgacaggaaattggctgcgttctgaatcctatttttatttgggataacaataagcctgtatggtcactgtgacctttgatttgctgtttctgcaacctcacacttgtctcaggattcttcttccacttctgcactttatattgggtttcttccaggcatcatattaaactttaagccaggtatgtgtatatgcatgggctgtgggcctgaaaaaaattagcccgagagagaaaaaaatttaagtagtgggctagaagtaagcatgctactagaaacagaatttgggaacacagctctgggcctagaaaagcgacctgtcaacttgttacagttaacatcaataactataggatgggtttggtggaaaattatgctgaccaacagggtgggagagaatagggtcagaatatatatcgctgtaaggttgagaaaaaaagaagtgaaaaaaaaagaaatgcatagagagaaaaaggagtttagaggtaacatgttaaagtgtgagaaataaactggagagcttgacttctcttgaatatatttttaaataaagtactcctttcaactccaaatgcagcaggcttggttcccttctcctacctccattgcggatgaaagcttaatctttaagatgggcttgggtgggtagagtacgccccttggtgagcactgtgctctctgcaaccccaataaggcccaacagggctctccaaggaggcaaaattctgatgatacatttctgtttagtggaaaatgggtagggaaaattatgtcttagaatcaattaaccaaacataaaatcctccaaggggcttggtaggatgcctagggaagagccacgagataaaaactccaggctggaagggcattgttgcagcactgtcattctccagtttctcttggagttgtcaccaccctctcctttgttctcactgctgacatcatttgtaaaataatttcttcccttaaataaacaagacatacaatcctctaaatgactaaagaacagttacctagaagaaaccttagtggaaagtattttcttcatctaacggatgattgtctttacagaggtggagtaaaggatgtgcgagggagcataatcaagctaagagatgcatgctgacttaaaaggcatgatatatgtgaaactaagataatgtgttcaagagtgatgctttgttgatgcagaaccactgaattccttactattatgtttgcctgactatcggcctcttaataaagaacttgtggtttgagtgttcattgaaattagccatattaggtttatgtggggatgtgaggatctatgtctaccaattgcagcctctgctgcaaattggaggcagaaatctgggctgaacaataggtaagagtgtcaactctacagatctctcacatgctaagcaagcacaatatagggcaatccaggtttacacaaaggattaatttgggaacaattatcctcattttcacttcctaaaaagattttgaataagatgtcttttaagtaagaagctccctgaatgcatttaaaatatgatttgattatgtacatttcagatttttctacctttctaggagtatctctgttgtataaaaacacaaaattctggaacttttgaaaggaagatgtgcctctcttcatacatttgtcattcttgaacgattgtaaaatgaagtgactgcatatcacgtcatgtgccctattgatttcttttcttgttttaggaatattcccagaaaaaaaaaaaacttttttttttttaaaatctactaagcatgctaggtaagactgaagatgaatctatttaagttatgtcaatatctatttataaagatttttgtgatattcttttcactgtagaacttcaagcatatcctaaaaggaacggttagatacctctacaaactgtggcaatgacttactgagtaattgctggcaactgatttttggtgcttcttgttttgatagtatagcagtgcgagtaggtttcagaagagcaaaactaagacaatccagggaaatgccatttgagaatttctaactttaaaaaaacaagtaaaatagtgccaagaatattatctaactaaccccaaagtctacaatgtaactcttttattttgataatgctgttctaaccctatctacttcagtcctttcccacccagctggtttaggaatcaaattcccaatgtttcatcactgttaacattactgttttactcttcactttagttcttaaatggcatagtgtcttaaattccctcagcctctttcacatttgatttctttggaaactttttaccttttcattgaagcccatatgatcttttccgaaacagacccttatctttacctccttctttggagtctttctcctacttgaatttctgaacttcttaaaatggccgctttgggttggtgtcagtaattcagtaataagttttcttttctttttttttttttctttttttttgagacagagtcttgctctgtcaccaggctgcaggctgtagtgcagtggagtgatcttggctcactgcaacctccacctcccgggttcaagcgattcccttgcctcagactcccaagtagcaagtagcagcaccatgcccagctaatgtttgtatttttagtagagtcggggtttcgccatgttggccaggatggtctcgatctcttgacctcatgatctgcccgccttgccctcccaaagtgctgggattacaggcgtgtgccagtatgcccagccagtaataagttttcttaagtgctttcttaatattctgatatttttaaaaaagatctggactattttgtcatacaggcaacagaatgttaaaccatttcataaaacaatgacaaatatacatgaatttttcatcagttataaatgcatttcctttataacattgaacatgtttttgcaactgaaataagtacggttttcatttttagaaggcacatgataaagttaaggcagtggttaattaattttttcagattaatttttcagaaaagtgactgtttctgtctattgtcttaaccccaggcatcaaaggattttaatcagaaagaaccgaggaataatttggttattttagtgcctttttttgagacaaagtcttattctgtctcccaggctggagtacagtagtgcgctcatggcttactacagcctcgatctcctggttcaagtgatcctccaacttcactttcccagctaactgggaccacaagtgggcaccacactctctgcaatttattttaatttttcatagaaatggggtctcactatgttgccctggctggtctcagaatcctaggttcaagcaatccttccacctcagcctcctaaagtgctgtgatttcaggcataagccactacactcaccctattttagagctttgtcaagctttggaaagaaaaccatttataatataatagataaattatggatatttgaggcagtttttatcatagtatacatggtaaaccacagcccccctttataatatttgtatttaataaaaatgaaaatattacttttatcttaaacatgttttaacaaagcaagcatatgtagattagcactaattaaaacaaaaacctttgtaatgatagctgttttttatatgattacaaaaaatttactatacaaatttttatcctaatcagtgtgaaaaactgcaaatattagcttatagggctagtcttcagagtcctcttcctacctactactgctaataagccaatgaaaaactctctgatgtgtgtggtggctcaggcctgtaatcccagcactttgggaggccaaggtgggtggatcacttgcactcaggagtttaagaccagcctgggcaacatggtgaaaccctgtctctactaaaaatacaaaaaattagctaggcgttgtggtacgcacctgtagtcccagctactcaggaggctgaggtgggaggatcacttgagcccaggaggttgaggttgcagtgagccaagatcacaggactgcactccagcctgagctacaaagtgaaaccttgtcaaaaagaaagaaagaagagagagagagagagacaggctcctccgctttttcagttcctaaataattttccaatctagaatgcaaaagattctgaaggaagacagttaccatttcagatcggcagaagttgtggctttaatctagactcgaatatgttttacatcaaagggttgcctcaacagtgctcaaacctgcctctctgaaaacatgctgagcacgaaggttacttgaagtcttagcttgagtacttaagagagtgctatggagggattgttgatgagagctgtgtcacagctaatttttctttagtaattaaaggtttataaaaatcttacactgtatattgacaaatttagcaacaaaatgagcttgagaaaaaaatcaaggcctgccatggcatctttgcttttttttcttaaaaaaaaaactttttagaaagattatgcgactgtattatctgtaactactgcaatggtgtaaatcctgatggtataatttgctttttaaagctatctttacttcagtataacttagattaaatttattttaaatttaaatgatatttttctctttgtttattattttataatgtttcccatagaattcacaaaattcattagaaagatttttttttacttccttaggtcattaagattctgatttgtcaatggatttcacataaaccctgtctttccaaaaatatacaaaaaaaaaaaaaatagccaggcgtgatggtgcgtgcctatagtcccagctactcagaaggccgagttgggaggattgcttgaacccaggaagttatggctgcagtgagctatggtcacaccactgcactccagcctgggcaacaaagtgagaccccatctccaataaataaataaacaaataagtaaataattttcaccttgaaaagcttataaatgtatgaaatcacaatgagggtcgctgatatagtttggatgtgtgtccctgcccaaatttggttttgaattgtaatccccagtgttggagatggggcctggagggaggtgattggatcatgagggcagttttttcatgaatggctcagcaccatccccttggtgctgttgtggtgatagtaagttctcatgagatctggttgtatagcacctccccccttgctctcttgttcctgctttcaccatgtgacatgcctgctcccccttcaccttctgccataattttaagttgcctgaggcctcaccagaagccgaacagatgccggcaccatgctttctgcacagcttgcaaagccatgagccaattaaacctcttttttttttttttataaattacccagtctcaagtattctttatagcaaggcaagaatggacttacacagtctcttttgtatcagggagagggtcttcttggtgactccacttcttttctttgtttatgtatccttccagatgatgtatttatttcctttgtttttcaattgatatttactcttaaattaaactaattatttaaaaaagcattttaaagtctcattttagattattttgactatctgatttttaaaatggtttaaaaaatctatcttggcctccatatgcaatcaaataagaaacacattttaagcatattatttaccttgtggattctgccttcctcagtgtgttcagtctgtgtatattcatttctcccacactgtaagaagctagtcagatgtataattggattatcatgctacataatcttagcacactcattttaagcatacatagactagtgagcaccactcattacatgtcatttctctagagaaactagttgggccatggctgcaggactctcacttgaaaagacatgtgtggtgatgttttctcaggcagttaagcaataaagtgtaccctgatttgcactgaaaataaagattcctttaaagggagcagttctagttatctctctctttaggtaccatatgctgaacgtttttctatgcactaaaacagcaactaggttttatactctgccttacagcctacttcacacccatttcacagggagaggaacagagaggtaagtgatttgccccaaattacataactaggaagttatttgctcagtgtggaaacttgttcagaaggtcatttcattgaaatgtaggaagagtttctggcacttctcttgagcaggagtcaaaaacctttttttgcactagcccagatagtaaacattttaggctttgtgggccatatgatctctgtcaaaactcctctacttcgttgttgtagtgcaaaagcagctatacacaatcctgaaatgaatgggtgtggccgtgttccagtacaaccttacagaaaaggcaataggctggatttggctctgagactgtagtttgctgacctcagctcttgaactgagctctttaactgacctcagctcttgaactatggtacaagatcccatggtcctgtttggtacctccatttgccctccttttcactctctgggagcatagctaagttcaaaattgaattaggtacttgtagtaagagcatacttataatcctgggatcttcatgttgccagatattaacctcttgaagtttttcaccacaacctgggcacttttctgatttgctcacttctagccccacctttgggccccttcataagcaaacatgcaggttttccagagagctgtatgctactgaatgcagaaaatttggctcatactggcctatggactatctgctcactgccctgataactattttccaagggagtgggtgccctacctttcctacatgaagttttttgctagtcttgccctaaaaattctaggtatcccttgcttttaggataaatatgtttcactgggaccagctggaaaacgaaaaatagaattatccaactaccactttaaaattggacaaagacttttgttgttgttgttggagggggtggtaaacatcattttagcagaccaaatatacttttggtgaaaggcagcctgttgcaaagacacaacacttggacaagattttgaagccctggttgcctttactactgacttaactacagtatttgcggacttgagcaagttgcttcccttctgtgagcctcaggttattcatctttgaaatgagtataatacctgtgattataattacttatctggattctgcagagaattgaaggagataatgggtgtaaaagtactttagcgcccagcactgctccttatgaaaatgaggaaataattgagatgagtgagccattgaggcaacagtacaaaaagtgctgaaaactcactgcttaaataagcacctcttactgcttttgtggcactttgtagcaatgtttttttttttttttttgagacggagtcttgctgtcttgcccaggctggagttcagtggcacgatctcggctcactgcaacctccgcctcacaggttcaagcattctctgacttcagcctcctgaatagctggattagaggtgcgtgccaccacgcccagctaatttttgtatttttagtagagacggggtttcaccatgttgatcaggttggtctcgaactcctgacctcatgatctgcccgccttggcctcccaaaatgctaggattacagatgtgagccaccgcaccccacctcagcaatgtgtttttattctgactagaaaagtaatgtttggttttgtttggctctttgcttaatatacccataataagggtacctatttgcctttggaccattagttcaaatattattttattaatatggaattactgggctccagaagccatagtcttcttagctgctccctatccccactctcacctcaatttttttttttcacttttgtttttcttctcagggaaaggtttgaggcaaagaatgtcttcttatgatccaaaaccaagcatggtggtgatttattcaccaagagattcctaagtacctgtgtgatggacatggtagaatctttgtcctgagggagctatctagatccattccttctgatatgcagccagtagccacttgtggtaatggagcaatagaaacaacactagttcaagtggaaacgtgagatgagaagtaggaggtggagagaactaaccagaagagggtacccaaataaaccagaaatatgtatgtgttagagaaggggcctattgagcgggtggcagtggcatgtgtggcattacttgctcctgtattctctgctttttacttagttgtggctttggtggtatagtctcaaatctaagttacgtaggtaatattgttatgtatcatgttttggcaatgtagactaaatacttgctcataagagtacaggacaatgaggatagtttggttttgtttactgcatggaaaatgcaggatgtttagtaaatagattcatggcgtagtgagttcactactaaaatcagactctgagaatgggtttgatttaaatggctagtttagaagactgaatttaggccacttgattgagaaaggccattttgggtaattataaaccaccaacattgtgttttgaatgttaaagcttatatttgtcttccagttaccagaatgtaagcttcttgaggagggagagaggagttttcttaatctctgaacctgcacctttcttctgtgcctagcccagtgcctggcaccaaacaggtgctcaatcaatgttgattctatgctaccaacaaaaatgagtccatgatgtttactattcaacaaatgaatacaattttagagtaaatttttactgcttacactacatgtagattttctttttagagatttcgcaatgctgatttatttcaaaataagcttgaagctaagcgacaaagctgaatgatgatttgttttttatttatttttaaatccaaacttacaattttacatgtcattgccagaaaaatcattaaataaattatgatatgcgcatatggaatactttgcaaccattaaatcaaccattaaatactatgcaaccattaaatcaaccattaaatatgttggtatatgcaaatgtgcatataccaacatattatatagttgagtaagaaaagctagtttcaaatgagtatgttaatatcatctgactcttgcaaaaggaaaaccatacatttgaatgtacatatatgcatatgtttatatgtgcatagaaaaagctatgaggggatatacctcaagttgctaaaagtggctccacctggagagggacatggaaaggagttggctaaaaactgaggtttgttatggtatacacccctgcacagtttgattttttaaaaacaatgattataaattacttttattatttataaaaatattatttaaaattttggtactaaaaacagagctccatcaacaggtcaatggataaagaaaatgtggtacatatatacaaccgagtactattcgtcataaaaaaatgagaccctgtcatttttgcaacaaaatggatggaactggaaattattatattaagtgaaataaggcaggcacagaaaggcaaacattgcatgttctcatttaatctgtggaatctaaaaatcaaaacaattgaactaatggatatagaaagtagaaggatggtaaccaaaggctagaaaggatagttggtggggcaggggagggtgaggtgagcatgtttaatgggcacaaaaaaatagaaacaatgaataagacctattatgtgatagcacaataaggtgactatagttaataataatttaattgtacattttaaaataactaaagaggtataataggattgattgtaacacaaagaataaatgcttgagggatgtatacctcattctctataatgtgattagtacacattgcatgcttctatcaaaaattttcatataccccataaatatatacatccattgtgtactcacaaaattaaaaaaaactgtgcattaaagaaaaacaaaaataaaaaccatagttcaagttataaacaaaataaaggtaatttggaggaaaactgtcttcagttatattggatatttgggggacatttttgtatgttagttagcaaagatcacttgaaaaagaagattcttccttctatgattcaagggagcctagcaaaaaataaatgaaatgaaataaaataatacaaagagaaaagattattccataaattctgcttacttatttctggcaaacttgttgacagcacatgtgaccttttggtaaaaagacatttttatatttttagttaagtttcaaatataaattgtttgtgtttttaaaataaattaaatggatgatttcagccagatcattatgaaaacacatgagatattgggttatgcaatgactaacagtgtgtaccttttcttgatatttattcataaactggggaataaaagtacattttggcccatttactccttaaataattttatgtctcccaaggagagttgtaagttgcttgatagtaaatgctatgtattttgtaccttagtgtatatattatgggatttcagcgttagaagagctcttaaatgccgtgttcatagtccaacctgtcttctgatgcttgaaatccccttgcagtaggaaatgcaaagtagagagcagacactcaataatgtagttagtgaattatttagaaagaggcattttgagcccataatgtatgataggtacttctacatttattattttattctttgcagacctgcagaaaactgtaagaaaaaagtttatttcagattcatgtgtttatttgattaatctcttcataggtttcatttttcagctcctgtcagaaaatacagattcttataaggttcaccttttacccataagaataatagtataaaggggataatgtgaaatacaatcacttcacagactgtttcaattaaataagagctcgtagataattcagtccaccacaccccattttacagatgttgaaattgaagcccccaccaaaaggaaaagacttgttcaaagtcacacagcaagtcagtggtgaacctaattaggccccctgccttccattttagtgagattcctgtgctgatagtcatacccatatcaaatcctctttggcagttatagcttgcccacagtaatgtgtcctgaaaaatatgacaattaattaagttggagacagaaccataacctctttataaaaattttctggaaagtttacatgacagtaagtaatatataattagaaaggataattcttatttcatatttatctttttgtttcagaataataaactaagctatctctactcagtccattttaatacaaaaatatttttacccggactgagtttttatgctttttaggaactttgtatctgcctcacttagttaaaatcctagctgcactaatcacttactgtggtgggcagaattctagaatgaccctgaataccttgtccttgtatgattccttcctctttaagtaaggataaaaactgtgaatatgatatcactcccttgattaggctttgttatatggcacagttaactttaagaaaggaccaatcacacaagccatttgaaagcagagggtttgggtattttttaactggtggcagaaagccacgcagagatttgaacattgaggggaatttgaatttgatgtgccagtactaacttgaagatagaggaggctgcatggaaagtggcctttaggagtgatccctggctgacagccagtaagaaaatgagggcctcagacctacagccataaagaattctgtcagtgaacttgaacttggaagtggattcttcctctagaacttccatataagagtccagcctgattgacaccttgattttggacttgtgagaccctgagcagagaatccagttgacttctgacctaaaaaaaaagtcagataataaatgagtattgttttaaactgctaattttgtgataatttgttatgcagcaataaaaaactaatatatttaccatgcaaggcaaggcatttatcctctcatgattcagtttctttttacctgacataatggaattaatttatactgctgtgaagttgtagttgagaaacatgacttctaaagtaatagaggacatgtattattaattttagtagtattaatagtaatgatactgattctcccaggcctatacaaatcctttgatacacaaatgaatagtaaaggaacataaattgtctctaggtagactttcccacaatgcaattttaggatacagaggtcatatgcctgttattctactgtggcagagaaaatatggagcctggaaaactgttcatttgcatcacatacatcttgggagctcactctgaacctggtaccataataagctctgtagacagtataaagaggaaaggaatcagacatggtgtctgacctcaagtgtctcataacgtagtagaagaggtaaaatatgggtcacactaactctactgcaaagtaggaagtgcttgtcgccttgagattgacaaaatttggtaagagttcagaggagattgtctgtgaactgggccttgaagaatagttaggatttgaataggagaaggtgaagaaggaaggcattccagctagggagaagagcacaaacaaaagcatagataaccttgaacatcatcatatgggataattcaatagttcagtataatggaagtataagatgcataaaaataagtgtagtaggaaacaagtttaaaagtatagattggggttagtcatacaaggccttgaatttcaggctaaggagtttagacattaacatttgtttttgaacaaaggggtgaactgatcacatctgtgatttagaaagaaaattctagcaatagtgtagataagggttgatggtaaagtttggaaggtggtgaggcagaggctggagacagggagcacatttaggatagaaagatgataaagagatgatttagaagagttgttttggaaaaggagaagacagaaaatgttttagaggtgtcatagagataaaattggcatggcatggtgcaaggaggtaaagcccaatagctttgtaaggtgctgagatagattgaaatcacagagttaggaagttttagagtcaggattagtaccaagacagcttggctctagatctcatacttaacacttacagtataattctgagagggtgggtaacagcaatagtcagaggaaagaacccttttatacatgatggtacaggaacaacactggcttccaaccccacagctgctctttaacagaaggtcagaagctggggagaaatatgtgtgtgtgtgtgtgtgtgtgtgtgtgtgtgtgtgtgtgtgtgtgtatgtgccatttctgggactaaggatgggaagtagattagttgaggccactgcagtggggtctgcaagttgctagcactcacccgttccaagaggccttaaaggtgttgatctgttccctgggcatcaccacattccacaaattaatgttcctctgagagaatagggtgattcaatttcactgtgcccgaaggttacttttggggttcatgtttgttctaagtctatgctaatgatctgccaactgtctgtttgtcactttctctaacccttagcatgtataaactgatctgttgggaaatgtgtagcatttataggatggtaggatttgtaacatgcgatcacaggactgtttatatagagtccctgggaaggggagagaagagtatttctgttacaaatgtggattctttggcccctcctcaaacttactgaggttcaagaattgacatttataataagcacatatccattttcaataaacatgaaagtttcataccctcttttaatgtttgaaatcctcaaataaattagtcattggtgccagagtatcaaataattatggtacagaatgtatttctctgaatgacaccttctcccagagattctgatatatattcctctgcactcaccctgtttgataattaccagtatatggaccatttacctgaagaataagagtagggtttcctactgttgttgaaaatttgcttgactcttaacaacttgtgtgtgactgtaacaagatcacacagggtaaacaatattagcttattcaaccactggctgaagaaatttaggaaagtgaacacatttttctttacatttctctttgttctgtgagccttttatgctggaatagttttcactgcaggctgttattgtctgcctccagaggagggagttgacctagcagtggtaactggagagtgttttttgaaacctctttccaaggttagttgccaatggcatctttggaacagtgtccttcacttttgtccctcagggaccagtgtgagaatgggaactttatgatctggagctggttaagtgaagtccaaaaataattaagaaagtgtttccttccctgggaatgagttcagtaggaatctcaatgtattgtagagcactaaggactcagcctcaggcatttgcaaaggattcttccagttgcctgtgttacagaggacacagttggcatttccttttggtgttgaggggagatgtgtacatggttgtgagatgactcaccctttttgcttagatagttccactttcattgtggacagactctttggagggccagtttggcatgcacgtgtgtgttcattccatcctggagcattctttatgagaaagccatttgttgagtggtttgccattttgttttacagccactctgtgggctatgaaatggtcatccggccgctttatttgtccctaaaaaaagcagtttttccctttcttatcttcatggctgccaagcagcagaaagagtaactcagggaagccatgtgatagccttttatctgtctgttcagaaactgatgatgtattggatttgataattcatcaaatctgaggtttactggtttgtatttgcctcaaaatgggcatataatattttgtcaggtaacataatagacagatcattggcattgctttattgaagtgaattaattcaataagcctgtaagtgcctgacatgtgccaggcactgtgctaggcattctgttaacagatgagacaaatctctgtcttttaggtgttttcagtcgaacaggggagacaaatatatgagcaaattgctattttttttaaatttcatagtgtacatgagtataaggtgctgaatatgtgattgattctgagggaaaagagagataagggaaagttctcagagaaagtcaagctgagggaagaaaagcaccccagacagagggactagcatagagctatgctagtacattgagtttaagggaatggcacatacttcactgttgcttcagcagacagcaggcctgttaggttacaaagggccttggatgacatgctgaggggttttaaaattttatttaaattttaattgacaaaatataattgtatatttctgtgaggtacaatgtgacgttatgatatatgtatgcaatgtagaatgattaaatcaagctaatttgtatatctaccacctcacatacttattttttggttagaacatttaaaatttattctcttaacaactttgaaatagacaacacattattatcaactgtagtcaccatgttgtgcagatctcaaaaacttctaacaaaaactttttaccctttgaagatattgaactgttttatgaacacaatcttagaaggatttaaaaaataatttgctattcaccaagtacttcttacgtacactgtgcatgaaatgattattactttttctaatattagttttcttgattgaggcttggcaattattagtttgtatgcctttagaaggatcataagcagaggtttatcccagtaggatttgcattttagaatgatgactttgggagtaaaatacagagaagtgaaaccagagatagtgggatcattctggagtctgttgcctacactgaacagtagttgagcgaaaaaggatgggcagaatgtgttggttctgggtattgcaaattcatggcacttgagtgaaaaagtttaagccttctattggctctttgtgaatatcttcaacatgcatgactacaaatagaacacatggttttgttgttattgttgttgtgtttttgtttttttttttatttgagatggagttttgctcttcttgcccagactggagtgcaatggcacgaatttggctcaccacaacctccgcctcccaggttcaagcgattctcctgcctcagcctcctgagtagctgggattagaatcatgcgccaccacacccggctaattttgtatttttagtagaaacagggtttctccatgttggtcaggctgtcttgaactcccgacctcagatgatcctcccacctcggcctcccaaagtactgagattacgggcatgagccaccgcgcccggcccacacggtatttttgaaagaacagtgagcttggattagaacactagtgtccaggccctgctgctactacataagtaattatgaatccatagccatcttgttgctcttcttctctgagccttggtttctttagctataaaatgggaagttgaaactttctagctacttctttgagttatgagtaacaagttaggtaatacacttaaaagagaatgtgctatacaaatactggttcttaagacagctgttgttaatgtactgagtattatgcttacctcacagggttattgtgagcatcaaatgggataatggatttgtaagcattttgtttaaagtgtgattcaaatgttaagaattagtaaaaatagtaaaagaacaattcattctccatccagatgttctgtccccactgtgacttatgtgctcattcagagttgtacagaaaaacctccacttaattttcacaagctggagttccacatgtaacagaatcatatgggaccaaaaaattctctgtattggcttcttccctgccgtattttggctctgggaccaacaagacacccattttgcatgagctgcctgccaccaactttgcgctcacatctagttctgttgcccatgtgcaagctgaatttgggcccgggcccccagatctaacatgaaactcaagtttccttctgttcaaactgtccaggcataatagtcttaaagtccgatgcccagcagagccgtagatttttcactggccaaaaatcaacatgaaaccagatgtatctgtaaatctagtttcataacactttgtagtcaatggaaatacagtagcaggcagaccagaccagagtttactatttgcagtggaattaataaccacatggaaactttgcctttggtatctgcgagatggaagataaaggtgcgaattcaaagcagttcccaccttaccctctaaattccaacataaagaggccttgaatgtccttctatcttattgtatatttcattaacagaagtatgttcctagctacttagtcattctatctctattctcctttgttttaacttcagtggtgccagcttaagatgctctggctttcagctttcatggagcacgtcatgtttttaaacttatctttagggacagaaatgttaggaagatcctagttcctcatctctttgctcctgacaaggaaatttagaattgcctaaagaaaggatgtattggccaacctaataataaatcagtattagtgaatctaaagcatatttgaaaaatttgtaacatgagttgaaattcagacctgcaatgaagtgtttttaaaagatttaaaatcgaaataatataaaagaatgttaaaaacaagtaaaacatatcactagttaatcactctaccaaaattcatttttatgtttgcatatttaaccatttttattttctatatttgtccatgaacatgtgtttttatatattgtttatattaaacatggttttaatcatggcttatttcttttatgttttacttcttttcctttgacataaaatattgtattttttaaattttaattgcttcttggcatacccttccaatattggtggctatatagattgaagttaaaactaattacaatcagagaaaattaacaattcatcccttcaatctcattagtcacaagttaaatactcaatagccacatctatctagttgctactgttttgaatagtacagatataagacattttcatcaacacagaaaattcacttggaaagcattgccctggagtaaatgtgccagactgtactatatcatttttctcttgttggacatctaagttatttcttattttttaaatattttatataacttgacggtgaatatacctatgtacatagctatttgctttggctgaattatttcttagaatcaatttcaaaagtggagttattaggtcaaagagcatgagaagattttttggaacctgcagtgtattgccatagtcctctcaaaaaagtttatgtcaacttaaagtacttctagcagcatatgattgtactaatttcgctgcaatctcaacaacactggacattataagtttttattctaccctattttccattaaaagatagcttatgcttgattgactttgcattttattttattattaataatgatgtggtttccttttttctagattttatttttatttaaggcatcctttgattttaacctgattttttttctctaaaaattattctaagaaaagacaaaggtgatacgaaatatatcctgagtttttatttttttcttgcatgggatttgtatatttgcacctttgcccatttatactatgatttcttagtgtcttccctggcaattttaatgaagacttcatgtatatcaatttttccacaaatataatctttctaaaaatatgttttttccacaatataattcagacgtattctccgaaatgttggaaaaacttaagtaggcatcaaagcatttgaagatttgtttaaaggttgtttttataccagttttaaattgtaatttaagggtcataaaataggtgaaaattaaatcatttttcagtaagggggcaagaccacttaactcttggaaaatacaggaaacgtagatttctagaggccaagaaggaggtagggattattttgtaactgcccccaaccttctaacctgtaatgaaacaaacactgaaggcccttaaacatttttaggcttaattggctgtccttgtacttagggcacatctaaaaatcctgaggcaaccactcaagagaacatgcttttgttaattcaaagggagctgtcctacgagtgtccagaatcctctgtagtcttgggcctggtgcttgagagacccaaaggaaaggtcaatggaattacagcttagtgttagagctttcatgcatcacactaattaattaatgtcataaaggtctctctcctgttatgggaaaaagcagcaaataggaacttctggtagggtgcttaaagttggtttgatattttttattagcatttttaactaatacaagtaatacatgcttatggtagaatgataaaactgaaaaaaaaggtatgaaaatttagaagttctcctactcatgacctcaccccttctttcactcccagtttcactcctcagagggtaaccacagtgactagcttcttgtgtttggttcctgagattttctatgtatatatattgttagatatatgcatggtatgttttcaaaattcctgttacactataattactgttctacaacttaattttttcacttaattaatagaccttatatatgcttttccatatcggtatatatagatctatataagttttcttaaaggttgcacaactttcaattgtatggctgtcttgtaatttactttttgtttcccttactaatggatatttcatgtttccctaactcttttgatattaagagtagtgctgcaattaacatccttgagaggcagtatatatggtgtttaagatgaatggttctggagccagactactttggattgaatattggtgccaccaattccttgctgtatgaccttaggcaagttgcttaatttctttgcctcagtgtccttgtgtgaaaaaatggaggcaataatggtcactatccagtagggcttttatgaggatttagtaagttaataatgcactttaagaacttagttatttttagattaagtagtgaaggactatataattgttagtataattgtatacctttattatcatacttttgcatgtatagcaataagacaaattcttagatgtttaaccattggacataaggaatgtacgcattttaagtactggtagatattaccttttccctgccaaaaattgcaaatattggatattaactttttaaatcttagtaaatctgataagtataaataacagtttatcatcattttaagttgcctatcttaattttgtgtgaaaatgattatcttttcacatgtttttttggccatttatgtttctttccatgtgaactaactgttcctggccattgcctatttgttgttgctgttactatatggcttttcatctgtttcttattggtttatggagctctttgtatatacaggaatttagcctctatttatatgtgtgacaaatactttttccaatttatctttaaaatttgtttatgttttcctattcatcagtctaaaattatgtagttaaattcatcattgttttttcttatgactttagagtttggagatcatgcttcaaaggtctttctaggtggggatgatttaaatcatgtactggaagtatttttgccaaaaagactcacgaattatggatgttagagctaaaagggaccttagagatttcctagttcaaccaccttttcttcatacctttttaatttttctctgcagatgaaaagaagtttagtcctaaagaaagaaaagagtctaaaggttctccagtaagctaatggcaaaaatgtagactggaacttctagctcctgatgtgtatttcagtgatcattcaatttaaccagatggtttcacaaaaagagctttctactaaaaaataaaatacatacttaagcaactcagagaattttttttttatttttcagattaattttcacttagagattcatcagcatatgtactatacatgtacaaatcacctgtgtgttttggatatttagttaaacaaatgtgcaaatattttaaccaaaggagcatattcatttgtgttttattttcttaatggttttcgttatgaatgtgaaatgtgtatttaccttaacagaaattaagtatatttttggtctgacatatatgagaactgaaaagcattggcttggctgctaactgcattctcatctttctttctctgctttggcaaagtctgggattaaatctaataccttttaaactgtttgggacttcagccagagtgacctgtcttgaattcagaactgcgcagatcattccccattctaaggccctctcatgcctcctcattgcctgtaggatgagatccaagtaccttagcatagcttatgcactgtagtcacttgacctctagcacctatgcagtcttccagtcttatttacacattcctttgcacatgctgtttccccgtgtggggcaacttttttcttgcctgtctgcctgcctaagccaacttaaataaacatcatttctgtaacttctgtgaagccttttccaatctctccactccaagacgaaggtgtttctataggcatgacttctggaatggcagatcaaggatctggtggaccctctactcagtgaaacaaccgtttaactagtaaaaatgatcaatcaaccatttaaaatcttcagaaaatatcctaagggcacatagcaaaaagagaaacatttattcaagaaaagctattaagcctcagtaaaaacagcaagagtctatggcatttgagtcatgacctgttcctaatccttcccttatctccattcttcaggcaagtgcaaccaagaagatggaggcttcctctctctcaaaatcttactccatagttataatttcacccacaatggggcagaccacaagcatctcttttttttcccccagccctatattacagaatcactgttctaggaaggcatagcttagaggattggagattccttccacacccactttctacgtatgagggctttgccccagggatggtaagtcaagaatacagggatcctgcttgtgcctgcctcagctcatatataaggtaaagcttccacactaggaaaggcaaattaagaggactagggaatataccgttatccccagggtccacttgtagaacaggggtgtcattctgggagaagcaggtcactgccccacttgtggaacaggggagtcactcgtcactgtccctggttcaaattctattgcagtgacagaggttctgtcccagggaaaggcaggttgttaggatggagaactccacagttctccctgaggtgactgactttatttggaacagagcatgaagaagttcatgcctaagggcactgtcaaaaataatggagatcttggtggtgagcaattaagagtggattggtagctccatgatactagtaacaacaagcaaaacagcagaccagcatggaggataccagagaaccagacaaaggaatcactaagaagagcccttgtggaattgcactcactgctgggtgtgtggaaagttatgcatgtgtgctttactgtaccctctcaaaagcaacctaaacaggatgtggggtaggctctaaagcattcctcaagccacacatggatccatcagtaaaatgtggagggcttaaggataaaaaggcttaagtacaatctctggccctacattttctaaatgttatgccaccctgaccaaggggcaactcctacaaagccaggcaaaataataaaatcatatttgtctctagtggaatggataactatgcctaaaactgtgccctttgaaaagcaactagagagataatttctgaagtgtttgtccctacctgaatgtgtggcaaaattctaaactccctgaagtgtgaaagtggtttccaagccacatgcacatccagtagtggtaaagggtgaaaatctaactggctaagagggcttcatagcaacattaaccaaaaagtggtttatgtagtctttgcctgcttcataattccctaggcattctatgctattctgtactcagaaggcttaaagtcaggttagggaaaggaggcctatgaggttactgtgcagaggcagtgctgggaaataaatgaagttaaataaatttaggccatcgtggtttaaagaatggattgtggagataagaaggataaaggaaacccagagtcaagaaaaataaaacttttcattggtgccatgccaacccatatccgagcctgaggcaaaaggaaaaatgtgctccctgatatacacttatacaaaatatcaactaattttatttgttggactgaatagaaaaagtcaacaaaaattaaaaataaaaaaatcatgactatatttttaataagtggtttatgtaaacccagagttgaccaatgggatgccagtctcaaccataaaaacaaacaaaacattgtgagtaacaacaccagaagtctcaaagtgtcagggaaaccaatttcacagaagcagttcagccaagtcactaaacaaacaaacgactaagcaaaaaacaagaatgagtctcagaaagggtcaagtcagtatccagagttgttacaatatagtatctaaaatattgttttgaactaaaaattttgaggcatgcaaagaatgaggaaagtatgactcatacatggtattatatgaaaaaatcaacaaaaaactatccatgaggaaacaaagatgttgaaattcactagggaaagactttaaaaaccagctatttaaatatattcaaagaactgaaggaactatgtctaaaatactaaaataaagtataataacaatttcttgtcaagtagagaatgccaataaagagatagaagttataaaaaaagaaaaaaatggaaaatctggagttgaaaattataataactgaaatgaaaaattcactagaaaaggtcacaagaagatataacttggcagaagaaacaatcagcaaattagaacatagatcaatatagattattcattttgaagggtagaaagaaaaaaagaatgaagaaaactgaagattcccaaagaaatgtaggacatcttaaagacacatcattaggagaagaaaagaagggaaagaaaagagcagaaagaatattttttaaaaaatggataaaatcttccaaaatttaatgaaaaacatcaacctacacatcaaagaaaatttttttaaaacttcaagcaggaaaatgtaacgatattgatacttagatacatcatagtcaaaatattggagtcaaatataaagagaaaattttgaaattagcaagagaaaaatgaaatggaaccacaataagattaacagctgattctcatcagaaataacagagagcagaaggcagtgcaatcccatattctaaacgttgaaagaataaaaaaactgtcagtcaagaatcatatattcaacaaaactatctttaaaggtaaaaatgaaatgaagacattcctaggtaaacaaaggctgagagaatttttcattagctgacatgccttgcaagaaatactaaaagcttcctagacagtagctttaatctgcatgaaaaaaaattccaataaagggaaatttgtaaataataaaaatacatcattatatattcttttccacttaacttatttaaaatcaatttcttaaagcactatctgtaaaattgtattgttatttgacaataaaatgtaaaagaggggagtgggaattaagctaaattggagtaaggaaatggtatcacatggtaaattgaatttacagaaagaaatgaaaaaattaagtggcaaatatgaagagtaacattaaaaacttctataaattaattgtggcctcctttcttcccttagcttctgtaaaagacataagactattaaaaatgacaataattataaacacattgttttattagtaataaacatagacaaattatctacaacaattattattatacaaggagagggaatggagctgtagaggagtaaagtttttataacctactggaactaagtcagtataaatatgatgtcgattctgttaatttgagatatatgttagaagccccaaagtaatcactgagaaaatgatgcaaaaatacagttttaaaaagttaaaaacatagtttagcttatgtgtgcctagtactccattattatttttttattatattttaagttctggggtacatgtgcagaatgtgcaggtttgttacataggcatacatgtgccatggtggtttgctgcacccatcaatccgtcatatacattaggtatttctcctaatactatccctccccctgtcccctaaccccctcaacaggccctggtgtgtgatgttcccctccctgtgtccatgtgttctcattgttcaactcccacttatgagtgagaacatgcggtgtttcgttttctgttcttgtgttagtttgctgagaatgatggtttccagcttcatccatgtccttgcagaggacatgaactcatcctttttatggctgcatagtagtccatcgtgtatatgtgccacattttctttctgcttgttcccaggagaaagtggctgaagattccagagagaagctgaatgcagtttaattctttttgccataaacacgacaacccattttcctgcaagctgtgttagtttgctctcttcttggttcattcattcatttattcatagcttccataaatatttaacaaacactaattaggggccaagccatgtgctaggcacaggggataaaactgtgaacaaaacaagccccagctactcttaaggaactgatagacaaatggaccagcaaacacgctggtcctgttttgaaggcaaagcgcctggtgctcctgatctcatgagcacagagcatttagcctaagtctcatcctcctaaggcctcagaaataaggccttattttaataagtgcaagtcagtcatttgaagactaaatcatagaatcctagaaaactagtaccgggagcaaggcaaaagaatgggatgagcatgaaacatatattcagaagttgtggtgtgtaggtatataagccaagctcttttcttcacttgcttgctaagtcacttagcttttctgcctttttgtttgctctgtctggaaatggagttaatgaaatatatctacatgatagggatattgagacgattaaataagatgctgctgtcacccagtatgcccttaccctgctgtacttagaagtatatgaaattcattttctaaatttttgtatgagtgtttcatgcatgcccaccaccatggaagctaccttaagacagtgagggactttgtttaacttgtttgtactacatcctcagtctaatggtgtctggcttatggtaggcaccaaatataattttattgacagaaaggatgataatgaatgtgaaggcatttttaagtttatgaagtgttgtgcatattgttgttaattttaagctgttacgttaaagaacccctaatccaactctcttgagttttatagatatcatagaagatatatcttcccttgacatagaagcttcccttgaaggttcccttgactcatgtatttgcctcacagtgattgtgcagatcccacaagataaatttatgtgaatgtgctttatgtgcttgaagtgctccacaaatatgggttttataagatgagaaaatagagtcagggagaaaggtgactgatccaaggtcatgcaaagagttagtgtcagaatttataatggaatttcaggctcccaactcccactccagtatactaaggcagattccagagaagaaacagtggagagcaggcactgatgagggacaaagaaaagcaggctccgtctggctgcaacttgtctcttcatggcaaaaagaaactaggaaagtgctatgccagagacgacatgataactttgcagaatggaaagagcttgtttaccacattgaatactttatctgtgtttatctaacgacagttccaccagctctttaccacttgacttttgcctaattcaaaaatataccaactatgaaacattttccttctcagtttttattctagattacattttgttcaactttatcttaatgtgtagtgtagaaagagtaaggtaagagtatagcaagtggttattttccatttctactgaggacagagaaataatctaagggatttgtattagagatgaagaagtgcatggccaggacatgagagatactgtgatagaatggatattgtgaagtctttggtagtttttgaggggaaaaaagagaaggttttctttgtctgatatagtttagcaacgtcttaatttaggattcaaaagttgttcagggtccatcttggccttcaaattaagatgccctttgagagataacattgttgttttcaaactctgttctgtgacttaagaatgagaggagaaggaagaaaagaggagaaaatttgagggaaaagtgcccaagcagcgtcaaggctagacactggaaatttatcaatgaaagccacatggtggatgggaatcagatatgtgcatcaattatttgtgttccaatccatatagaagtaccgtataatgcaccaagctaataggtgctttgaaagaagaccatacaagtggagatgtgttcctattctatctagggatagagtcaggaagggcttcattgaataagtggtagcctcttgggctgagacctgagttatgagatgatgtggcaaaggagacagatggctgggggcaaggtggggtcattgaaattggaggcagtagcaatataagcaaagctacaggggcatgaaaaagcaaggttagattagtgaattgcaacagggtggtactgctggaaggtcacatggaaaagattgtgaaggtattgagataagaagctagaaataagctttgaatgccatcctagtactttgaatttgcatgctgtaagccaagtggttttcacttggtcatttaataaaattacagattctcaggtctcacctgtaacttcagattcagaagagtctgctaactgaaggtggaatcagtgttccatattgctaattagctcctcagaggattctaatatatcagtgagttatgaccactgctgtaagccataggtagttattgaaagctgctatggagaggagccacagaagcagatgttttagataggattcctctggggtcctgtgtaatttatggactggagaggatcagacaggaagcagaaagacttgaataagacagttgcagttattttggaggcaaagattctctctctctctctctgtgtgtgtgtgtgtgtgtgtaattgtaggaactatttaggcagtaaaattaacagatattagtcactgattgactgagtggatggcagtgataggtggggtgcgttgagggaagtgtattacattaagtccaggatgactcatggttttctaagttgagtcattggggattgccatccaatgtgagaaactatatagtcttatcatagttgatcttggaggtagacttgaattaaaatcttgaagccatcaattgctgtatgtgggtcttgggcagaacacttaaggtttctggacctcagttatttcttctgtaaaatgaggaaaataatgcatacctcatgcatttgttgtaaagactaaatgaggttaaagtatgtagagtgtagtttagtaactgggacgtatagtggtccagtaaacatcagctgttattattgtgctatatgttgtgatgtgtactggagtgagatggggtaggggattttttagtctctgccaatgactcctctccccatgatcaaaatcagaaaatcagtctcttatgtgttgaggagtgagacacttctcccaagtgtttaaggctaataccttgccttgttttgccttgggccagacctcactacacatctgtttaagagatcagggtaagctctgttcttggtgagtatctcaatggggctgtttttctagttcttgtagtttctttgggccaacatgaaatgtctaaccttggcttcttggttgtggattctcgtcaacatttcactgctacccaagttgtgtctgcttacatgatgctatcttccttcttttgggtttctgaagccctcagacacttggctgaacatttttcacatttcttaagctatatcatctgtgttttccctgccacagacaaagtcacaaaaggactttaagataggttttggttttttttttccccagggtttttatacattttgggtaagggcaagtggtaaatgctgcttttctgccttaaccagtagtgtctgacagaggaggtagcatgatgattgcagagctcactggactgaaagtcagatgctttacccgcctagactctagtaccaaggggaagatggagtgagatggggtaaatggggagaaattaccatttattttgagtgtgccaggccttttctcatgtattgtctaatgcatttgtcacaattctctttgggtttgaaatgtgattttcttcattttatagataaggaaacttatgggaagggaggttaggttcatcttgtgcccaactttacatggctagtgatcaataatagtgagattcaaactcagatttctctgccccaaagcctttgctttttcctcttttgacactgtaactaatgagaagatgtatttaactctgagtctcatttgcctcaactgtaaaatggagctctgtaactcttgctctgtatgacagtaaatctcctcagaccagacttatgataggggataaggatatttgtatctttgggcccctaatgtattgaaagtgcttctaagtgcctggcacatagaagggcactcaataaatatttaccacattttccagaaagagggtagctccataatgggtgagatacattttggtggctactgtagtgtttaatgcttttaccatctgttaaaatgattttggagtatagctagataactgatgatggttgttatatagattttttcataggttgcctgttccaaattctatgccgtggaagaagttaaatatccagaatttgacaggaaatattattctacaacagatccctggcgtaagaatgataacacctgtgttctagtctcagacttgcctctgaataactgtttctcctggtcaattctctgtctctatctaggcttgaaatttcccccaaatgatgaaggagttggactagtttagtggggttcagcctcgagtggccattaaaattatttggggatctttgaaaaaaattagatgcccagatttttgtcgttgttgttgttgtttttgtttgtttgttttttaattatactttaagttctgggatacatgtgcagaacatgcaggtttgttacataggtatacacgtgccatggtggtttgctgcacccatcaacccgtcatctacattaggtatttctcctaatgctatccctccctagtcccctaaccccagacaggccctggtgtgtgatgttcccctccctgtgtctatgtgctctcattgttcagctcccccttatgagtgagaacgtgcagtgtttggttttctgttcctgtgttagtttgctgagaatgatggtttccagtttcatccatgttctttcaaaggacatgaacccatccttttttatggtggcctgatattccatggtgtattgaactgctcactccagttcaattaaatcagaatacagaatgttgagaggagcatcagtattttaagaaggccccctagtgaagttcaatgtgcagccaagggtgagaaacactggactagatgattgataagggccatccaactttgatagtcaacaagagacaatgctatagagtatggtggacagagcatgggctttagagttagccaggtatgcattcagaccctggctctgttacttactagttgtgtgatcttgaagaaatcaaaatggagatacactatgtacctggcagtaatagttgtggggattaagcaccttcaccagagcttaggacataataagcccccagtaaatagcttctttaatatcagaagttcagatggaagatgtgagaaaaatattggttcagtaagatttaacaggtaaattaaaatcaagtatttgaaaacattttcctgtttctttagcaatggattccagaaacataatgtggaaatagctctcagtccttagatttgatgacattgcagaaagaaatctggctagtcgtcccatggctgattggctatgatggctagaaagccattggaaaaaaaaaattggctcacagaagacagcagatgtggcttgggaaatgcaaggacatgactgtaataaggatttgtctatccagccccatttatgagagtgattccaggagaaaaggacagatttgtattgtcagtgggatacgctgttaaaaaacacttttgctactaccactccagctgtcttggcatgtttgttggtgatgtaagctacagaaaatggaaatcaccaatagggctatagcaacctgatgcatagtgacaagtaattgttctattcatggttatgtgttgtacagagcacttgctgcatgtcaggtttgagacttgagtatgcattagggccatggacacccccatcttatctttaagtagatttcaaagtaaatatttgatgaatatgtaaaatatttagtttggtcagtcatagggctgagaacatggtggcagttacctcctagtatctgcaagcaaaaaaagttttttcttcctatagcaattgccatctcagccacttttgcagcatttctttttgctacactttgcattaaccatttgtgcacttgtcttagcctcaaacaggccatgaaagctccttgaggataggggctatgtctttttcatctttatatatgcatcatttagcagagctgtccctttataatgtactaattactgaatgaagggatgcatagatgaataaatgaatgaaaagtaggagtgacctgtcttctctctttcttcacgatggggactagtgtgtgtatataaggggataatttttgtgtcacataaaatataaccttacttagaaggcaagacttccagaatggtggaatgagaaccacccccccgcccccataaatccgccctttcatgaaagcagtgaaaacgctagcaaacgttgtgaaaattaacttttccagaactctggaaaggaaacagaggcttccaacaatctgagaagaatgtattcaagaaaaacttcggtaagctctctgatcacagtggaaataataaacaattagtaatagaaggatagttgggaaattcaccatttgtgggatataaacagtggatcaaagaagaaatcataagggaaatgagaaaatactttgagattaatgaaaatgaaaatacattgttccaaaacttacaggatacagccaagctaaagcagtacttaaagggaaatttgtaactgcgaaggcctatatcaacaaagacaaatgatctcaaatcaagaacctaaccttccaccttagactaggaaaggaacagcaaactacaaagaaagcaggaagaaagactaataaagactaaaagggaaataaatgaaataatagagtagaaaaacactagaatcaatgaaattaaacattgattctttgaagagatcaacaaaactgaaaaaaactttagtcagattgaataagaaaaaaagagagaaaattcaaattatcaaaatgagcaatgaaaatggggccatcactacctaccttaaaaagaattttcaaaggattaaaagaaaatgccattgcattagttcattctcacacaactataaaaaagctacctgagatggggtagtttatgaagaaaagcgctttaattgactcacagttccacagtctgtacagcaggcatggatcatgaggccttaggaaatttacatcaggtgaaaggctaaggggcatggaagacatgtcttcacacggcagcaggagagagagcaaagagggaagtgccacacacttttaaaccatcagctctcatgacaactcactcactatcatgagaacagcaaggggaaaatctgccctcatgatccaattacttcctaccaggtcccttccccaacactggaaattacaattcaacgtgcgatttggatggtgtgacacagagcaaaaccatatcaaccatactgtatgccaaaaaattagatgacctagatgaaatggacaaatactcagaaaaacacaaactatctaaagtgaccagtgaagaaacagaaaatctgagtagtcctgtaacaagtcctgtaacaaaactggattagtaattaagaaacttcccacaaagaaaagcccaggttcagtcttcactggtgaatactatcaaatatttaaggaagatttaatccttcacaaattatttcaaaacttggaagaggctggaaccctttccaactaattctgcaaagtcagcattaccctgatgccaaaaccaaagatatgacacaaaaataaaactgcaggctaatatcacatttgaatatagataactttctaaaaatctcaacaaaatgctagcaaacagaattcagcaacaaataaaaagggttataaagggtgaccaagtaggatttatctctggaatgtaaattaacattcaaaaacctaagaataggaggaaactttcttaactttgtaatggacatctctgaaaaacacacagctaacatcatactaaatagggaaagattgaaatttttccttgtaagatcaggaacaagacaaggatgactgttctcaccatttcaatttaccattgtattgtagattcaagtcaaggcaattaggcaaaaaaaaaaaaaaaaaaaaaaaaaaaaaagaaagaggtaaaaggcacccatattggaaaggaagaggtgaaaatatctatattcacagatgacatgatcttatacaaagaaaaccttaaggaatccatgataaactattaaaacgagtaaacgagttcagcaaggtttcagaatacaagattaatgtgcaaaaatcaattgtatttctgtacactagcaatgagcaatctgaaaatgagattaagaaaacagttcactcacaatataatcaaaataccagaatacttaaaaataaatttaacaaaagaagcgtaagacttgtatgctgcaaaccacaaaacactgtggaaagtaattaaaaatctaaataaatagaaaaacatcccttgttcatgtactagaggactcaatattgtcaagatggaaatactccccaaagattgaaggaaatccctatcaaaatactggctgttttcttagcagaaaatgaaaatctgaccctaaaattaatatttaaatacatggaacctaggataaccaaaataatattgagaaagaaaaacaaagtcggcgtacccatgcttcctgattccaaaccttattacaaagcagtggtaatcaagagtgtatggtattggcataaggacaaacagatcaataaatggaatactattgagaatccaaaagttaactcttacatttaagaccaattgactttcaaaagtgttgctaagacatttcaatgaggaaagaatagtcttttcaataaattgtactggaaaaattggatatccacatgaaaataaaagattttggaccacttcaaacctgcaaaaaaaataaaatgatctcatggtgtatcatggatctaaatgctatagagctaagatgataaatctcagaagaaaatatcaaagtaaatctttatgaccttgaagtaggcaatggttttttggctataacaccaaaagcacaagcaataagagaaaaaaaatttttttaaaaaaacccttgattattttattaaaattttgttgtgggtacaaagtaggtgtgtatatttatggggtatatgagatattttgatacaggcatacaatgttcaatgatcatattaggataaatgaagtatccagtacctcaagcatttatcatttgtgttacaaacaatccaattatactcttttagttatttttaaatgtacagtacattattattgtagtcattcccttgtgctatcaaatactatatgttattcattctatctaactatattattgtacccattaaccatccccactcccctgcctcccagctacacttcgtagcatctggtaaccatgatttcctcttatctccatgagttcagtagtttcagctcatggagatagacagaactaattttattagctcccacaaattagctcccatgtcagaacatgtaaagtttgtctttctgtgccaggtttatttcacataacataacgaactctagttccaaccatgttggtgcaaatgacaggctctctcttttttttttttttttttttttttgagatggagtctggctgtctcccaggctggactgcagtggtgcaatctcagctcactgcaagctccgcctcccaggttcatgccattctcctgcctcagcctcctgagtagctgggactacaggcacccgccaccatgcccgactaattttatatatatatatatatatatatatttattattattatactttaagttttagggtacatgtgcacaatgtgcaggttagttacatatgtatacatgtgccatgcaggtgcgctgcacccactaactcatcatctagcattaggtatatctcccaatgctatccctcccccctcccccaccccacaacattccccagagtgtgatgttccccttcctctgtccatgtgttctcattgttcaattcccacctatgagtgagaacatgcggtgtttggttttttgttcttgcgatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaataatgccgcaatgaacatacgtgtgcatgtgtctttatagcagcatgatttatagtcctttgggtatatacccagtaatgggatggctggttcaaatggtatttctagttctagatccctgaggaatcaccacactgacttccacaagggttgaactagtttacagtcccaccaacagtgtcaaagtgttcctatttctccacatcctctccagcacctgttgtttcctgactttttaatgattgccattctaactggcgtgagatgatatctcattgtggttttgatttgcatttctctgatggccagtgatggtgagcattttttcatgtgttttttgggtgcataaatgtcttctttttagaagtgtctgttcatatccttcgcccactttttgatggggtcgtttgtttttttcttgtaaatttgtttgagttcattgtagattctggatattagccctttgtcagatgagtacgttgcgaaaattttctctcattttgtaggttgcctgttcaatctgatggtagtttcttttgctgtgcagaagctctttagttgaattagatcccatttgtcaattttgacttttggtgttttagacatgcttttggtgttttagacatgaagtccttgcccatgcctatgtcctgaatggtaatgcctaggttttcttctagggtttttatggttttaggtctaacgtttaagtctttaatccatctcgaattgatttttgtataaggtgtaaggaagggatccagtttcagctttctacatatggctagccagtttttccagcaccatttattaaatagggaatccttgccccattgcttatttttgtcaggtttgtcaaagatcagatagttgtagatatgcggcattatttctgagggctctgttctgtttcattgatctatatctctcttttggtaccagtaccatgctgttttgattactgtagccttgtagtatagttagaagtcagggagtgtgatgcctccagctttgttcttttggcttaggattgacttggggatgtgggctcttttttggttccatatgaactttaaagtagttttttccaattctgtgaagaaagtcatcagtagcttgatggggatggcattgaatctataaattaccttgggcagtatggccattttcacgatattgattcttcctacccatgagcatggaatgttcttccatttgtttgtatcctcttttatttccttgagcagtggtttgtagttctccttgaagaggtccttcacatcccttgaaagttggattcctaggtattttattctctttgaagcaattgtgaatgggagttcactcatgatttggctctctgtttgtctgttattggtgtataagaatgctgtgatttttgtacattgattttgtatcctgagactttgctgaagttgcttatcagcttaaggagattttgggctgagacaacggggttttctagatatacaatcatgtcatctgcaaacagggacaatttgacttcctcttttcctaattgaataccctttatttccttcttctgcctaattgccctggccagaacttccaacactatgttgaataggagtggtgagagagggcatccctgtcttgtgccagttttcaaagagaatgcttccagtttttgaccattcagtatgttattggctgtgggtttgtcatagatagctcttattattttaaaatacggcccatcaatacctaatttattgagagtttttagcatgaagcgttattgaattttgtcaaaggccttttctgcatctattgagataatcatgtggtttttgtctttggttctgtttatatgctggattacatttattgatttgcgtatattgaaccagccttgcatcccaaggatgaagcccacttgatcatggtggataagctttttgatgtgctgctggattccgtttgccagtattttattgaggatttttgcatcaatgttcatcaagcatattggtctaaaattctcttttttggttgtgtctctgcccgtctttggtatcaggatgatgctggcctcataaaatgagttagggaggattccctctttttctattgattggaatagtttcagaaggaatggtaccagttcctccttgtacctctgatagaattcggctgtgaatccatctggtcctggactctttttggttggtaagctattgattattgccacaatttcagatcctgttattggtctattcagagattcaacttcttcctggtttagtcttgggagggtgtatgtgtcaaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcagtctatcaattttgttgatcctttcaaaaaaccacctcctggattcattaattttttgaagggttttttgtgtctctatttcctttagttctgctctgattttagttatttcttgccttctgctagcttttgaatgtgtttgctcttgcttttctagttcttttaattgtgatgttagggtgtcaattttggatctttcctgctttctcttgcgggcatttagtgctataaatttccctctacacactgctttgaatgtgtcccagagattctggtatgttgtgtctttgttctctttggtttcaaagaacatctttatttctgccttcatttcgttatgtacccagtagtcattcaggagcaggttgttcagtttccatgtagttgagcggttttgagtgagattcttaatactgagttctagtttgattgcacggtggtctgagagatagtttgttataatttctgttcttttacatttgctgaggagagctttacttccaactatgtggtcaattttggaataggtgtggtgtggtgctgaaaaaaatgtatattctgttgatttggggtagagagttctgtagatgtctattaggtctgcttggtgcagagctgagttcaattcctgggtatccttgttaactttctgtctcgttgatctgtctaatgttgacagtggggtgttaaagtctcccattattaatgtgtgagagtctaagtctctttgtaggtcactaaggacttgctttatgaatctgggtgctcctgtattgggtgcatatatatttaggatacttagctcttcttgttgaattgatccctttaccattatgtaatggccttctttgtctcttttgatctttgttggtttaaagtctgttttatcagagactagaattgtaacccctgccttttttttgttttccatttgcttggtagatcttcctccatccttttattttgagcctatgtgtgtctctgcatatgagatgggtttcctgaatacagcacactgatgggtcttgactctttatccaatttgccagtctgtgtcttttaattggagcatttagtccatttacatttaaagttaatattgttatgtgtgaattttatcctgtcattatgattttagctggttattttgctcgttagttgatgcagtttcttcctagtctcgatggtctttacattttggcatgattttgcagcggctggtaccggtcgttcctttccatgtttagtgcttccttcaggacctcttttagggcaggcctggtggtgacaaaatctctcggcatttgcttgtctgtaaaggattttatttctccttcacttatgaagcttagtttggctggatatgaaattctgggttgaaaattcttttctttatgaatgttgaatattggcccctactctcttctggcttgtaaagtttctgccgagagatctgctgttagtctgatgggcttccctttgagggtaacctgacctttctctctggctgcccttaacattttttccttcatttcaacttttttgaatctgacaattatgtgtcttggagttgctcttctcaaggagtatctttgtggcattctctgtatttcctgaatctgaatgttggcctgccttgctagactggggaggttctcctggataatatcctgcagagtgttttccaacttggttccattctccccgtcactttcaggtacaccaatcagacatagatttggtcttttcccatagtcccatatttcttggaggctttgctcgtttctttttattcttttttctctaaagttcccttctcacttcatttcattcatttcatcttccatcgctgataccctttcttccagttgatcgcattggctcctgaggtttctgcattcttcacgtagttctcgagccttagttttcagctccatcagctcctttaagcacttctctgtattggttattctagttatacattcttctaaatttttttcaaagttttcaacttctttgcctttggtttgaatgtcctcccatagcttggagtaatttgattgtctgaagccttcttctctcatctcatcaaagtcattctctgtccagctttgttccgttgctggtgaggaactgcgttcctttggaggaggagaggcgctctgctttttagtgtttccagtttttctgctctgtttttccccatctttgtggttttatctacttttggtgtttgatgatggtgatgtacagatgggtttttggtgtggatgtcctttctgttttttagttttccttctaagagacaggaccctcagctgcaggtctgttggagtacccggccgtgtgaggtgtcagtctgcccctgctggggggtgcctcccagttaggctgctcaggggtcaggggtcagggacccacttgaggaggcagtctgcccattctcagatctccagctgcgtgctgggagaaccactgctctcttcaaagctgtccaacagggacatttaagtctgcagaggttactgctgtctttttgtttgtctatgccctgcccccagaggtgaagcctatagaggcaggcaggcctccttgagctgtggtgggctccacccagttcgagcttcccagctgctttgtttacctaagcaagcctgggcaatggcaggtgcccctcccccagcctcgctgccaccttgcagtttgatctcagactgctgtgctagcaataagcaagactccatgggcgtaggaccctctgagccatgtgcgggatataatctcctggtgcgccgttttttaagcccgtcagaaaaacgcagtatttgggtgggagtgacccaattttccaggtgccgtctgtcacccctttctttgactaggaatgggaactccctgaccccttgcgcttcccgagtgaggcaatgcctcgccctgcttcggctcacacacggtgcgctgcacccactgacctgcgcccactgtctggcactccctagtgagatgagcccgctacctcagatggaaatgcagaaatcacccgtcttctgcttcgctcatgctgggagctgtagacctgagctgttcctattcggccatcttggctccagaaaaaaaaattgttaaattggacttcatcaaatttgaaatttttgtgctgcaaatgataccatcaagaaagtgaaaatctcacccacagaatgagagaaagtatttgcaaatcatatatctgataagggtattgaatttagaatatataaagaactcttgcaactcaatataaaaagacaacccaattttaaaatgggcaaagtatttgaatagaaatttcttgatagaagatatacaaatttaaaaatgctcaacatcattagtcattagggaaatgcagatcaaaaccaaattgagataccggtttacacctattaagatggctatagaataaaagaacaaataacaagtattggctttaatgtggaggagccagaacccttatatattgctggtaaaatgtaaagtcatgcagccctttgaaatacagtctgcaagtctttaaaaaattactatttgttatttggtttttcttcacttttaatttaggttcagaggtacatatgcaggtttgctatatagctaaattgtgtgtcacaggagtttagtgtacacattatttcatcacccaggtaataagcatggtacccaataggtagtttttctatcctcaccctcctcctaccctccaccatcaagtaggccctggtgcctcttgttcttttctttgtgttcatatgtactcaatatttagcttccacttatcagtgagaacatgtggtatttggttttctgttcctgctttagtttgcttaggatactggcctccagattcatccacgttgctgcaaaggacatgatctcattctttttgcatagtatactatggtgtacatgtatcaaaaatgttactgtttgacctagtaattctattccaaggtaaatactcaagagaaatgaaaacatgtccacacaaatacttgtacacaaatgttcattgcagcattatttataatagccaaagagtggacgacaaatgtcttccaaatgtgggctccaaatgtccaccaactgataaatggaaaaacaaaatgtggtatatccatgccatggtttatctgtcaataataagaaatgaagtactcatacatgctccaacatggatgaaccttgaaaacattatgctaggtgaaaaaagcaactcacaaaagactacactgtatgattttatttgtattaaatgtccataaaagaaaaatatttagagatagaaaggaaattagtttttccagggtctgggaggagacagtatgaggagtggctgctaatgggtacaggatttctttttggagtgatataattgctctaaaattagtttgcagtaatagatgtgagtatgctaaaatgggtgaattttatagtatgtgaaatataactcagtaagcccattaaaaacaacctaattaaattaaaaccaagctataacagaaatattatatggctttggcagtttagaatagtgggaaaatatggagtaagggtggggaaatagtcccaagtataattctggttttgtcactactagtgtatggacttggacaagtcatttgctttctctaagtatcagtttgcatatatgcaaaatagaggtaatgatacctacctcagtggtaccttttcaaaaccttgttcttcctcatctctcctctaccactttctcataatattattacagtaataaccatttattaagcactgtgtccgcagtggtgtggggctgctttacctccacaacttcactgaatcctcactgcagtcttgtgggatctttatttctttgcccattttacatgtaaataaattgaagtcaaatgagttgttcaaggtccttctgttagcaagtggcagagatggacatgaaaactagatcttctacctatgtgtctttccacttcaactaaagaatttattaaagagaattgaaaagctatgaactaaatttcggtaatacttttaatagtaaacattgctgccctcgtgaatgaacacacactaaatttcaaatctcacggtggcagggaataaagatgctacctatcttaagccattacttcaccaacttctccaccaaaatattccttgtaaccacaaataagtaagcacaatagatctataaggagagaataattgtgaactctgattttatcttaaaaagtcatgtagggatgtcatgttccacaatgtgattaataaaatatattttgttactaaacacaaggaaaaatattatgttccataaagatgtttggtggttgcctcgacctcttttagtttgaaaagtaggtatgtatgagaaagatatgtgtttacatgtttacccttgccttctctctgtctcttcccctctctctccctccctccccaacccctatgccctacacccccgcaacccccacatgtatttacctttctctaaaagctctgcatagccaagaaaagtgctcttttttatttttaggatattagatatttcattttcttatggtaagacaaaagattaaggcaaccaagacttacaatgtgcctaccatgtggcaggcacagaggcaagggcttttacatgttatttaatgtaattgtaattctcacaaaagccgtctagagttgaaaatatttccaactctaaatgaggcaaatggagcacagagagccttaattatttcacccaaagttcagtggtagaggcaggattccaacccaggtctggtgggctccaaatccttgttgggttgccattcctcttgctaacaaataaaactggtctgtgacttttgcatttcaccccgcttccacagtcactggtgggacttacttaagttaatcagattcttcaaagtatccccaagtcctcctttgaaaagaaagttgggggacaggaggaggagcagaggagaggagataaaaaggaaaggagtcagggagagagagagagagagagaaacctggtgatctcagctgggtgccaaggtttcctaagcccaagttccccatggttgagcctgtattgtcaggccaacagcttctagtaatccacttttatttaattaatagtgaaactgttgaagaattgcaagtggtgttctggttcagaaaccttccgttctatggggcactgcttttgcttcagattcataaaaccaaatgctctgcctcaagataataagtgaacgtgtaaccctcgggaggtaagaaaaaacacaatgtcacgtgcaaattctgcacttgttctcaaagcaaacctctcctgtgtttgcaattaggatgttatctaggagcatattcaaaacttttgaggtttttattttagtttttctttcattatgtgctgttttagtaatatcaaagaatacatgtaatatataatttatatgtcataacaataaaattaatgttgatgagcccagattaaagaatcaacaacattaacatcatgattgcatcaaccctattagaatggaagctctgtgaaggcatggatttttgtccattttgttcactgctatatccccaggacctagaggagtgtcagccacataataggagcttagtcaatattttaaaaataagagcataaatctacttatatcctctttcctcttaccatcactcccagcctcccctcagaggtaaccactatcctatatttgggctttattattcccttgcattttgataagttttcacatgtatattcccaaataatatattgcttgcttttgcttctttttaaactttatataatggaatcatattgtatgtatcctattgtgaattatgtcttttacacaacattagtatttgagattcaactatgtgtagctcgattccattccttttcattgctgattgtagtttattggatatgtgtgccataaattatttttctcctgtcagttaatgtttatcatttatgctttaataaacaaaactgctatgactgttcctgcatgtgcctcctagtacatatgtgaccaactttctctaggatataagcctgagagagggactgcagttggaatttacatttccaaagcccaaagtttagctcatgagtcagagctgcaatgtgccctttgtccacactaggtcaggatcagtgggagtgctacccaaaatattttgctagctggggagtcagggagaagcagagactgacctagtgaggccaggaggcactatctcaggtctctagtcaaaatgggttgcaattagtaaaagtccagattctgaatccccttcactatttatcttcctcttcctcctttacagttatttttgttcaaggtgcactttattaaactcatgcctaacaaacaaaactctaatgaatattttgtctttcattgattgtaaattcaattaattagattgcttgaaaaaattttaactgtattttcactttagtatggatgaaaatttcgatttctttaaaaaacattttttaataataacacaacataaagtctaccctcataacaaaatttaagggcacaacaccatattgttttttttttattttattattattatactttaagttttagggtacatgtgcacaacgtgcaggtttgttgcatatgtatacatgtgccatgttggtgtgctgcacccattaactcgtcatttagcattaggtatatctcctaatgctatccctcccccctccccccaccccacaacagtccccagtgtgtgatgttccccttcctgtgtccatgtgttctcaatgttcagttcccacctatgagtgagaacatgtggtgtttggttttttgtccttgccatagtttgctgaggatgatggtttccagcttcatccatgtccctacaaaggacatgaactcatccttttttatggctgcatagtattccacggtgtatatgtgccacattttcttaatccagtctatcattgttggacatttgggttggttccaagtctttgctattgtgaatagtgccgcaataaacatacgtgtgcatgacaacaccatattgttaactgtaggcacaatgttgtacagcagacgtctagaactttttcttcaggcttaactgaaactttatagccattgaacagcaacactccatttccgtttcttaaaggtcctttacaaaatgagctttctgcgtgtttccattttgtttatctgataacttttttttctttttttattatactttaagttctggggtacatgtgcagaatgtacaggtttgttacataggtacacacatgccagggtgtttggctgcacctatcaacctgtcatctacattagatatttctcctaatgctattccctcccttgcccctcacccctcactggccccagtgtgtgatgttccctagcctgtgtccaagtgttctcattgttcaactcccacttttgagtgagaacatgcagtgtttgattttcttttcttgtgttagtttgctgagaatgatggtttccagcttcatccatgtccctgcaaaggacatgaactcttccttttatatggctgcacaatattccatggtgtatatgtgccacaatttctttatccaatctatcattgatgggcatttcagttgttccaagtctttgctattgtgaatagtgccacagtagacataagtgtgcatgtgtctttatggtagaatgatttataatcctttgtttatatacccagtaatagaaatgcttggtcaaatggtatttctagttctagatccttgaggaattgccacactgtcttccacaatggttgaactaatttacactcccaccaacaatgtaaaagcgttcctatttcttcacatcctctccagcacctgttgtttcctgactttttaatgatcacgattctaactggcgtgagatggtatttcattgtggttttgatttgcatttctctaatgaccagtgatgatgagctttttttcatgtttgttgaccgcataaatgtcttcttttgagaagtgcctgttcatttccttcacccactttttgatggggttgtttgtctttttcttgtaaatttgtttaagttcattgcacattctggatattaattaacctttcgtcagatggatagactgcagaaattttctcccattctgtaggttgcttgttcactctgatgatcgtttcttttgctgtgcagaagctcttgagtttaattagatcacatttgtcaatcttggctcttgttgccattgcttttggtgttttagtcatgtagtctttgcccatgcctatgtcctgaatggtattgcctaggttttcttctagggttttcatggttttaggtcttacgtgactcatcttgatttaatttttgtgtaaggtgtaaggaaggggtccagtttcagttttctgcatatggctagctagttttcccaacaccatttattaaatagggaatcctttccccattgcttgtctttgtcaggtttgtcaaagattagatggttgtagatgtgtggtattatttctgagacctctgttctgttccattggtctatatatctgttttggtaccagtaccgtgctattttggttactgtagccttgtagtatagtttgaagtcaggtagcatgatgcctccagctttgtgcttttggcttagaattgccttggctatgcaggctctttattggttccatatgaaatttaaagtagtttttttataattctgcgaagaaagtcattggcagcttgatggggttagtattgaatctgtaaaacactttgggcagtttggccattttcatgataatgattcttcctatccatgagcatggaatggttttccatttatttttgtcttctcttatttccttgagcagtggtttgtaattctccttgaagaggtccttcacatcccttgtaagttggattcctacatattttattctgtttgtagcaattgtgaatgggagttcactcatgatttggctctctgtttgtctgttattggtgtataggaatgcttgtgattttcgcacactgattttgtatcctgagactttgctgaagttgcttgtcagcttaaggtgattttgggctgagagaatggggttttctgaatatacattcatgtcatctgcaaacagagacaatttgacttcctgttttcctatttgaatatcctttattgctttctctttcctgattgccctggccagaacttccaatactatgttgaataggggtggtgagagacggcatccttgtcttgttctggttttcaaagggagtgcttccagtttttgaccattcagtatgatattgggtgtgggtttgtcataaatagctcttattattttgagatatattccatcaatacctagtttattgagagtttgagcatgaagcagtgttgtattttgtcgaaggccttttctgcatctattgagataatcatatggttttgtcattggttctgttgatgtgatggattatgtttattgatttgtgtatgttgaaccagccttgcatcccaggggtgaagcggacttgatcgtggtggataagctttttgatgtgctgctggattgggtttgccagtatttttttattgaggatttttgcactgatgttcatcagggttattggcctgacgttttctttttttgttgtgtctctgccaggttttggtatcaggatgatgctggcccataaaatgagttagggaggattccttctttttctgttgtttggaatagtttcggaaggaatggtaccagctcctctttgtacatctggtagaattcatctgtgaatccttctggttctggactttttttggttggtaggctattaattacttcctcaatttcagaacttgttatagttctattcaggtatttgacttcctgctttaggcttgggagggtatatgcgttcaggaatttatctatttcttctagattttctattttatttgccccagaggtgtttatagtattctctgatggtaatttgtatttctgtgggatccgtggtgatatcccctttatcattttttattgcatctgtgattcttctctcttttcttctttagtagtctggctagtggtctatctacaaaatagactgtttatctgatatttattttgtaattatctaataataaccatcattatcatcatcagcattatcattatcatctcctttacccatacatacatttgtgtctttcaaataataatcccatctttgaagtgcatcctcatctttagcagtctgcactctgctttcttatatcatttattatcttattttataattatttatttccagtccttcttctctaacagatagtagtttcttagggccaaggaaatatctcgatcaccactatatccccagcacctaaccctgtgcctggtccatagggccagatgctaagagttgagttgaaccattgtacctaatcttaaccttcattagcacaacatggtttgtcagtggttaagaatctacactttggagtcagactcacccaggatggaatcctggcattgccacttattattaatagatgcgtgatcttgaacaagtttacttaattgttctgagcatcagtttcctcttctgcaatatagggatgatacacagctacctggtaggttgttgggaaaattaaatgggatgatatgtatgaaatggcctggcatatagagtgcctaaatacatgttcttctgattctatttggacagtttgtgttagtaacagaagtcaaaaaggtggagaaaggagaaaggtacttgtgaaaattttctatttcttctccatgtttcattcaggactgaggaagggggcacagtttttacccaaggaaatgacatttttagccaaaagaaatgatcttagcatttagctgaattatatattggaagtaagctccttccatgtggaacttatggccttgctagccttggtttgttggaagtgctcttgctggctttctagttagggtagggaaaggaaggcttgtggggaatgaagataggccatgatatcaagccactgggtttgcaaatcagtagaattttttattgctttctgttgtacttgggacttgaataaaggctgatatttgtgtcttgctggtaaagtgcttgtaaagtgagtgaaagttttctttgctcttgtcctgacatagctgttcacttggggttgaggggaggataacctttcatgttttttttttttcttcattctgatgactgtgctgaacattcaaaccaaaaggccattggtggaaagtaaaggtgagtggtgagaagacaatagggtaatggaaactgtgttggacttgtaatcaaattgtcctgcacttcccctctccaagtcttaacgtttttcatctgtacagtggatattaaaatgagaaaataagcttgtcttcacagagttttcgttaggtgttgacacaacaaacaggctcccattagggctcattttccttcattccttagtaaggaagaagtgcttataaaatatagcagttgtgctcttgtgaatgatagcatgggcagttgtcatctccctgaagcagatgtaacccagaatgtcacttgagttttgtttaatgcttaggcataagacataggaatgacaaaagctgacctttgggtagtgagaacaatgttccattttgttcaaacttgaattttttactataggagactgagaattaaccttccatgaaggttttaggattggctttctggcccttctccttcatatccacctgaaagagcttgggcgcagaagttcttgcagaaaggcagttagacaaggtgacttctgaagctccagtggccaagtattttgatggtagcctaaaagatgtccagaatcattgtacatcattttttcaacagaagcttcaggcatagggattatgcttggtactttatgttgtggaatggaatctggcggatgtccatgtgatctatagaaacacctaaggaaagtgaagaaatgagggaaaaaaaagaacaagacttttatgataatactaatcacgatccttgtgtatttattccaatggcattttatccattatctgatttatattaccactcacagcagcagctcaataggatgggagatattatctctattttatagatgagatttgaggctcacgaagctaaagcaaggaacatcaaatcactttgatatttggtctggttttgttataggtctccctttggatgaggtaaagttacaaacctgggttcatatcatttaattagtctgaaaatgttgcctggacaccaccttcagttagatatcttaacctcaggcttcctgccttcattgctcccgcatatagacatagactatgagattggctaatcccagagaacttccctaatcccttggcaagatccaaaaaggctcagtcacaccctacaaccatcatctttaggagaagtctcagaaaattcagcttcacactaactaacttgagcaatgaataatagtcatttatgcctgcaggttaatgctgaagacctgagacttcacttgcctatttctgccattcagtgacatgtgttgcattggttttttgtgtctttccagtttggagactgccagggaccatgttttgcccattgactattactttccaccccagaagacctgcctgatctgtggagatgaagcttctgggtgtcactatggagctctcacatgtggaagctgcaaggtcttcttcaaaagagccgctgaaggtaaagggtcttgcacatgcacttctctttccctttctcctttaccttccagagagagacactaacctttcagggcccaggattttatcatctcagaaatagagtcattggcaaggccctatcaaataacttaggagcctaaggaagcaaatttttgtacttgctagttccctggtttcagcagccttgtttgtacaggcaatttaggcagtgaaggtggtcccagctggggcttggggctcagtgggtcctagaaatgaaagaaaaattaatgatttgaaaagatttaatttcctcccttcttgttttctactctgctggctagtaaaggaaaaatttgtccttattagagaggttagaagtggagaaaccccaactgagtccccagcctgttccttgggatgaatatgagactgttccttagcaaaggcttcctggcctcggccccagaaagggagtgttctcactcttcagcagactatcagtctctgcacctgctccctcctgttgtggcctccttgggacctgtctttgcattaatagttcctaggtaggtaagaactcagagtgaagaaacacatttattctcctctccagagacctgatctcaaagcctgtccattagtccctaaccttaatctaaggtagcatcttatatctggctaaattggctcaagccctagctccttagttttatttagcttagaacaactcatgtctgctcaacctctagaggcgctcagcccacattctgcagtagaaactcccattttcaggcctcttatatacggtaatgtctccttcctctaaccacccagggcttaagcttcctgcttatccacttcaccctgtattgagggctttcttctcaaagagacattgatgaggagcccctagagagagatgctgtgctctgggaccagaccccttgttaaacaccagtattcacctctgccccaactttccccaaagaggtacttcctgccaaggcctttctctttcctctcactggctggaagtgttgagttccacttcagaaccagaacagagaacctttccttctataagagctataaaccttgagaacagtcttaaaacataggtatgtaggccacaccattcaccacgaatgtactgatactcatcagaatatggaagaagcaccagagagtttgaagcatctagagaaaaggtagaaagagaatgccctttaactgacctcctcagtgatagccaatcacaatgatgagtgttgattcatcattttggctaggtggcagaaatatctataaaacagaagctgccatgttgttttcttccagtcctcagggcctacaagaaggcagctatcatttggtattactgaaaacatgccccatgttcagctcatacccccaaattacccattgctactgtttatgctgggctaatatgaagcccagggccctaatgtctaggtctaggcagtaaggcctagagcagtgcctaaagagcctgagagcagtgccttcctttcttcagagtactcatgaaaggatggctgtcagaaaaggaaatgaggatgggttccagagacttcagaccaccccaacttccccagtgagaccctggcacctccccataccctctcacctagcgggccctgtctatagagcagagaatgaaacagagcactcatctagaggtagtgtgtcagcaagcccaggcactgcaccacagtaatagcagccatatcagatgggaaaggagttcaagtgaacaaacaagcaaattcaatagtcagatagattagattatacttgatgcttcctctgagttttacaaatatgggtcactaaattgttattttcagaaaacaggggaaatgctcaatcacattgtgaaagggaagattttgctgtcatatcatacatcccacatgggagctttctgcagaagttagagctgaaggagggaggcaggcagaagggcaactggcagggctgcctgggaggagctctgcaatgaggtggatcctgtgccatttgagaacagggaagaaaagaaatgaggttttggggagggaatcacccaactcacagaacacacagaaatccagcaaggtttcaaaacgctctacaccttagagtctgttaagttagggaaactctgtgagctcatagggccaaatgcacttgcctgcttgaaatatgaaaaatcagcaatggattccttgaaaaacaatgaaaagggaaccttctgagccccttggttattttgacatatggaccatagatttcagtcctgagccctttgaaggtaggagaaggtggtttagaaaacacacacacacacgcacacaaacacacaccagaatgaagcaaaaaaaaaattactggtgttttctttctcctcccatctgtgaagctgttggattgattttactgccatcattatccctgtttgaaggcagggggctgtcttattacccaaagaggacatttattgatttggttttctttttccatttttacaatgcatctttatcgcccatatggcctttctggaggtggttttcagtctggcttgttgaaacatcaaattatacctgtcttagagaaaatagaaacaaaaatctttctcttccttacttgcttgttgtagtcagttaactcggactgagtattcagagtcttgattatcacttaattcatagtttcataaatctctggaatgggcataggtacaggacttaaaagcctggcatctcagacagaaatatgtttttagctttggtggtttataacagatgggacttttaggctgtcattggtgcagggctcagcacagagtcagttgtaatctggacaggttttgttgttgaggaagagtgggaagagggagtcctacattttctccttgtcagtaatgttggagaattggggtgagggtgaggctgggcagggagggtctgcatagaaaaaagggtgcggtgagaaaaaataatgctactaagccatgagggtaaaatgaccaaattctggttgagagaaacttggtcaaagtgtgtatggggagagaaagttggtcaaagtctgtgtctgagtgcttggtgggatgaactctgggttagaaacaggcatggagggaaatagttggtttatggagtgggtaggatgagtggggtggtgaaagggaaggcattttggatgctaagagaccaggaagtcaaagcaaggcaatacacataaacagaggtaagggctcagagaggttttagttgtgtagacttggataagaaattttcccttttggacctcagttttccttgtttgtaaaacaacggacttgaactagatattttaaaatgtgcttccagcttagacattttgtgaccgttctacaaattacaaacataatcatcatcatttcagcaaactcacatgtatttatacctgcataagtttttggtcttgctttcctagaaggtgactaatcccagatcctaatcaattaaagaagcaatcttcagatggggatagagccagctgagagagtgtactatggatggagtgagttaaaactcaggactcagattttctccttgtgatcattgctgggtaacttcctttcttttctattttctcatctggaaaatcaggatatgaatccccatctctacctcattatgtttcaaagagggttaattaatccatcatgtgcattatgtgctcaagaatttactatttttcagacattttctagtaaaacattgaagattatatgtccatttgttttgtacacatggagtgctgtttggtacacatcataaaattgaaactgtagtttacattctgaactcaaagaattacaccatcctcactgatgtttacaataggtcccaatttagtttctttagcaaattttatgtaagtatggctttgattctctctctcactccaggtttttgttagggaagaaatgcaagtgaaccctcattgaactctttctgtcctttaaatccattctttcccacctcaactcatgtggaattgaatgttgcctctagtttggagtctagcagagagtttttggtgcatatcagtgtccccttcactccctgacttttcaagtaacatttcccagaggcaaattaactctgctaagaggatctgcttgcagcttcaacagagccttcatcaggtatctttggccaaggagttgactgatcctgactttgcgagtcctagagatcttttcacaaagctcctctcatgtttctgcctctgattttcttaaatgtcacagacagactttagatttaggggttggttaactttttttgtaaagggccatgtagtaaatattttaggctttgtagatcatatggtctctgtgtcaactactcaactctgcctttgtaggatgaaagcagccatagacaatactggaactaatgggagtagctgtgttccaataaaactttatgggcactgaaatttgaatttcacttaattttcacatgtcgtttaatattatttttcttttttaccatttaaaaatttagaaatcattcttagctctttgggcctcacaaaaacagatggtagagtggatttggtttatgggctgcagtttgttgacctgtgctttagctaatcacttctgtacttataaatctgcataggttttatgtttttccatctcttggtatcttagtaggccagtcaaagtttgaacaacttgttagcacagaatacctggcctagtggcttcttggtcctgagcttatttactaaacaagagaaaaaataaataagtctagaaatgctagaagaggatacttttttgttttaatgatctagtagatcactcctccttgcaatacccagaggagaaactgaaaatatttcaaacattttctagacttctgtgttgtaaatttgtggataactatgaactatatatgaatgaacttttctggatgacacatatattccagatggtaaaaaggaagggctttggggactctctggtaccaagtgtcatggaaaaactgtgtgtctcatagaaagtagatcccaggaggccagcagagttgtggatctgccatatattacctcatgattctgtcttcgcacactcaccggcttaattctgggcctccccataacacgactagaccacaggcttgcagaagaaataatttagctctgtaactcattgaagttggtgcccacccaagtctctgtcagtgcccaattcgggagccatgccaagaatttgccattgctgcttcatggtggccttgtgcctgcttatttatagcctgtgcattttatgaaacagggattaataagaagttgccatagcacttgcaccattatgtaaatatctgtaatgcttacataacttttgtcacttgcaagaccttttgagtccattgccttctgctaccatgccttaccaatttcctagtcccttattattatttttcaattcattatatttaacttctgtgatacacgttcagaatatgcaggtttcttatataggtatacacgtgccgtggtggtgtgctgcaaccaacaacccgtcatctacattaggtatttctcctaatgctatccctccactagcccaccaccccctaataagccccagtgtgtgatgttcccctccctgtgtccatgtgttctcattgttcaactcccacttatgagtgagaacatgcagtgtttggttttctgttcctgtgtttgttttctgagaatgatggtttccagcttcatccgtgtccctgcaaaggacatgaactcatccttttttatgactgcatagtattccatggtgtatatgtgccacattttctttatccagtatatcattgatgggcatttcggttggttccaagtctgtgctattgtgaatagtgctgcaataaacatacgtatgcatgcgtctttatagaagaatgacttataatcctttgggtatatacccagtaatgggatggctgggtcaaatggcatttcaggttctagatccttgaggaatctccacactgtcttccacaatggttgaactgatttacacccccaccaacaatgtaaaagtgttcctatttctccatattctctccagcatctgttgtttcctgactttttaatgatcgccattctaactggcattgacatggtatctcactgtggttttgatttgcatttccctaatgaccagtgatgataagctttttttcatatgtttgttggccgcataaatgtcttcttttgagaagtgtctgttcatatccttcacccactttctggtgtggttggttatttttttcttgtaaatttgtttaagttccttgtagattctggatattagccctttgtcagatggatagattgcgaaaattttctctcattctgtaggttggttgttcactctgatgatagtttcttttgctgtgcagaagctctttagtttaattagatttcatttgtcaattttggcttttgttgccattgcttttggtgttttagccatgaagactttgcccattcacaattgctacaaagagaataaaatacctaggaatacaactcacaagggatgtgaaggacctcttcaaggagaactacaaaccactgctcaaggcaataagagaggacacaaacaaaaggagaaacattccatgctcatggataggaacaatcaatatcgtgaaaattgccatactgcccaaagtaaattatagattcaatgctatccccattaagctaccattgactttcttcacagaattagaaaatactactttaaatttcatatggaaccaaaaagagcccatatacccaagacaattctaagcaaaaagaataaagctggaggtatcaagctacctgacttcaaactatactacaaggctacagtaacccttatcaattttttatgtgcctctccatattctgcagtcagaagcttcttcagtcctttcagggaattgctgggtgactatcaaactctggtagttcatttttgcagttggctgctgttgtgaggataagagttagactcactttctcttcagagatagaaattatgtattaattctctgggttctagacccacagcaaggagcatactgctcctcaaaataactgaattctgcgagaagccatcattgtaaaacaacaatatcttcagttatagtagccatgtgtgcaacttctggaaactgttattcagattttcatgttccttccctgtctcttcatagctaggcagctgctttcagccttgtacagatgctagtgagctttctacctacaaacctgcagaaaattgaactgagatttggaggtgaaagactcttgataaagggaacaaggtttagaattctcagtccctttgctcccaggctgtgttgtgactactgaggcactccagtgaaatcactattcctcctatctagactaatgcctgtctctgcagagcacctcataagaacaggcctggtagtaatatcctcatgcattcagtcagtaaatatttacagagtgcttactacatatagggtattgggctgacatatgcaagatacagggcctgcttccaggaggttatagcttattgatcataaatgtggcattttttttttttgagacggagtcttgctctgtctgtcacccaggctggagtgcagtggcacgatctcggctcactgcaacctccacctcccaggttcatgtgattttcctgcctcaccctcctgagcagctgagactacaggggctcatcaccacacccagcttttttttttttttctgtatttttagtagagacagggtttcaccatattggccaggctggtctcgaactcctgacctcgtgatccacccacctcagcctcccaaagtgctgggattacaggcgtgaaaatgtggcaatctttaaagctcttcagtggatgaaaggccaccctatctgctgtccttttgaacttcgcaactttcttggtacagagtgagaggttattctcttggttttccatataagtaaactgaggctttgccagttcatcaacaggtagtaaataatatatttggaatttgaacccaagtcttctggggtcaaaggcagcattcactctgctctgtcacagcagctcctcaaataagccaacatagaaaccaagtactatgcctaggcaacaagaaaggcagcaatgaagagcaacagcagagtcaaatatgagagaaggaagttaagaaagatgttaagtactgtggggagtaactgagaaaccaccaagtatcgctaacatcacagggaacttgtcttcctaagaaaattccaagcacttaaaaccgctggtagttcatcagcaactctcttcattagatgtgcgagggacatgtgggccatagtccttctactaacttatattcttcaggggaaagttctgattctgatgagacccagcatggtagctcttaattcactgttgtcacacgactatagaacaggaagcacaacttaacacctgtgctcatgagaattttgctccttatgaccaagctaaagaaagagcttagacaggatgtgtggctataaatgtagattaatggttccttggctctttggtttgagccttctcagcagagcatcccacggagtgttttccatggggccacgagcaagagaaatccacttccctcctcctcaatgtcagaaaatagagaatattgtctttcaggatagaattaaaaagtcatagaggcagcaacttgttttcctatattagggttttaaaattctgtttttccttcctctcctgggtcagatcattgtgtggatggaccttgatttcattgtggtatctgtatgtggaccctgaagaccatggacttctaacaattccttaagttacataagcacattcctacaggtcacaagctcatttacttacaggatggttgatttggtcacaggttatttcatgaaaatacttaaaagatttgcagtgttcaaaactgcagtatctttaaacactaaaacttgaaggaagggaatttagaaatcaaaaaatctggtcaaaccatttcatggaaaaggaaagtgaggctcagagagaggaaattactttcctgggtttgtatagcctataaatggcagaaatgagagcctccctgccatttctagttttctgtctgagagactctcctgcctaatagctaattagcagagtcacagaggtcattaccttgcaattctcaagaattatgtgaggcagcatagtaagcatttatggcccttggttcctagaaggagcttagtccctgatagtcatctctgcctttgccattgtgtgagactgtcttctgtaactgtatgtcttcctccctagtaagttaatgagtaataaaggtattctatagtgagaggactctgtaagacatttcttggtgtgaggattgttccaaggttgttttgtgtgtatgtgcatgtataaacttttttagggagcatattcatagcttttacatggatctcagaggctctataacccagagaagattacagaataccagtcttgtctttggtaaggattttatagacccatcctgactacagtgatatccaacatggctatgtaatgactggcactttccccacataacatatatttattccacactcagtgcctactgtgtacatgagacctataccgggcactgggataagagacatgaaataacagctaaaattgtttattgagcagtcagtatgcattagatgctttgtagtcattttcttattcaatctgtataccctcaatttacaaatgaggaaactgaggcacagaagagttgagtgatttgcccaaagtcatacaaatagtcagtggctatgtgatgaatagttaccaacataaaagagtgagattactgctgtactaaaagtaggtacataatcccctgagcagacagtatgagagaatgatttattttacctggaaagtttaggaaggcttcacagaggagttaagggttgatctgggtcttgagggatggataagagtttgccagatacaaaaaggtaggaagagaacttcaggaggagggaacaggctgagcaaagacacggcgatgtgaaagtgggaggcttgtttggggaacattatggaatctggaggttattgtggggaatctcatcagatgcagcaagctgtttgacaggccttcagttggctctttgtaccttgctccctccgcatgctgagctgtccatagctgccctaggctggtgtctgggattttcggaagaaggttactatccaggtagtgtaacaagatgcagtgcaaaagcaccagattggggctctggctctgctgctgacttaccacctggccttaagcatgtctagttccctctttgtacattaaaatctccattggaacagtaacatggttgtattaaatgatcttgaagattttacctgcacgttttgcacatgtaccctaaaacttaaagtataataaaaaaattaaaataaaaaataaaaatataacaatataaatctttaacaataattttagtagtaaatctctacaattttacagataatccagatgcatccattggccaatggttcactttgtatgcataatatttgggaaacaggcagacccaatttcaatccttagttgtaagacttaatacatatgtgatctcgagcaaatcacttttgtatgcctctataaggataataatagctcacagaattattttaagaactaaatgatgtgtaataaagctactggtactcagtaagttttgtatccttttcctagagtgagtcttggtcataggcatgcgtatacttgcagcgtccctgggtaggccgaaagagcaaataagagatggtatctatggtattccccaggtaaaggaggccttgggttggcataagatttcacttctctttagagttacttaattagggaccagaaaggccatcagcatttgtatgagaatataacaaaggtcaatctcttcctctttactttttacctcccagtacactgtgagtaacattccccagccagcccagccagcacgtgttcattgcctctcttgacttccagactttggacttgaaggtgtcagagctctctgtgtatctttgtccccaacaagataagtctgacctccccagcaaattcaagtcctaagccactgtccaggagaaaagctagcaaggtcataaattattctccatattttccagccattggtttcccttgtccagccagaggtgtgtctcaaagtatgctgaggccagattcaatagaaacctgagccagcacctgtgtaaataatttttaaagctccttttcctgaagctggatgaatatttttaaaaactaagctggattgtcttttatctagcatgccgtctcctacattcctagtgctatggacctcttggaggaatgtggtttggttatagtggtattgtcttgtctgttgtgggggagggagacatttctttcagaagcaaggtaatactttggtctggtctatgactctattttgtttaaaatgaaactatggcagtatagtggtattcattctgcttcccataggttaactttacatccctctgtcttcacccactcttcagttctgattcttttaaaagcagccaaccaaaaccagcaagtacatactgcttatctctgacttccaccagaatcaacttcagatcttgtccaaagctccatctgaagagaggggaataacacccagccaagagccctcagggcccatcagtaagtagacatcctgtccttgaggttccttaactctgctcagcttcagaatacagaaggggttggttcttcatttgtgttgtttataactaaaagcctcctactccccacttttttgcatagcttcttctgccatcccacctgtgtagcctcttcaactcccccaaaactcctctgtagcccatgtcacttggaaagagttttctttgtctcttttgcaacttgacaatgactagccagcaagtttaagttcaaattattgttccatgggagcagagatagatataggaaacaaaaaaaagggatatggaggtatagagtgatttcccacctacctagtgagcactactgagatattcaagtactctctacccaagaattctattgatataaaggtaaaaaacttgatcttaggtctaatatccgttagtagtgtgaccttgggaaaatgataccacccccaaaggcttagttttcttaactgtaaaataggcatacagatgaccacccccagaggattcataaggataacatgagataaggcaacttgaaatttcctagcatagtgatagactttcgaaaataaaatgaatcaaacactgataacagtacttcctagtacacaaatgagaaatcagtccctcatcaaattacagcacattttcaatgctccaattatgtcactgtagaaatgctaatgtggattaaataatttgtctgttgctatttatacggataatttgatagtagttatttttggacatggatagctttgaagccttacagatgagtccatccccaagtacccaaaactaaagaaagttggctagagtgatgacaaggtggcagcacagagctccctgcgttctgggccctgtcccctagctagagagaactccaggctataagcatttgtattctcatagtccaatggcagggaagaagggctggaggtgagtagttttcactcatttattttttcaacaagcatgtatggtatcaggccttgtatgcatccagagacaaatgtgaactagccgtgtcctcaaggagattccagtctggtgggcctgccttccaaggtcagttgcagctttagcactataaagagcacctacctgcggcagatacaatgtgatgggacatgacagagaaaaaatctataagcagagcctccccattcccaggcattgaaacaatcctaaccaagactggcatagtacaatgagcctgtccctatcagcaggtttggaagccttaacaacaacaacaaaaacaataataatggtgatgataatcatagagcctaatgttaccaaacattttccatgtgttaagtactatactaagtgcatacttaatcctcacaacaatgctataagatagtagatactcttactactaccctgattttacaaatgtggaaactgaggcacagaagactaagagaacaggaatacacctaattcacctcagttcaacaaacatcaagcatctgttttatgtcaggcctcgtgctggatggcagggagagagagatgagtaaagcatagtttcagtccagtgggagcaaatgacagcacacagtggggcaggtatattgcagcccttctgcttgatgctaagaactcagtgtcagtgatgaatgaaacacagtcattctctcaaagatcttaaagcttagtaggagatatctgtgtggaaacaaaaattaaatactgctgtgataagtgtcataagagataagtggaaaatgagagagagagatcactgtagcaattgattggtttaaatcaaagcccccaaaaaaatgttattgagaattataaaacaactaattgatttaaatcaaagcccaaacagaagtgtttgctaattttatttcaatttggttgataatttggttgaaatgaatttatttcattttttattccatccttacaatggaagattagtgcttgtttcccacccaaggataccaggatatttcaggggctgtattacaatatagttaaattattcctttatctcaaagcacatccacactttcccctatccttacctttactcagggtatctcttctgcctcaggtgctttttctccacatttccatattcttaagtcctaccttccttcagggcctcactcaaatgcctcctcctccatgaagcattcacccgactgaaaggtaccccgccctctcctgtactccacatcacttcatgggtgtctccacttcctgctttatctttcagtaatacacttacagttctctttcctccactagactgagctcttcagaggaagactcacttggctgaaaccatgattttactttaaacacattgaaaacctctactggagtgcattgtgtctggtgggcttcaaccttaattcttaagtatgtgaaaacacatcacctatctggaggtttacactttctgctaatgactttatttttaagcccaccaccctaacacaacaaatacttaaaacttgtcttcatttcctttaggtctggccctcatgcatgcatataatttatagagtcactgttttgctcggttgtcctcatgcctctatattattggaggtttagattgtttccatatactcaggttgtattcatgtcctttttttctttttaaatttccttagcatccatttccaccattggaaattcagggtcaaaacaggggtttgggattggagcatgtctatcacagataaccaatcatgtgttatgacttaagaatttatgaaagggccctctacctgaagatatcttgctactgatgctgtctcacagtgtctgaaactcccatcatatgtggaattgttttggaaggctttgcctcctgggacacattcagccataatcaagaaatagtattgagcattagactgtcagtatgtccattagcaagactgtggaggaatggaatcaccaatattatattttataggggatacagaatacaagagaagttctgaagagaaaattcttatgtagaataggaaggcttagatacagcatgaaagctgcaggctttgaggagccagaggtcaaatgaaagcattgagtatttgtttagatgaaagaacagaaagggaaaaagaagcagaggaagggatagtagagagaaatgtataagttttatccatttaacttgtaattgtgtttggctatgggcacaatagaagcagtgagatcactttattttattttattctttatagacagggtcttgctatgttgcccaggctgcagtgtgcagctcttcacaagtgtgatcatagcgtactacaccctcaaactcctggactcaagcaatcctcccatctcagcctcctgagtagctgggactacaagtgcacaccaccacgcccagtgagatcacttgaaactagggagagatgtgtgagttctgggcaaccagtagttggctttacatagaactgtaggggtcaaggccaaaggggacgtcctgttccaagtcaccttctttggacattagaaaaccacgaggggtttggaaatcagaaaaccagcagaggcaggaaaactcagggcagcatgggagattcagtatatacaaaaaggttcacaccagtaatcaaacagaattttaactgctgatgtggagtagaggcagctttgtctgctgtgtgataaccaaacctttacgaatagtaggtgtatatggggaattggagggagataggtggctgtgtttagtaattggttgacttcactgagatggtttggggattgtggcttccagatgatcagattttcttttttaggtagagactccaacatcattacagaactataaattacatgtggaaaagaaaggcctcctatgttagaatagaaaataaaatgctgtggggttgagggacagaggtgctgtctaggaagtcagatagcgttttccagttctgtccctcagagttccttgtcctcattgagactcaatttctcttacttttttttttatactttaagttttagggtacatgtgcacaacatgcaggtttgttacatatgtatacatgtgccatgttggtgtgctgcacccattaactcatcatttaacattaggtatatctcctaatgctatccttcccctctcccctctccccaccacaggccctagtgtgtgatgttccccttcctgtgtccatgtgttctcattgttcaattctcacctgtgagtgagaacatgcggtgtttggttttttgtccttgtgatagtttgctgagaatgatggtttccagcttcatccatgtccctacaaaggacatgaactcttcattttttatggctgcgtagtattccatggtatatatgtgccacattttcttaatccagtttatcattgatggacatttgggttggttccaaggctttgctattgtgaatagtgccatgataaacatacgtgtgcatgtgtctttatagcagcatgatttataatccttagggtatatacccagtaatgggatggctgggtcaaatggtatttctagttctagatccctgaggaatcgccacactgacttccacaatggttcaactagtttacagtcccaccaacagtgtaaaagggttcctatttctccacgtcctctccagcacctgttgtttcctgactttttaatgatcaccattctaattggtgtgagatggtatctcgtggttttgatttgcatttctctgatggccagtgatgatgagcattttttcatgtgtctgttggctgtgtaaatgtcttctttgagacgtgtctgttcatatcctttgcccactttttgatagggttgtttgtttttttcttgtaaatttgtttgagttctttgtagattctggatattaccctttgtcagatgagtagattgcaaaagttttctcccattctgtaggttgcctgttcactctgatggtagtttcttttgctatgcagaagttctttagttgaattagatcccatttgtcaattttggcttttgttgccattgcttttggtgttttagacatgaagtccttgcccatgcctatgtcctgaatggtattgcgtaggttttcttctagggtttttatggttttaggtctaacatgtaagtctttaatccatcttgaattaattttagtataaggtgtaaggaagggatccagtttcagctgtctacatatggctagccagttttcccaacaccatttattaaatagggaatcctttccccatttcttgtttttgtcaggtttgtcaaagatcagatggttgtatatatgcggcattatttctcagggctctgttctgttccattggtctatatctctgttttggtaccagtaccatgctgttttggctactgtagccttgtagtatagtttgaagtcagatagcgtgatgcctccagctctgttcttttggcttagggttgacttggcgattcaggctcttttttggttccatatgaactttaaagtagttttttccatttctgtgaagaaagtcatgggtagcttgatgaggatggcattgaatctataaattaccttgggcagtatggccattttcacaatattgattcttcctacccatgagcatggaatgttcttccatttgtttgtatcttcttttatttcattgagcagtggtttgtagttctccttgaagaggtccttcaagtcccttgtaagttggattcctaggtattttattctcttagaagcaattgcaaatgggagttcactcatgatttggctctctgttttctgttattggtgcataagaatgcttgtgatttttgcacattgattttgtatcctgagactttgctgaagttgcttatcagcttaaggagattttgggttgagacgatggggttttctaggtatacaatcatgtcatctgcaaacagagacaatttgacttcctcttttcctaattgaatgccctttatttccttctcctgcctgattgccctggccagaacttccaacagtatgttgaataggagtggtgagagagggcatccctgtcttgtgccagttttcaaagggaatgcttccagtttttgcccattcagtatgatattggctgtgggtttgtcatagatagctcttattattttgagatacgtcccatcaataactaatttattgagagtttttagcatgaagcgctgttgaattttgttaaaggccttttctgcatctattgagataatcatgtggtttttgtcgttggttctgtttatatgctggattatgtttattgatttgcgtatattgaaccagccttgcatcccagggatgaagcccacttgatcatagtggatacgctttttgctggtattttattgaggatttttgcatcaatgtttatcagggatatcggtctaaaattctcttttttgttgtgtctctgcctggctttggtatcaggatgatgttggcctcctaaaatgagttagggaggattccctctttttctatttattggaatagtttcagaaggaagggtaccagctcctccttgtacctctggtaggattcagctgtgaatccatctggttctggactttttttgattggtaagctattagttatatcctcaatttcagagcctgttattggtctattcagagattcaacttcttcctggtttagtcttgggatggtgtatgtgtcgaggaatttatccatttcttctagattttctagtttatttgcatacaggtgtttatagtatgctctgatggtagtttgtacttctgtgggatcggtgattatatcccctttatcattttttattgcgtctatttgattcttctcccttttcttctttattagtcttgctagtggtctatcaattttgttgatcttttcaaaaaaccagttcctggattcattgattttttgaagggttttttacatctctatttccttcagttctgctctgatcttagttatttcttgccttctgctagcttttgaatgtgtttgcccttgcttctctagttcttttaattgtgatgttagggtttcaattttggatctttcctgctttctcttgtgggcatttagtgctataaatttccctctccacactgctttgaatgtgtcccagagattctggtatgttgtgtctttgttctcattggtttcaaagaacatctttatttctgccttcatttcattatgtacctagtagtcattaaggagtaggttgttcagtttccatgtagttgagcggttttgagtgagtttcttaatcctgagttctagtttgattgcactgtagtctgagagacagtttgttataatttctgttcttttacatttgctgaggagtgctttacttccaactatgtggtcaattttggaataggtgtggtgtggtgctgaaaagaatgtatattctgttgatttggggtggagagttctgtagatgtctgttaggtctgcttgacagtggagtgttaaagtctcccattattattgtgtgggagtctaagtctctttgtaggtctctaaggacttgctttatgaatctgggtgctcctgtattggttgcatatatatttaggatagttagctcttcttgttgaattgatccctttaccattatgtaatggccttctttgtctcttttgatctttgttggtttaaagtctgttttatctgagactaggattgcaatccctgcctttttgtgttttccgtttgcttgataaatcttcttccatccctttattttgagcctatgtgtgtctctgcatgttagacgggtttcctgaatacagcacactgatgggtcttgtctctttatccaatttgccagtctgtgtcttttaattggagcatttagcccatttacatttaaggttaatattgttatgtgtgaatttgatcctgtcattatgatgttagctggttattttgctcgttagttgatgcagtttcttcctagcctcgacggtctttacaatttggtatgtttttgcagtggctggtaccggttgttcctttccatgtttagtgcttccttcaggagctcctgcagtgcaggcctggtggtgacaaaatttctcagcatttgcttgtctgtaaaggattttatttctccttcacctatgaaggttagtttggctggatatgaaattctggttttaaaattcttttctttaagaatgttgaatattggcccccactctcttctggcttgtagagtttctgctgagagatcagctcttaatctgatgggcttccctttgtggggaacctgacctgtttctctggctgcctttaacattttttccttcatttcaactttggtgaatctgacaattatgtgtcttggagttgctcttctcaaggagtatctttgtggtgttctctgtatttcctgaatttgaatattggcctgccttgctagattggggaagttgtcctggataatatcctacagagtgttttccaacttggttccattctccccatcactttcaggtacaccaatcagacatagatttggtcttttcacatagtcccatatttcttggaggctttgttcatttctttttattctttttcctctgaacttctcgcttcatttcattcatttgatcttcaatcactgataccctttcttccagttgatctaatcggctactgaggcttgtgcatttgtcacgtagttctcgtgctgtgtttttcagctccatcaggtcctttaaggacttctctgcattggttattctagttagccatttgtctaattttttttcaaggtttttaacttctttgccatgcgttcgaacttcctcctttagctcagagtagtttgattgtctgaagccttcttctctcaactcgtcaaagtcattctccatccagctttgttccattgctggtgaggagctgcattcctttggaggaagaaaggcactctgatttttagagtttccggtttttctgctctgttttttccccatctttgtggttttatctccctttggtctttgaagatggtgatgtacagatgagcgtttggtgtggatgtcctttctgtttgttagttttccttctgtcaggaccctcagctgcaggtctgttggagtttgctgcaggtccactccagaccctgtttgcctggttatcagcagcagaggctgcagaacagtggatattggtgaacagaaaatgttgctggttgatcattcctctggaagttttgtctcagaggaatacccggatgtgtgaggtgtcagtctgcccctacttgggggtgcctcccagttaggctactcggggttcagggaaccacttgaggaggcagtctgtccgttctcagatctccagctgcatactgggagaaccactactctcttcaaagctgtcagacagggacatttaagtctgcagaggtttctgctgccttttgttcggctatgccctgcccccagaggtggagtctacagaggcaggcaggcctccttgagctgtggtgggctccacccagttcgagcttcccagctgctttgtttacctactcaagcttcagcaatggcgggcacccctcccccagcctcgctgctgccttgcagtttggtctcagactgctatactagcaatgagcgaggctctgtgggcgtaggaccctctgagccaggcacaggatataatctcctggtgtgccgtttgtgaagaccattgaaaaagtgcagtattatggtgggagtgacccgattttccaggtgccatctgtcacccctttctttgactaggaaagggaattctctgatcccttgtgcttcctgggtgaggcgatgtctcgccctgctttggctcatgctcggtgcgctgcacccactgtcctgcacccaccatttgacactcccctgtgagatgaacccggtacctcagttggaaatgcagaaatcacccatcttctgtgttgctcacgctgggagctgtagactggagctgttcctattcggccatcttcacaaaaatcttactttggtttctagtgttaccacccactgttctttctcatctcaaccctgagtataagtacagatcacattccttgggttcttagaaaataatagaaatgaactctcattcatcaaaatgcccattagtaaatactgagggagaacaaactagaaatccagtatagaaaataaaaataggattatattccttggaatctcagaaaaaaacaatgaagagctttctttgggcattagacactttcccataaggtggctgactctcttttagtcatgtcagcttggcccaatcttcacttggtagcccttctttcttcttcattaatccatctcctatgctcctatggggtcctagagaaatgcccatcatgtacacacacatctaataacacaaagatcactctcgactagcaagcccttttatgatggtgtgagcatttgacacccttgttgctagtaacatcagtgagtgacctgacccatttttggaacagaatatgatcagtatgttgcctcaaggaggccctcactgttctaggaaatataattccagagtttgctgactcacaccatggaatatatgcataaaatggatcctgcagataagcctttctctgactagtttcagacatttttttctgggtaattttaaagttattttttatttttgtgggtacaaagtaggtgtatatatgtatgaggtacctgaggcattttgatacaagcatacagtgtataataatcaccagagttaatggggtatccctcaccacaagcatttatcctttctttgtgatacaaacaatccaattatattcttttagttattttaagatgtataataaattattgttgactgcagtcaccctgttgagctatcaaatactagatcttattcattctaactatacttttgtacccagtagccatcccacttcctcccctcccactacccttcccagcctctgataaccatcattccactctctatctctatgagctcaattgttttaagttttagctcccacaaatatgtgagaaaatgccaagtttgtctttctgtgcctggcttatttcacataatataatgtcctctagttccatccatgttattgcaaatgacaggatctctttcttttttatggcttaatagtactttattgtatgtatgtaccacattttcttcatccatttgtctgttgatagacaagagttgcttccaaatattgactattgtgaatagtgctgcaataaacgtgggaatgcagatctctttgatatactgattttctttctttagggtgtatacccagcagtgggattgctgggtcatatgatagctctatttttagtattttgtggaacctcaaatctattctacataatggttttactgacttacatatccaccaacagtgtatgaggatactcttttctccacatcctcaccagcattcattactgcctgttctttggatgaaagccattttaactgtggtgaaatgagatctcattgttgttttgatgtgcacttctctgatgatcagtgaggttgaggaccttgtcatatatctgtttgtcatttgtatgttttattttgagagatgtctacccagatcttttgcccattttttaatcagattgttagattttttttttcctacagagtgcttgagctctttatatgccctagttactagtccctggtcagatgggtagtttgcaaatagttgctctcattctgtgggttgtctcttcactttgttgatcgaatcacttgctgtgcagaaggtttttaacttgatgtgacctcatttgtccatttttagttgcctgtgctggtgcggtattactcaagaaatttttgcccagattaatgttctggagagtttccccaatgttttcttgaagtagtttcatggattgatgtcttagatttaagtctttaatatgttttgattttatttttgtatttgctgagagatagggctctagtttccttctgcatatggatatccagtttttctagcaccttttgttaaagagactattcattctctaatatacgttcttggcacctttgttgaaaataagttcactgtagatgtatggacttgtttctgggttctctgttctgttccattggtctatgtgtctgcttttatgtgaataccatgttgttttggttgcaaaagctctgtagtataatttgaaatcaggtaatgtgattcttccagttttgctctgttctttttcctcaagatagctttgcctatcctgggtctcttgtggttctatataaattttaggattattttttctatttatgtcaagaatgtcattgatattttgatataaattgcgttgaatctgtagatagcttcaggtagtgtggacattttaacaatatcaattcttgaaatccacgaacatggaatatccttctattatttggatgtcttcttcaatttcttatattaatttttttttagttttcattgtagagatatttcatttatttgactaagtttattgctaggtattttattttatttttacctattgacaatgggattgctttcttgatttcttttttagattgttcactgttggcatacagaaatgctactgatttttatgtgatgattttgtatcccgcaactttactgaatttgtttatcagttctaataggcttttggtgcagactttaggcttttccaaatataagatcatattatctgcaaacaagaataatttgacttctttcttttcaatttggatgcctttcatttctttctcttgtctgattgctctaactaggacttccagtactctgttgaataacagtggggaaagttaacatccttgttttgtttcagatcttatagccaaggccttcagtttttctgaatttagtatgatactagctatgggtctgtcatatatggcttttattatgttgaagtatgttccctagttttttgaaggtttttatattttaaggaagataaaaattgaactttatcaaatgcttttcatgcaacaattgaaatgatcaagtgctttttgtctttcattctgttgatacgatgtatcacactgattgacttgtgtatttagaaccatccttgcatcccgtggtaaatcccacttagtcatggtgaatgaactttttaatgtgttgttgaattcagtttgctagtattttgttggggatttttgcatcagtgtttatcagggatattggcctatagttttccttttttttatgtgtcttttgggttttgttatcagggtaatactggccttgtagaatgagtttggaatgattctctcctctattttttgaaatactttgaataggattgatgttacttctttaaatgtttggtaaaattctgcactgaagccattgggtcctgggctttttactgctggggagacttttcattacagcttcaatcttattacttgttattggtctgttcaggctttagatttttttcatgaatcaatcttcacaagttgtctgtttctcaaaatttatcaatttcttctaggttttccaatgtattgtcatccagttgctcataatgccctctaatgatgccttgaatttttgcagtaaccactgtaatgtttccttttttaatctctgattttatttgagctttctctttttttcttagtctagctaaatatttgtcaatgttgtttgttcatccacaaaaccaacttttcatttcactgatcttttgtattattttttccttttaattttatttatttctattctgatatttatcatttcatttcttccagttatttgagtttggtttgctcttgcttttccagttctttaagatgcattgttaggttatttatttgaacttttttgatataggtgcatattgctataaactttcaccataatattgcttttgctgtatcccataggttttagtatgttgtttagtatgtttccaatttggtacatttcaataaatttttaaattttcttctttatttattgacatagtcattccagagtatactgtttaatttccatgtggtttgtatagtttccaaaattcctcttgttattgatttctagttttattccattgtggtcagagaagaagcttgatatgaatgcaattgttaataatttttttaaaacttgttttgtgacctaagatatgatctgtcattgagaatgatccatatgctgaggaaagaatgtatattctgcagccattggataaaattgtctttaaatatctattaggtccatttaagacataatgcagattaaagccgatgtttcattgttcatttttctgtctggatgatctcttcagtgctgaaagtggtgtgttaaaatctctaaatattattgttttgggatctttctcttctttcaactctgataatatttgctttagatacctgggtgctccagtgttgggtgcatatatacttaaaattgttgtatcctcctgatgaattgacccctttatcattatataatgaccttctttttctctttgtgtagtgtttgtcttgaaatctattttgtcggatattagtattgctgctaatttttttggtttccatttgcatgaaatatctttttcattcctttattttcaggcagcgtgtttctttatatttaataggtgaaatatgtttcttgtaaataaaaattattattttaaaatatttttaaaataatactattttttaataagaacaattattattttttaaaaaatttcattagttttgggggcacaagtggattttggttaaatgggtgagttctttagtagtggattttgagattttagtgcagcagccacctgagaagtgtacattacccatatattatatatatactatatatgctttatatatatagtgtgtatatataatatatatacaactacatattgggtaatgtacacttctcaggtgactgctgcactaaaatctcaaaatccactactaaagaactcacccatttaaccaaaatccacttgtgcccccaaaactaatgaaattttttaaaaaataataattgttcttattaaaaaatagtattattttaaaaatattttaaaataataatttttatttacaagaaacataattcacctattaaatataaagaaacacgctgcctgaaagtaaaggaatgaaaaagatatttcatgcaaatggaaaccaaaaaaattagcagctatactaatatattatatatatactacataaagcatatatatagtatagtatatatataatacatttataaagcatatatatagtatgtagataatatatgtttatatactttaagttctgggatacatgtgcagaacgtgcaggtttcttacataggtatactcgtgccatggtggtttgctgcacccatcaacctgccatatacattaagtatttctcctaatgctatctttcccctagccctaccccactccctgacaggccctggtgtatgatgttcccctccctgtgtccatgtgttctcattgttcaactgccacttatgagtgagaacatgtggtgtttggttttctgttcttgtgttttagtttgctgaggatgatggtttccagcttcatccatgtccctgcaaaggacatgaactcatcctttttgatggctgcatagtattccatggtgtatatgtgccacgttttctttatccagtatatcattgatgggcattttggttggttccaagtctttgctattgtgaatagtgctgcaataaacatacgtgtgcatttgtctttatagaagaatgatttataatcttttgggtatatacccagtaatgggattgctgagtcaaatgatatttctggttctagatccttaatgaattgccacactgtcttccacaatggttgaactaatttatgctcccaccaacagtgtaaaagcgttcctatttcttcaaatcctcaccagcatctgttgtttcctgactttttaatcgccattctaactggcatgagatggtatctcattgtggttttgatttgcatttctctaatgaccagtgatgatgagctttttttcatgtttgttggcagcataaatgtcttcttttgagaagtgtctgttcatattcttcacccactttttgatggagttatttgttttcttcttgtaaatttgtttaagttccttgtcgattctggatattagctctttgtcagatgaatagattgcaaaaattttctcccattctgtaagttgcctgttccctctgctgatagtttcttctgctgtgcagaagctctttagtttaattagatcccatttgtcaattttggcttttgttgccattgcttctggtgttttagtcatgaagtctctacccatgcctatgtcctggatggtattgccttggttttcttctacagtttttatggttttaggtcttgcatttaagtctttaatccatcttgagttaattttgtataacgtgtaaggaagaggtccactttcagttttctgcatgaggctaacgagttttcccaacaccatttattaaatagggaatcctttccccattgtttgtttttgtcaagtttgtcaaagatcaggtggttgtagatgtgtggtgttatttctgaggcctctgctctgttccacgtgtctatatctctgttttggtaccagtaccatgctgttttgggtactgtaccacttgattggtgagagagggaatccttgtcttgcactggttttcaaagggaatgcttcagcttttgcctattcagtatgaccaatatgtagtcttttattcctcaccctctctcaacaccccacccccacggagtcctcaaagtccattatatcactctgtatgtttttgcgttctcatagcttagctcccacttataaatgagaaaatacagtatttggttttccattctttggttacttaattagtataatggcctccagctccatccaggtgtcttgtttttcatccattcagccagtctataacttttgcttggagagtttcgtccatttagattcagcgttatgattgataactaagggcttactcctgccatttggttgttttctggttattctgtggtcttctcttccttttttccttctttcctgtctcccttttagtgaaagtggttttctctggtggtgtattttattttcttcctttttatttttttttgtgtgtatttgttgcatgttattgatttgaggttaccatgaggcttgtacataatattttctaactcattatttcaaactgatgacaacactctatcgcataaaaaaacatggaaagagaaaactaataaaaactctacattttaacttcatctctctgcttgttgtcactttgtcgtttctatttacatcttattgtactgtttatgtcttgaaaagtagtttcagttattacttttgattggttcatctcatagtctttctactcaagatatgagtagttcacacaccacaattacagtgttacaatattctgtgtttttctgtgtactttcaattacccatgagttttgtattttcagataatttgttattgctcactaacatcctattctttcagattaaagagctccctttagcatttcttgtaggaaaagtctggtgttaatgaattccttcagctcttgttgatctgtgaaagtctttatttttccttcatgtttcaaggatattttcactggatagtctattctagggtaaaagttttttttttttttttcttcagcccttcaggtaagtcatgccactctctcctggcctataaggctaccactgaaaagtctgctgccagacatatatgagttccattctatgttacttgtttattttctcttgttacttttaggatcctttctttatctttgacctttgggagtttgattattaaatgccttgaggtggtcttttttggattaaatcttcttcgtgttcttgtacttggatattaatatctttctctaggtttgggaagttctctgttattatccctttgaataaactttctaccaagatctctctttctctctctgtctctctctctctctctctctccttcttaaggccaataacttttagatttgcccttttgaggctgttttctagatctcgtaggtgtgcttcattgtttgctattttttttttttttttgtctcttctgactacattttcaaatagcctgttttaaaactcactaattctttcttttgcctggtcaattatgctgttaagagactctgaggcattcttcagtgtgtcagttgcatttttcagcaccagaatgtctgcttatttttttttagattatttccatctctttgttaaatatatctgatagaattctgaattctttcttagtgttatctttaatttccttgaatttcctcaacacaactattttgaattatctgtctgaaaggtcacatatctctatttttccaggattgctatctggtgctttatttagttcattttgtgaggtcatgttttcctggatggtgttaatgctagtagatgtttttcagtgtctgagcattgaaaagttagatgtttattgtagtcttcacagtctgggcttgttcatacctgccctccttgggagactttccaagtattcgaagggatttggatgctgtgatcttagtctttggtcactgcagccatatctgctttatggagcatcccatgctcagtaatgctgtggctctttcagactcatagagttactgcctgcatgctcttgggtaagagccaggaaaattccctggattaccaagcagagactcttgttctcttctctcactttcccccaaacaaatagagtctctctctctctctctctttctctctctctctctccctctcattctctgccgacctgcctgaatctggggtagggatgacacaatcacatttgtagtcaacaccattgggactgtgctaggtcagacccaaagctggcacagcactgagtctcgcccaacgcccacagagaccactccctgggtaatgtctgtgtttgctcaaagcctaagggctatacaatcagtcagtggtgaagccagcctgtcttatgtccttcccttcagggtgatgagttcctcaagcaggtccagggatggtgtccaggagccaaggcctcgagctgtgactgagctggcacccaatccataagacaaagattttttccacactttccttccttgtcctcaagcaaaggagtctctccctgtggccaccaccacccccatgttcatggcaagtattgtctggctaccaccaatcttcactcaaggcccaggggttctttagttagcttatggtgaatgctaccaaggctgagtctctcccttcaaggaagtgggctcctctctggcccagggcaggtccggaaatactatccaagagccaaggcctggaatcagtttccccaagagtccatttggtgctctacacccactgtggcagaaccagtacccaagctgcaagacaaagtcctctttactcttccttctcctttacagagactctccctatagccaccacagctgggaatatgctgggtcactcttgaagcaagaacagctctgagtctcactcaaaactcctggcaagtactgcctggctatcacactgattattcagggcccaagggctctttagtcagcaggagatgaatcctgccagtactgattccttcccttcaaggcagccggtttctttctggcccagtgtgtatctagaaatatcatttgggagctagggcctggcatggtgacctcaggactctgcctggtgccctgttctactgtggctgatgtagtatccaaattgcaagaccaagtcctctttactctcccctctcctgtcttcaagcagaaggaatgagtccgccctggagttgggagctgcattgcctgggattggaggaggggtggcacaagcactctcttggtcaccccagctggtgtcttactaggtcgcatgttccccaagtccactggctctgaggctagcacaccaggatttgaccaagaattgcaattcttgtggcttacactgcctttcaagtttatttgagatcccagagcactttagcccacagtgacagggcttgccagaatttagtttctgactgctgagatggacaatttgcgtctgattagggctggtctaagtgctccttctgtgggcactggctgagttctgctccatgttgctttctgctgtgacagggcaacattgagtttcaatgcaagtcccacagtcactgcaatcttcctctcccaagcctgctctgaacaccatgtggttgctgctgggggctgggggagggatgttgtaggcaattcaagaatgtctttcctacccttttcggtgcttctttccttggtatgatattaaaaccagttactgtgattgctcacctgatttttggttcttatgaaggtgcttttttgtgtggatcactgttcaatttgtgcctgcaagcggggatgggggacaattgctggaggcttctctttggccatcttgctccacctctaccctagtattagcaatttcaaagcagttgggatggaggtagaaggaaagggcgcttggaatcagaaaatccatgtcttagctttgagccttagaaaattcatttgacccttgtaagcctcagttgcttcatctgtaaaagagaaataatataatggctgaaaagatcaaaggtgataatgcttttgaaaacactatagaaaatgacaaaatatcacatgagtattattttctagtttctaggagtctccttaccattgtacaggacaaccatgtctatttttaaataaattattatttgcctctgagcaaccctgcaaagagttgcctgtaggagaaacagctttacttgcaaatcactccactgttttctttgtgcacagcttattaatacataaggcacatgtcctccagcctgcagtaacattggaatcattacctctttggagtacctaccagagcttctcaaagtgaattttgtttatcaccacaaaaaatagtctgttgcagagataacctccaaattcaatgacaatatttccaatcacttttgcatgatgcagaaatagacaaatatataattttgcttatagagacaattattgtctcccaacaagtgatcagtagtcagaaaatggccaagaaataccatggggtgtgccttcccataacagcttatctttgtgttttagttgcaaggttactaaaagcctgtgcagggtttatggcaaaagtaaaacttgctccaggagcaagcccttgtttcattgtctaatgttcttaatccccagcagacaggatttggatctggcatttggtaacagggcagtttccaaagttgctgtacgcaacttgaggaagagaggtgatattatcggaatgaatttctttgttgtaagttataaatgtatgggcttttccaatcccatcacccttaaaactttatttgttttctgcagtgagggtgtctccgttgtctttaatatgcttgctttgagttcatggatgaacattcctgcctggctgacatgtggactctctgaaattgttataaggtctttttctttgtttttttcttgatgcccaagctgccaagggtagtactggcagtggtgggcagacaaggaggtgatagcaaactttgtcctctggcctcccttgacccattccattcattatctaagggactccaagccagcattccacagagtgccctcaccaaactcactaagactgaaggcgaaccaggattccaaacagccattatgaaaggaaagagagagagacttagggtttgcaaaataagataccctgttgattctttttattccatacagatactactattctttaggaaaacgttaaaatcacatgatcttccaggacctgggctgcttctttaagaagcatgttacagaaagctttattggccaacaacatattgaaagatagattaatcaatcattcattcaaataaggtatattcagaattgaggtatattgtagccagacagtgagactacaaaaaaagaatgcaccgtacccttatctcttgcacaatctaacgagggagataaccactctttcaatttatagtgacctataacatttcgtacactgctgaatatctttacatggtaataacacaatggaaagcttgcaaaatagacagaggctaggggaagaaggattgagtgtgaatatagcctcttataaatcgagaggaatggtctgtgtcttctgatcatacagagataataaatatggaaatgatttcaaactaacaaagcaaatgtgcagaaaatactgagaatatagtgggcaggatacctgagttttggttccatctctgttattgactcattgtgtaatctgagtcaggtctgttctgctctctggatctcaccctttcctatctgtaaaatgagattgttggattagatgatctccatagaggttctcacctattctgacattcaaaaggactcctaatttttcttatataataataatatatatgatctgtagagtgctttacactttatatgatatttttgcatctgttatctcatgtgagaaaagcactggactgctggactggcaatgaggacacctggattcttgtctctgttttgacactgattcatggtgtgatcttcaagcaaattctctgagtttcagtttctcaatctgtaaaataggggggtatgaagattggactaaatcagtaggtctctaaaatgttccacaaagccctggggtggggggctcctacagagtttcgctaaggcaaaccacaacgctaagcctgcatggaagaggagaaaaagagtggcctgacaagagaagttcccagtttcctatgccaaccccaggcagattacatttaattttatctgatttatatagagagtttctatgtaatgttttattcttaaaaatagtttactataaaaaactcaactggtttgatttttaaagattgcacatataagtgagatcatgcagtcagtatttgtctttctatgcctggcttatttcacttagcataatgtcttccagcatcatctatgttgctgcaaatgacagacttttcttttcattaaaggctatatagtattccatcgtgtatgtacaccacattttctcttttgtaactttcattttaggttcaggggttcatgtgcatgtttgatatataggtaaactgcatgtcagagaggtttcttgtacagattatttcatcacccaggtaataagcatagtatctaatcaatttttttctgatcctctcccttctcccaccctacaacctcaagtaggccctggtgtctattgttcccctctttgtgtccattacaccacattttctttatccacttatccatccatggacacttagtttgcttccatatgttggctattgtgaataatgctgaaaaaagtcaaactcatagaagcagagagtagaatggtggttaccagggactgggaggcagttgactgagctaggaaaagagagataataaaagggtacaatgtgtcagttatatagaaggaataagttatattgaactattgcacagcatggtgaccatagttaataataatgtattatatgtctcagtattgctaaaagagtaaatttaaatattctaaccacaaaaaattattagtaggcaaggtgatggatatgttaatttgcttgatttaatctttctagaatgcatacatatatcaaaacatcccactgtaccccataaatatatacaattattatttgtcaatttagaaatttaaaaacttgatttagatgagctctaaggccttaagtattaaagtattaagtattaaagtgatatgtaaccaagtatattgtttggtaacttcatttttgttattattttaacaaaccaatatattgtgaatatacttccaagtgaaaagaaaaaagacattgcagtcatcactaataactgcaaaacattcctttgcaagaatatggaataattcatttaatcattcccctaatgttagacattcaaatgtttccaactttttctatttaaataatgctacaataaacttctattttgtgcttattgtattattttcttacaacacatccctagaagtggaattcctagaagtttatacacatttccaatttttttccaaatatatggcaaaatttctctctaaagtatttttattcctaccagaaatacctcttcaccaacacgtagtatttaatctgtaccaatctggcttaagacaatgatatttaatttgtatttctgtgatttctagctaaattaaataatcttcatatgcttattggtcatttgtacttctaactgctttctcctgtctgttgcccatttttctattgtgctgtttatttttatatatcgaatatattgaccattggttttacatacttgatgctaataattattcttagtttatggtttgtctttgagttttataatggtgtttatttcacataagaaattataaatgttttctaatgaaatttatcaagtctgtcttcacttatgttttcttcattgtcaataacttaaaatgaccttttctacctttaaaaattttgaaattttcctctgtattgtctaatagtacttacatgatttcctcttttaaattgacatatttaatccatttggaatttattttgattttaactagtaatttaactttattttcttctccaaatgattcactagttgttctgacattatttagtgaataattcatcctttcttcactgaattggaatggcatattccatatactgtgtctggttttggcttttctgatctcttccactgatcaacctaagctggagccagtatcaaactgttgtaatcattatgcctttagatactttaaatgtacagcagggaatgtcttattactcttatttttcacaaatatcttggcattgtctcatgttttattccttcagataaattttgggattattttgtcaagattttgtttgagttgttttaaatttttagatttcattgggaaagaactgaaatccttgaaatattgcttcttcttagccaggaatatggtacaactttgcatttaattcagttctttccttaaataccaccatgaagttttttgttttgttcatataggtcctgcattaacaccatatatataaagtgtgagaaatactacattcttcaggattctctgtaggttaacaatgaagatgatgactcaaccctttctttgtttgcataatgtgatgccactaatagtgggtaacttctctgccttacctcctctgttccaaacaggatttttcagaatgaacaaattaaaagaatcataatcagacactaaccccaagccatactgcatggcagcaccaatgggactgacagaaaacaacagaaataggaagaaatcctacagagaaacaaacttgaaagctgtctcatggcctttgaatcatacttaagttttatgatggaaggatacgactatgaagaaagacacagagcaacatcagacagtcaagaatttcagagccagctggcatgcagtggacctcatgccagcccattttatgactatttaggtagtcaagggtttaagatttttctaataagacagttattatgcatttcaatgagtgatttctttgcagctctagagtgtggccttacctacttcaacatgagaagatttttgtattttgtcagtcatttcacaatgacttttagtgagcccttcattatagactgtggatacaactttgctgttggaaattaacagtgtcaaacaactgggtataatgtttgtaatatctgaggagggggagctgcctaggaagttgtattccctgtgttaatttttcagtctcttaggttatagaggaccttctagaaccaccttacagcaggattacatcccatttacacagttctctgtcacttgaatacagagaagggatccacaaggccatatgcttcctagacaaagagaaaagatttctgccacactcagaacgctttgtcttcagactataatcacccacaccatatttcctttggatccactttccagatttttgtgctggcactaacaccaacttgctgtggcttggggcatgtaatttcaatactttgtgcccattttcataagtgaagtgtcaggcatcacattggacattttaagattctttacagcccaatgattctgtgtttctaattaggcccaatgggttagagctaaaaggaaacagtgagtttcctggaaggaaaggacatataacacagtccagaggtaaaatgggctgtattcaagaaaagataggacaatactttgcagggatgctgcagagaggattcaagccttgtatggaggaatggatgtgatacaaccaaaaagtctttaaaaattctttccaactaatctgagatttgtaaccttatggactgtgatttgcagcaaaccaaggatgtgataaagactagtattgtttctagaatgcaaggatggttcaacatatgcaaatcaatagtattaacagaatgaaggacaaaaactatatgatcatctcaatagatgcagaaaaataatttgacaaaattcaacatcattttatgataaaatctttcaagaaattgggtattagaaggaatgtttctcaacacaataaaggccatatcagacaagcccacagctaacattatattcaatgaccaggaatgagataaggatgctcactctcaccacttctgtttaacatagtactggaagtcctagccaatttcatattaatgagcctcattttcttcatcatagaatgaagtatataataatccctgttatacttactttgcacagattattattattatttaattattattttgagacagggtctcactctgtcacccaggctggagtgcagtaccacaatcacagcttacttcagccacgacctcccaggcataaaggatcctagcccctcagcctcctgagtagctgggagtacaggtgcacaccaccacacctagctaatttttttttttcatttttttatagagacggagtctcactatgctgcccaggctggtctcaaactcctgtgctcaagcaatctttccaccttggccttccaaagtgctgggattacaggagtgagccactgcacctggccttgcagattattattaaactttgtaaactaatcaaatgagagtgattattgttactgttaagaactctgatagcctcatccatatatttggagaaattgaataaataataggaaagaaataatagcatcccaatgattttaccttggctctaccatcatttggggaagtgataattcagataggagaagtgacttggaagcagtcttgagagattgcctgttccatcccctatctttgtccttaaaccaaattgtacagataaataaggtcttatttttaggacttacagaaaaaagattcctttcatatccatctttgcaatcctcaaccacttctgtcactattatgtgtcatttcaaacattaaattcctcattctgctttgaaggaacacatgtgtcatgtgtacccatttgtatgttttggtgtgttttatgctttatgtgatcacccacatatgcacagataattccaaaatccagtgtgtgggtgttgtattccctgtgttaattattcagtcacactcaaacacctatgcactcacacatacatgaatacacacatgtacattagcatgtttatgcttatgttgcatgtgactggcaacatcagtgcctttctaaggcaatgttaactaccttgagttttgggagagctttagagaacaaagacaagagactaaatgattctagatgtaagagacaatgttgcaataagttactatcctaaaaagacagaatacagggacaagagactattattttggatagtttcttgcttaccagtaatacttaagtcctttacattaaaaaaaaaaaactctgtaaatatattgcagaagaaatccagacatccttcaagattcttagagctggaaaagattttaatgactttccagtccaatctatctcatgtaatcaatggggcccagagaggcaaaaggtcttgtccaaggtcatatagtgagttagtgataaggctgaacaaggattcagatgttggggcttccagcccactgctctttctctcatctgggatttgtgtatttttgttcattagagattttcctctgtaacctcaatatccaatgcagggccttgcacataatagattatcagtaaatgttaaattaatatgtcatggctttggttgtactgggcttttgcacttactcctgagtaaattgtaaagaatatctacgttttaggttgccttgttttagaccaagaggtacccagagaaaaggtgtgaactatgctaaggaaattatccgagttccaaattgaaaaaaaaaaaaaatcatgcttttccgctataacctctctcattcacagagtgattctctttcagaagggcaatctagaactattatgggagccatattccattggtggtgcaaccatttcttgacaaactagggtccaagaaagtattttcctggggaagatgagatttctcaaagaaggcacgcactttctaacctaagcttatttcagtaatcaatgtaacaagctggtcttgatgattgcagcagtaccaatactgtgggagtgtaccagttctagaacagctacaacattggaattgaacgcactagaattggatacaggacctgtttttgaggagctaacacccaaaggctgaacagcactcgtagcaccgtcctttctgtgcacatatggtagtcctcagtttgcaacagaaataaagctgttagcaaattatgtgttctatttatgcaaataaaatcttgtggtatgctagaaagagcactggcctggagaccttagttttctcatatgttaaaaacccctaacacaggcctggttcatagtaggcacccaataaatagtagttttcttcctttgggggcctccgattcagtgtgcttcttcaggtaagtcacttccctggaactcctccttggaatgagagttgtactgttgtgatttttaacagttccttcaagccaagcattttggaatcctttcataaagggagaaaggaaggaaagaagaaaggaaaattaaaggaaaaagaacaaataaaacgttaaaaaggaggaaaggaaaaaggatcctttactacaataaaactaatcttatgttcttgcaagtagcactttaagtaaaagaagttctttgctgacctggttactactgaacctactacataaaatagcctactataatagatgcatttatgtgcctaatcttcactttttaggcttagtaaagggagaggaaagctgatgtatagttaaatttatgtttttagttgtttttttttctactctcaaatatcaatcactctttagtttctctttctttttccgaccacaagcattcttcctctgcttaaagaagcttccctaaaatcccagtctatccagtaagccaaagcacagcaataaatttgaggaaaaaataccagggacttagagacagaaaggagtgaggggatgcagaagctgaagctggagcacggttgcaagcatgagaagttctgcgtgtttcagagcagccaaggatgtatttttgcctattcctgctggtgactctgtgtgtctatgcatccatctgctatatttacatgtttagtcagtcaatccacgtttgctgagagcctgctgtgtgccaggattgtgctagcgtaaaggagcaaagtattgagcaaaatatgtttgagcagctgtaattctgaggatctctaggtctgagcatgtgtatgtgtgtgcgcttctatgtatctgtgacaactccaggtgttcatgacagtgatctttgttactctgttggcttcatcgaacttccttttacttgctgtgattcactacatagagtgggctttatctctgatttttataacctgcaagactgggggtatgatcaccagcaatctaaaaacagttagaaatcccatggagttatcttttgtagaaattttcctctactaatattatgaaaaataagcatcttattagctcgagtgtaattctatgcatgattacaggtatcaataggaagaaacattgactgagttcaaatctcttctacgccatgctaaaggggtgacaagttccacaatggatcattttctcatgggcatttctgacttttggtaaaagtagagcaccttattttaaaaaccattgagtagtcctaatagtggagatatcatcaggatctgaattgttcatccctaaaaaaaacaccaatggaaatcaaacaatatagtgccaaattaaactgtttgaatatttaggttctgtatgatcaaattgtttggtgccatactctgtccacttttttcatgtggtaggatataatttcatatcttttctgttctagaaatacccgaagaaagagactctggaaactcattatcaggtctatcaactcttgtatttgttctcccagggaaacagaagtacctgtgcgccagcagaaatgattgcactattgataaattccgaaggaaaaattgtccatcttgtcgtcttcggaaatgttatgaagcagggatgactctgggaggtaagatacttttctttctcttcctcctccttcctctctcccccttctccctcattttctagtctctctttagaccagattttcttctttgatgcttccaaggggaccagccatgctctagacacaggctgaccctttcataggcaacgtggccatcagccagctggtgccttttttttaatccttatctataccaatccccattccggggctcagcattagagcaggcggtgtgaagcagggatcaggagccaacagaaggtgagtgaggatgcatctgactgggcagggcccccaggggacttaatgatactggcctgatgttgttcagtggtagctaggatgagagaactaagaaatccagaacagtcagaggtgcaggatgacccaggcataggcgcaggatgacccaggcacaggctgatcctgaacacctgggaatatcccttagctaactgctgcctatgttgtagggccagccacctcgaatgagaagctacttctctttggagcctgtgactaggctgccacacagagccaatttcctatcctatctctcccaaagatgagcaggtgttttaataatttccttttctttgcaaagctattgaccatttccaaaagcattttttttcagtagcacagtaacgtgatagatggaagatacagctctttcaagggcgttcctctatcataaggctctctgtcccacaaacctgtctaccatgagtgttgtcaccattccagaaaggcttgacatcagttgattgagacttatattttccctctccaaactcccccatctcttcatgtttacatctgcccaatgccagggtcctcgctgctgcctgctacttccaaaaagatgtgtctttcatgagaaaaacaagatcattaatccacttcgatttggaaatggaatttgaagaaaggcaagcctatttctgagtgcctgcaactgtagcctcatacccaattattcattattagcctggaaaacccaagtgcctagaatccaaccctctcccctctcctcttaagtctaatttagaccagttgtctatctctggctttctgtgaggtgttcaataccttgtctgcctatgtgcacatttatagacaacaactagttctcttatcctggagcagggccatgtgtggatcttcatatagataactatatcctccccatcctcacagggcagtagtattatttaaacagaacaaagtacctcacatgaattgacccaggctggatgagagacaatttcaaaagaatcatctcaagtagcgtccagtactcccaaacatcacaggtagatgttctgtgagtggctttccaagcatccacatcaaatgagactcagatatctgagaaaactcaaccttgttttggtttgcttggtgcaccccaaagaaatccaacaattgaggtctacagtggagaagaagtaggactggggtcagggagtacagaggcaaaggcaggaagggtgacaaagtgattgacaagaaaaaatgttctccatatgaatgttgcagccccatgttgagggttcttatacactcaactgtcaattatttagccttctgtgaattatgtatagtataaaagatagggactctcaagtagggaacctcttggcttgccatctggcaatatgaattgcaagtccactttgatgcaggtaaagtttaatggtaacaaaagtcctcataacatttggatgcaaatcttaacattaattccatgtctcagccaacattctccattattaagcagcctgtgatgtgattacagtgaaccacttttgaaaaggagcctgtgtataacagatagtttcactatactatataaccgtcagatgcaggcttgtaaattaatttgttggtgacaatgtttcagtacattttcaaattgattcattggtatagtactcaaatttgagtgggcttggtgaacacaatgaagacaagctgagaagtgctgtgactggccttcatttcagttgcaggcccatgatattttgagtgtcttccatgtacaaggcaccatgctaggcattagagcttgaggctggcaaacttcaggaagtgttcacaagataccaggattcttgatgttgtgtaaatggccttgcctttagagtcaggcagatctagtttaaaggctcagctcctttatttactgtgtgcccctctgagcctcaatttcctcatctctgatttagaaataccatcctcatagagttataatgagtatcagatgacatgatgaatgtgaacatccttgataaatagcaaaatgctagacaaatatgggggcttaatatgacattgaggtcactagtaatttagctggaaagtctgtaacacagcacttcccgatggcttttaccctaagtaacttggtatgccatataatatgtaacagcaccaacaggcagagaatcgccagaaaacactcttgattacctcaaacgaaaaagtaccaccaggatcctgttcagaagctaattttagtaattaagggaatcatatgctatgttcaaataccatgccagtaaaaacccaattgtttaccttcttaaatcactgcttgaagagcaaatctttccattttgctgaatgaacttatctccacgttccctgccctactgacacaaccccctcccaagtttattgttaacttacacattcaatgcacagcacacctttactcaaacaatggaaaagaaagaaagtgtcaattcaaagtggcccttgtctattccttaaggagtagacttccattttcatcagatttggatttagcatagacatattgattaccttgaagaagaattcatataattttatcttctgattcccatcactcaaatcaaaattacataatatattccaaaatggcaactaggaatgtggccttgggcaagtcccttctctcctctgatgcttggttttcccatcatagaactggaattgtggcttcaccgaggacctttctggtgctaacattttgtgattctatgtaaaaagccacacagaaaggattgtttttcagccctttcttagattgtctgttccctgctcccagaagtatagatagtgagacttgagtgctttgatacatcgtaattgtatctacctccattcacacctacttaagatatctgtctaaaagtagactagacagattattcagagagtggagggcagaagggctgtctctgtatcttaaagaagctggcactcttcagctgatggctgcttggtcttgaggcctcaagatctttaatctggctttctctatagtgtttcattcactgtttggtgatggaatctcttcagttcagagatacttaatagatatagctttttctttcctgcttccaggcctacctacctgtttcttgcttttttttctagcagctgttgttgtttctgaaagaatcttgagggtgtttggagtctcagaatggcttccttaaagactaccttcagactctcagctgctcatccacaacagagatcagcctttctttgtagatgattcattcctggctgcatttgaaaaccacatattgttaattgcttgacgaatttaaatcccttgactacttttcatttcagaaaacacttacaaaaaaagtccaaatgaggaccttccctccagtgaattagctgtggctttctcacagtccatagttaggataaatgtaaagccatttctcatttttctccgcactttccaagggtacactccttgtttccaagatggaatgagaaataaagaagtgcccttcctgccatcttctcccctgaccctttcctccttcccactttcctcctattcctccccaaacatgatttatttctgcgttttgcaactcttgagttctcagcatttagtaaatggtgttggtccctgttgattccttcctctcctggaccatggaaggtagtaggcctttcagaaatttcaggtagcagccaaaccccagaagaagagaaggaacacagagacctagaccatgtgagaacctgaggtgtgcagcatttacttcacagattcgtctagcatatttgagaggtgtctttcctactaggagactgaactctgcatctgagaataaaaacttaacatatctacaggttttgacaacctctgtgaattatctagttgagaggatggctcaaggagcctattgccatggtctgatgtcgttatggacgctatgaacatccttgcagtttccattgttgaagacagccctgatgccagctgtctcatcattccccatgttcaagagcatcccagcattgctacctcaggatcccatgtcctgaatgcaacagagtgatttcgctgctgaattactattcatggcatggctcttcacagcatttattcatccatgtatctatccattcatccttccagccagccaagaagttcacgctttcatcttttcatccatttactcacctatttattcatttagcaaatatttattgagtaccaactatgtgccagacactctgctaggcattttggggaagcagaactgaataagatactattcctttcctcaaaaatttgagcaagaggagaaaggaagtaatgaggaatattccttagccataaaggaaaaataagaaatcacttggaagaagttaggtgagatggaaggaaaaggacatctaaggtaaagcgtacagtttgaataaaggcacagagacatgaacaaaatgcattgagggtttgaggaacagcaattggtttaacatggccagagctggggaaatggtaagggcaagctgaaaccacattgaaagcaaacttggttattatactaggtagtttagacttcaagcagttgaaaatctttgagcatgggataggcatgatgacattgtgtttatttgcatgtttctttaaagaaaactggcagcagcacaaatgttttgttgatgagggtttaaattgtagaaagtgagacaattttaggaaggccagctagagagaaatttctagcatcaaattttgctaaacacctaggatttgtagttacctccatttgggttgttacctgcaagtactgaccacgtatatgaagaagtactggtttagaccaaggcaattggcttgtataagaggcctaccctcataccaaaagccagtttccttggtctaggccagtgtttactggtatgtgtcctgagaaaactagttccatgacatgttccatgaaaaatatgatttctattgtcaaataagtgagggaaacttgcatatcatggtcctgctcaggaagatttacaatccttattagcatatcacaggtcctggtgaatactgcggtaaagtaaccgaggagctttgtaactcaggattcccgaagttgattcaaccacaggacctcatttattcacataacacctgttatcctacaaaaccactgttctctggaatacactttcgaaaacatgggtatagacaaaaactctatcctataggcagagaatacctatacctctagctcaggtcatcattttgcagatgtgtgtgtcattaagaatcagtcaataatgcattaatgatcaaaagcagaccatccttaccacatggtgcataagattatgctattatgctattagctactaatgccactaaagttaattatgttgggtctgcaacgttgtcatacacaaaggataggatgcaaaactgtcctaggccaaagcatggttattgcccaagttatctaatgtctgcaggtacatattcctggcctaaggattgtgctaaagaagttatttctaagaaatatagtgacttccagcatcatgcagaatgaccatttaatattttgaatatctagacattctgctgtagaatttaatagtccttttatacactgtctgaccaacattttgacatttactcagaaccccatcacagtgctaccacataacctcattgctaaagtgggaggcctagaaatcacagatttgtagaaaccatccaatgattgaatcccctctacttcctgttcagcaggcagcagagtgtcataaagaattaacaacgtggaactcagttactgggatttcttccattctcctttgattctctagactagaattccaaagaccctcaggctggtgatgcaagtgggaagtctcatttctgagaagtgctgcttcctacccacaattctttgatagctgagtgctttagctgatctgcataactgaggtgtgcaccaaggagcagaattactctataaattttggcatcaacatgtgcaacttgtgactcagcactttgaaactctggggatttttttgtttggttggtttttgttttaagatgtcctgtggtatagtggaaatagtacaatagactcagatacagagaggccttgtttctagtcttggttctgtcacttactatcttgatgtccttgcacaaatcaccagacctctctgagcctcagtttctccaaccacactgtgggaataataaaatcttttttacggcattgttgtaagtatgtagagaaactggtacacagtaggcacacaatcaatgtcaccgtacccttcagcccttcttttgtggatgaaaaatggtctttgtgctcccagtcaccactggggtctgttctctctctctctgctgttacagtgtggcttttggttcttgtttctttgttctttggtctgtaaattacccttgaaacaacccttgaaatttccactccatgacctaaatcgtcatccctaaattggttacatacatatttggtgacactttggaggggaaaagctttatgtctctctaactgtagttcttaagggaatttgcatatggaaaaaacagagactgcgtctcttaattcctccaaaccaaattatctgggatagcacatatatgttgtactctgtctctgagcatttgctcttagagaactatggttagagcgaagtaaatttttctaatcataaaaattaatgataccgcatatctgatacttgaatgagtacctccttgtaaaatttatacttaaatccttgagtttttaaagtgtaatagcaatagaaagattttattgttgtttacttttactgtgagtgctccaaaatccctcagttgctcttgaaagagcaagatgatgccataggcaatattttccaaaggtagtaggcagaaaactgagtacacagcacacaataggccatatatacaaaagcaagtattttgcaaataataataattcaggaaaaaagcttcactttcgttggtaacctgtttgtttaaaaccattttattatttattatttaaaaagagtgtcacttgttacagattgtgggatgtgttccttaagatcacaaaaatgtaaaatattttctttttatactgaacacatgcatagacaacttacctgagcaagctgctttttggagacatttgcacatcttttgggatcacgttgttaagaagtagaactaagggaaaaacacgcagccacccagaaatcggtagagccttcagctcatctgttattaatatttctgtgacaacagatatctaggaagtaaacaggaaattgcatcgctatcctgcatcaccttttttggaatcaggttccattcttctcagtccagttcaaccttgtgatactttttagatctcaaccaaggcatagaaatatattttcccttgcttaataccccatggaaccaatgcccctgtggttgaagtaaaaattgattgttgagggacatttcagccctctagcagtcaacaattaaaaacatgtaagcaccgagcacctgcagaaaacttggactggcatttggatctaagaagaaaatctgcatcttgaccaagatgaaaagtcaccagcccaagcttgtgcagtgaagtgtcatgttggccacaatgaaactgaaagagactgatgactctcctcagggtggaaaatgaggcatggaagctttgattagtgagctgttaggcacacagacattaatttcaaagcattctcatctccagtctgagtaataatgcttatagtattatgcaattgtttggctgctgcaagaaattcagcagactccaacaagtagtctttcttggtctctgagtgactgtaacttaaattctacctcccttctcttctcctacatcttctcactccccaccccacccccacatacacacaattcttgtccactatgttcagagagatgcacgcacacatatatatgtatatatatagtatatttgtcaataaagcagaaaagaagaaaaaactccaagtaaacaattttccatttccccatctcacttctgtcttacaagtggataggaaaagaaaaacccccagtaaaaaatggcaaccgcccacctccccaactttacatgctgcttcctatgttagaggatctgtcttaggcatctgattatggagcctgctagatacaagcccgtatttagactgctacagtcaacaatgtctctctttcatactagaaaaattccgggttggcaattgcaagcatctcaaaatgaccagaccctgaagaaaggctgacttgcctcattcaaaatgagggctctagagggctctagtggatagtctggagaaacctggcgtctgaggcttaggagcttaggtttttgctcctcaacacagactttgacgttggggttgggggctactctcttgattgctgactccctccagcgggaccaatagtgttttcctacctcacagggatgttgtgaggacgggctgtagaagtaatagtggttaccattcatgtagttgtgagtatcatgattattgtttcctgtaatgtggcttggcattggcaaagtgctttttgattgttcttgatcacatatgatgggggccaggcactgactcaggcggatgcagtgaagctctggctcagtcgcttgcttttcgtggtgtgctgccaggaagaaactttgctgatgggactcaaggtgtcaccttggacaagaagcaactgtgtctgtctgaggttcctgtggccatctttatttgtgtattaggcaattcgtatttcccccttaggttctagccttctggatcccagccagtgacctagatcttagcctcaggccctgtcactgagctgaaggtagtagctgatccacagaagttcagtaaacaaggaccagatttctgcttctccaggagaagaagccagccaacccctctcttcaaacacactgagagactacagtccgactttccctcttacatctagccttactgtagccacactccttgattgctctctcacatcacatgcttctcttcatcagttgtaagcctctcattcttctcccaagccagactcaaatattgtattgatgtcaaagaagaatcacttagagtttggaatatcttgttctctctctgctccatagcttccatattgacaccagtttctttctagtggagaagtggagtctgtgaagccagggaaacacacatgtgagagtcagaaggactctccctgacttgcctggggcctgtctttcccaccttctccagtctgtctaaacacacacacacacacacacacacacacacacacgctctctctctctctccccccccaacacacacacactctctctctctctcacacacacacacatacacacacacttctttctctttcccctgactcagcaacattctggagaaaagccaaggaaggacttcaggaggggagtttcccccttctcagggcagaattttaatctccagaccaacaagaagttccctaatgtggattgaaaggctaatgaggtttatttttaactactttctatttgtttgaatgttgcatatttctactagtgaaattttcccttaataaagccattaatacaccaatcgtattttcttatttacaacagactgagagaattaatgctgttaacattggatcttttttcttttttttttttccttttttttctctctcgtttgctttccaggtcatgctgacctgttcagcttggactgtttcacatttgtttttaatgtcagtttaaatgtaattgtaaaagcatgtatgctctaaaatcatgtagttacttttttcagtggaaaagcctggtattcgaaagcatttccaggctctgcaatttcatatgagcaggtttttggtaaaatcttttgtccctcactcagggtggtatctggacagtgagcccctttcttctggctcagtagtcagagagaggagacttggagacagtttctgctggatcctgtgctttggcaaggatgtgcagcattgcatatcattctatcattaattatgtttactcctccatgaactaaaaaccattagactaaatagtccaacataaaccttgaaagataaaatttgatattcttttgcctggccatttctctgacccagaattggggctgggaggggattggagacttgggggaaagaatcaaggagccttcttgcctgggggaatttggcatgcacttattaatcccatttggttgcactccctactaatccctcactccatacctgccaaggattggctctgctccctgcttctcatccctgtcctagttcttcctcacctatctccatttcccactactgatccttctctccagtaagatgctattcaacccgatgaaatataaagagtagcaccaccctggaagtcaggataccttagttttagctcctgctctaccattatctagctgtgtgacctggggcatgacttaacctttgctcttcagtctgaacagtctttaagaattggtttggaggaggaaggaagggatagacaagatccaaggcctttgaactcttttttggaaatgggtccttttcttcaaacaaaatttgatgcagagtcccaaatttacctacagaataaaatactgctgttcttgtttgaaaggaagtggggtgcttggagccacatgctcaggcccactttgccccctctcaggaaccctcgaaaaaacttataggacttataggactgttggggatctgccaagtctctcttatgttacatttcagtccttgtgaaactctatatgtttcatcagttcactttttcagaaagttcacctgcttggggtaaaggtcatgaagtggagaatgtggggctcagtaactagcaatagtaaaaaacatcattgattggcttgcagaatttactctgttctaagcatcttacacacatactcatccgaaaactcacaacaaccttgtgaggtagatctgttattatcttaagattctgaaacctgccagcatgactctcaatctttgacttgagaccagttgcccaacatggaaggttatacttttcacagtttaccaccataagcagtctttcagagtgatttctagctagagatccattcttagaaaaagtcagaacctgcccattagcatacactgtcacatggtgcagagtaccttcactgggttcatctcatttcctcctaaaaatagtcctatgcagtagtccagtcatatcatcaccattatatagatgagaaaaactgaggtgtaggagaaatcaagagatctgttcaaggtcacacattccataagactctgaataccaccatcaagaataataaaccttttatgtgaaaagcattttagaacttcagtgtcattattgcattctgcctcctggagttcagtgcactttttcaccatgctttaatcttggagtcctggtggtacagaatctgccttctactctcagacaacaccacagtgtctttatccctcataacaaacttatgaattaagtaatgatattatccccattttacaaattagttaactgagataccaagaggctaagtcttgcccaaagtcacacagctagtcagtgatagagccggagttacaaatgaggcatcctgactccagaatatttgctcttaactactactctttatacatatgtaaggaaactaaaagcaaaagagggaaagatgtccctgaggccccacagtgagctcccctgactcacaatccagtattcctctgaccttctaatcctaaagttatacagtaaggtcccttgactctaatcctagtagatggaaagatggctggcatgatttaagccagaggccacaaactggcttccccagagccagaattcacctgcagaattctgtttgtccagcacagtgtttgtttagaaaattgacgtagactgcccctaggcagggcatcaatcactgtcattgtccccagccctccttatttatgtttgccaggcttttttactcatttatgtgtctgcctgacttgtgaaggtatttgagtttatgacttttagatttaagcattgcaatatataagcactgcacacatgcattcacaaaagtatagcctagtctagcttcacaaagaatttgtagccctacaccaaacacacctttatgtttacttagtgtttagaattagatttaagatcagaatttagtttcacaggcattcatgtgtggaagaacctcagttattgttttttgtttcatactgtctcacccttgctttccctgctgtgtctggacccctgtcaatcctgctttctgccattcttcatgcctgagttagggcccctgcaagccattcactggttaatctttaggaatgaatggagagtgaaaaccagtttggagggttcactgtgtcccaagcatcctctcatttagttctcataagtgtcctaagagacaggtagcagcacattcgttttataaatgaggaaactaaatctcagagaagctgaacaaagacctcaaagtcattaaggtagtaattaacggagccgggatttgaacgcaagactgttggactccagagcctattcttttgccctacaccacagttccttacaaggaagatgtattcattttctattactgcataacacattgccacaaatttagcagcttcaaacatttatcagctcactgttttgtaagtcagaagtctggcacagcatggctagattctcagttcagggtctctgaaggatgaaactgatgtgtttaccaggatgcattctaatctgaagctcagggttctcttccaagctcatgtaattattgcaggattcagttatttgtggttgtaggactaaggctccctcttcctttctggctaccagccaagggccattctcagctcttggaggctgccctctttccttatcatgtggaccccaacgccttcaaagccaacaacagagactcttccttgtgttgaatgtttctcactctacggatgtctttcctggaggatcccagtcccgtaagggctcacctgatgaggtcaggtacatcaagaatagccacccttcaaattcaactgaattagcaccttcattacatctacctagcctttttacaacagcatctaggttagtgcttgactgaatgactggaaactaaggtctcagaatctcggggaccgtcttagaagtcagcctactacagatgttgattcttttcatgtgtcaaatttcatagtgagatagggagaacagaaacatcacatccttgaccttaggtaaagggattcaaacttcctaagactttggaaacttcacgccactttcaccttttccttaatcatggttgagaaggcctatatcttggagtggccaggagtgagactggaacagtacctaaaggttaaggacgctaaagaagttacagattggttacatctgctcctccctaggaatgatccatggaacctgatttgaaatttttttctctggtgctatagatagctcccacaggggtctaatgccccagggctgaaaagttagttccccataggatccatccaggcatgatatcaggccaggtgttacaatctcctaaagaggaggtatggactggaaagccccttgccaatggccctttcttgtcactgctctgacccaagactaacagggcagagatagtgaactcacatactattaaaactatccacttatacttccccctttctctttgctttatcactccatttaagtaaaccaatgagtctctgccttgacacagtggcaagctgacctgtatcttatatgaaagaattagatttgactctggggctcaggtgcagagggcaggaggggcataaggatggccttcatggaagaaaagaagtccttggatactgagtaacagctgagactagcaagcctcattgtccaggattccaagtcgtctagcaacatcctggtctctgctgcagacagaacagaggatcccccggcagaatgaatggagtctgatttcaattacgttcagtatagtcactctctttaggcagagaagccagaacacctggtgcagctagggccactgtggtcacagggacaagcacactacctgggtcctggaggcaagtgggaatgcagtttttcttccttaagcagatgccatataggcctggggaggaggatgtgagaataccagccaagttctcattggcactatacagagaaaggggaattatttcatcttgatggattctccccacagtctctgcacatattgatcttacttgtaatgagtttgcttaggttcacgagtcatcatcccagggagatctgagtcattggtgggaaagtcgaggcgacagattatatctcactgatctcactgtcaccaattgctctgtgtgtccctccaccttttgaaaaagtccatggattcatttgtgtgtaattcatttggatttatttcttctttatcaatagctttagtggggtattgcaaatgggaaagttgccccagagaacagtgtacattcacagcattattcagtagaactttctgagatgatgaaaatcttctatatcttatgttgtacaatataatacagccactaactacatgtagcttttgaacactggaaatgtggcaggtgagactgagggattatatttttaattttttaatgttgtaattaatttaattttttaaaatttttgctttctattttatagtttaataattaaactaaacttacgtagcccacatgtggctagttggctactatactggacagtacaagtctagaaggatctcagagagacacatgctgagatacagcaggaataagtcaaaaagagagccaatgtaacatagggaattctggattgggaattagagccctggctctaatctcagctctgccactaggtgaccttgccctctctggcttcagcctccccatctttgacttgaaaggttaaactaactaacgtcgaaagtcccaaaatggtggctatggactgaattcaattttgggatacacaagtttcaggaattttttaaaaatctattaatgccttctaggtgtgtgtatgcacgcttgcagacatgtgcccatgcacaagcatgggaaggcagtaaggcattcatttcaattcaccagtgtactaaccattcacacacacacacacacacacacacacacacacacatgcacacacaccctactgtattgcctatgtagagcctgaagatcttttaatctgtcaccattggataagataatttctaaggacccttcctgttttgtcatgctgaaaatctttaagccactatagtgtcccaaatctattccagtttgggcagatgactggagtattctcatagcctcctgtctattcccttctggatttgatactagttatgaagtttggagtcaagggtgaagaagggaggcagggatgatataaccccagccccactcctcaactctgcttttgagttagaagtagggttcagggcttcagattccttggggaggcagtagagagaatatgggctttataatcagaagatgaggttcagatgattgggttctcaccttttttatagctgtgttacctcagtttattcatttgtaaaatagggataagaaatatctttaacctcctaagatcatgtggaattaagtgatgtaatgtgatgaagcgaggcacgcagaaggccctgaaaaaattagtagttacccttaaggggactaaatggtctggcaactcccgagctcaaagctagaaaggtccagtaatggggaagatggggtctttctgtaggaactgtagcaggggagcagatcctgtaggccaccagtctgtggagctgtgtccaagaactcatgtttgcaataagcccaccaaatgacaagttattgtggggttcaggcctctaactcaagaagatggtcttggcccagatcataccttgcagcctgtgcctttggtgggatgtgggtgttggcagtggctatgcatatctccttattactggctgtgccaaagccccgcagaaatgattgttggacaaagtcatcttgcactcagggctggttttccaggcttccttgttattttcccctgagttcttctgtgttcctcttgcaacaccaaccccactattttcctcttccctaccctagttgttggtccaaacatgtaatccattcttgcagtgatttattgggtgacaccatgactggagtttgcattgaaggacttctttttctaattagaactaaaagtcagttccaggctgggtgtggtggctcacgcctataatcccagcactttgggaggccgagatgggaggattgcttaaggccaggagtttgagtccagcctggacaacatagtgagatcccatctctacaaaaaatgttaaccaggagtggtagtgtacaactctggtcccagctacttgggagactgaggagggagaattgcttgagcccaggaagttgaggctacagtgagctttgatcgtgccactgctctccagctgggtgacagaggaagatcctccttcaaaaaataaataaaaactaaaaaaaaagtcagttccaggttgtatcttttttcacaggggccagacacagatgagagcaggttttgttgtatttatccatttaaattgagcaataaaattctctctttggtttctacctttcttatttattattattatgttaaagggattaaagtggttcatggtctttctcagtgcaactgcttatgctagacctcagaattatgaccttttcaattatttatatttctgtctatataaatactggaaaaaatagtacaaagtaagcatcggaatgcctaaggacctctaaattgtgtgtgtgagcacatggggaagatggttcttaaggtttgagttttggattattgtggttgtcttaaataatgttatttctatcattctttccaatgactgtctcctagcatagttcccattttacagactgatggcagaggcagaaagattctctcacttctttgatactattgaggacttcagcctttcaccgctcttctcccctttgctaaaaaagaaaaaaatcaatatgtatgttacagtgcatttttttaaatattttttattatactttaagttctagggtacgtgtgcacaacttgcaggtttgttacatatgtatacatgtgccaagttggtgtgctgcacccattaactccttatttacattaagtatatctcctaatgctatccctccacccttccccaaccccacaacaggccccagtgtgtgatgttccccttcctgtgtccaggtgttctcattgttcaattcccacctgtgagtgagaacatgcagtgtttggctttttgtccttgagatagtttgctgagaatgatggtttccagcttcatccatgtccctacaaaggacatgaactcatcattttttatggctgcatagtattccatggtgtatatatgccacattttcttaatccagtctatcattgatggacatttgggttggttccaaggctttgctattgtgaatagtgccacaataaacatatgtgtgcatgtacctttagagcagcatgacatataatcctttgggtatatacccaataatgggatggctgggtgcaatggtatttctagttctagatccctgaggaatcaccacactgacttccacaatggttgaactagtttacagtcccaccaacagtgtaaaagtgttcctatttctccacatcctttccagcacctgttgtttcctgactttttaatgatcgccattctaactggtgtgagatggtatctcattgtggttttgatttgcatttctctgatggccagtgatgatgagcattttttcatgtgtctgttggctgcataaatgtctttttttgagaagtatctgttaatatcctctgcccactttttgatggggttgtttgtttttttcttgtaaatttgtttgagttctttgtagattctgggtatttgccctttgtcagatgagtagatggaaaaaattttctcccattctgtaggttgcctgttcactctgatggtagtttcttttgctgtgtagaagctctttagtttaattagatcccatttgtcaattttggcttttgttgccattgcttttggtgttttagacatgaagtccttgccggtgcctatgtcatgaatggtattgcctaggttttcttctagggttttatggttttaggtctaacatttaagtcttgaatccatcttgaattaatttttctataaggtgtaaggaagggatccagtttcagctttctacatatggctaaccagttttcacagcaccatttgttaaatagggaatcttttcccaatttcttgtttttgtcaggtttgtcaaagatcagatggttgtagatacgcagcattatttctgagggctctgttctgttccattgatctatatctctgttttggtaccagtatcatgctgttttggttactgtagccttgtagtatagtttgaagtcaggtagcgtgatacctccagctttgttcttttggcttaggattgtcttggcaatgcaggctcttttttggttccatatgaactttaaagtagttttctccaattctgtggagaaagtcattgatagcttgatggggatggcattgaatctatgaattaccttgggcagtatggccattttcacgatattgattcttcctacccatgagcatggaatgttcttccatttctttgtatcctcttttatttcattgagcagtggtttgtagttctccttgaagaggtccttcacgtcccttgtaagttggattcctaggtattttattctcttagaagcagttgtgaatgggagttcactcatgatttggcttctgtttgtgtgttattggtgtataagaatgcttgtgatttttgcacattgattttgtatcctgagactttgctgaagttgcttatcagcttaaggagattttgggctgagacaatggggttttctagatatacaatcatgtcatcggcaaacagggacaatttgacttcctcttttcctaattgaataccctttatttctttctgctgcctgattgtcctagccagaacttccaacactatgttgaataggaatggtgagagagggcatccctgtcttgtgccagttttcaaagggagtgcttccagtttttgcctattcagtatgatattggctgtgggtttgtcataaatagctcttattattttgagatacgtcccatcaatacctaatttattgagagtttttagcatgaagggctgttgaattttgtcaaaggccttttctgcatctattgagataatcatgtggtttttgtctttggttctgtttgtatgctcaattacatttattgatttgcatatgtggaaccagtcttgcatcccagggatgaagcccacttgatcatggtggataagctttttgatgtgctgctggattcagtttgccagtattgtattgaggttttttgcatcgatattcatcagggatattggtgtaaaattctctttttttgttgtgtctctgccaggctttggtatcaggatgatgctggcctcataaaatgagttagggaggattccctctttttctagtgattggaatggtttcagaaggaatggtaccagctcctccttgtacctctggtagaattcagctgtgaaatccatctagtcctggactttttttggctggtaagctattaattattgcctcaatttcagaacctgttattggtctattaagagattcaacttcctcctagtttagtcttgggagggtgtatgtgtcgaggaatttatccatttcttctagattttctagtttatttgcatagaggtatttatagtattctctgatggtagtttgtatttctgtgggatcggtggtgatctcccctttatcattttttattgcatctatttgatttttctctcttttcttctttattagtcttgccagcagtctatcaattttgttgatcttttcaaaaaaccagctcctggattcattgattttttgaagggtttcccatgtctctatctccttcagttcttctctgatcttggttatttcttgccttctgctagcttttgaatgtgtttgctcttccttctctagttcttttaattgtgatgttagggtgtcaattttagatctttcctgctttctcttgtgggaatttggtgctataaatttccctctacacactactttaaatgtgtcccagagattctggtatgttgtgtctttgttctcattggtttcaaggaacatctttatttctgccttcatttcattatgtacccagtagtcattcaggagcaggttgttcagtttccatgtagtagagtggttttgagtgagtttcttaatcctgagttccagtttgattgcactgtggtctgagagacagtttgttataatttctgttcttttacatttgctgaggagtgttttacttccaactcagtggtcaattttggaataggtgtggtgtggtgctgagaagaatgtatattctgttgatttggggtggagagttctgtataagtctattaggtccacttggtacagagctgagttcaattcctggatatcctttgtgtcttgttgatctgtctaatgttgacagtggggtgttaaagtctcccttgattattgtgtgggagtctaagtctctttgtaggtctctaagtaatcactttatgaatctggttgttcctgtattggtgcatatatatttaggatagttagttcttcttgttgaactgatccctttaccattatgtaatggccttctttgtctcttttgatctttgttggtttaaagtctgttttatcagagactagcattgcaatccctgcctcttttggttttccatttgcttggtagatcttcctccatccctttgttttgagcctatatgtgtctctgcacatgagatgggtttcctgaatacagcacactgatgggtcttgactctttatccaatttgccagtctgtgtcttttaattggagcatttaggttaatatttacgtttaaggttaatattgttatatgtgaatttgatcctgtcattgtgatgttagctggttcttttgctcgttggttgatgcagtttcttcctagcctcgatggtctttacaatttggcatgtttttgcagtggctggtaccggttgttcctttccatgtttagtgcttccttcaggagctcctgtagtgcaggcctggtggtgacaaaatctctcagcatttgcttgtttttaaagtattttatttctccttcacttatgaagcttagtttggctggatatgaaattctgggttgaaaattcttttctttaagaatgatgaatattggcccccactctcttctggcttgtagagtttctgccaagaaatccactgttagtctgatggcttccctttgtgggtaacccgacctttctctctggctgcccttaacattgtatccttcatttcaactttggcgaatctgataattatgtgtcttggagttgctcttctcgaggagtatctttgtggcgttctctgtatttcctgaatgtgaatgttggcctgtcttgctaggttgggtaagttctcctggggaatatcctgcagagtgttttccaacttggttccattctccctgtcactttcaggtacaccaatcagatgtagatttggtcttttcacatagtcccatatttcttggaggctttgttcgtttctttttactctttttttctctaaacttctcttctcgcttcatttcattcatttgatcttcaatcactgatacccttttttccagttgatcgaatcagctactgaagcttgtgcattcgtcatatagttctcgtgccatggttttcagctccatcaggtcatttaaggccgtctctacattgattattctagttagccattcgtctaatcttttttcaaggtttttaacttctttgcgatgggttcaaacttcctcctttagcttggagaaatttggtcatctgaagccttctctcaactcatcaaagtcattctccgtccaggtttgttctgttgctggtgaggagctgtgttcctttggaggagaagaggggctctgatttttagaatgtttcagtttttctgctctgttttttccccatctttgtggttttatctacctttggtctttgatgatggtgacatacagatgggattttggtgtggatgtcctttctgtttgttagttttccttctaacagtcaggaccctcagctgcaggtctgttggagtttgctggaggtccactctagaccctgtttgcctgggtgtcggcagcagaggctcagaacagcgaatattgctgaacagcaaatgttgctgcctactcattcttctggaagtttcgtctcagaggggtacctagccatgtgaggtatcagtctgcccctactggtgggtgtctcccagttaggctactcgggggtcagggagccacttgaggaggcagtctgtccgttctcagatctccagctgtgtgctgggagaaccactactctcttcaaagctgtcagacagggacatttaagtctgcagaggtttctgctgccttttgttcggctatgccctgcccccagaggtggagtctacagaggcatgcaggcctccttgagttgcggtaggctccacccagttcgagcttcccagctgctttgtttacctactcaagcctcagcaatggcgggtgcccctcccccagcctcactgctgccttgcagttcgatttcagactgctctgctagcagtgagcgatgctccatgggcgtgggaccctccgagccaggtgtgggatataatctcctggtgtgccgtttgctaagaccattggaaaagtgcagtattagggtgggagtgacccaattttccaggtgccatctgtcacagctttgcttggctaggaaagggaatttcctgaccctttgcacttcccgggtgaggcgatgcctctccctgctttggctcacacttggtgcactgcacccactgtcctgtacccactgtccaacaagccccagtgagatgaacccggtacctcagtcggaaatgcagaaatcactcatcttctgcgtcactcacgctgggagctgtagactggagctgttcctattcggccatcttatgaatcatgcatgttcaactatgagcaactatgtgtattcaatgggaaatggaataccataaaattgtcatatgttgagcccaaaatgataggatagaatttgatagtctgaggatggaaaggaccttcaaggccacttttaaaaaccccattcccatatgatgcttgaattcttaaccactgtgtgtctagtattttctcatttccagtgatatgtgtgcctgccaacctttccgtctccaagagctttaactatcaaaatgtatgtgtgtgtgtttttgtgtgtgcatgtgtgtgtgagtgtgcgtgtgtgtgtgtgtgtgtttagagagagagagagagacagaaagagaaggagagactaaaatccaattcactgttctttctgggacccaaagaacaagtctagtcattctccatttctagtctctttccctagcaatcggctagacatgctagacatagacacatgtacatcactcctttgaattacaacattcagtatttgtctatcacttatatgataaaatacaaacttagcttttatttttatttttttagagacagtgttttactatgtcacccaggctagagcatcagtggcacaatcatagcccactgcagcctggaacccctgggctcaaggaatccttccacctctgcctcctgagtagcagagactacagatgtgcaccaccagacccagctaatttggttttttactattttttgtggagatggtgtattgtcttgtggtgttgctcaggctgatcttgagctcctggcctcaagcactcctcccatctcagcctcccaaaatgctgggattacaggcatgaaccaccttacccagccaaatttcttaatatgatatacatgctcctttaaaatcaagcaccatctttgctttcaacctcattattaaccactttcccatatatgcaacatatgtttcagccatactagtgtctagtttttccctgaacactccttggtgcttttgtttatgccctttctgcccacctttgcctggtgaaatcctcatcaatcttcaaattctatcaaatactatcttccatataaagcattttctaaacccacctatgtaaaaagattagtgttttcctattttgttgatgcctccattgcagcattttccagtccaacgttttctagaattgattgtggccaggctaccagactgggccagggcctgtgtcttttctgtcacccagaagcaaaggtctaacaatggatatctgctgaatgaatgaacgaaaatgaatcattaatatattagtaaatacgttaattaaagttccaggtatgaatactgaaggctgcattcaggcagagctggatccaaggatatgctaggttggtctagcacaagaatcagagttttcctctgcaagctatgaaaaatttgggtttagcaggtatttgggatgatgaattatacatttaaccagtgttgaatgagcacttgtccttaaggagtttagagtctgtgaccagggagaatggtgattttcttagctagggcagtttttctaaaaaggtagttgcattgtgtgtttttgaccactgatgataaattcaagtctctcttccttcccaatagcccggaagctgaagaaacttggtaatctgaaactacaggaggaaggagaggcttccagcaccaccagccccactgaggagacaacccagaagctgacagtgtcacacattgaaggctatgaatgtcagcccatctttctgaatgtcctggaagccattgagccaggtgtagtgtgtgctggacacgacaacaaccagcccgactcctttgcagccttgctctctagcctcaatgaactgggagagagacagcttgtacacgtggtcaagtgggccaaggccttgcctggtaaggaaaagggaagtgggagcatgagataagggggatcatatttagtgaacgctcctatggaccagccaccatgtctggtgcttttctgcccattaactcaggcagtcttcatcataaccctgtgggagagggattgttacaagtctcaatttaaacatacagggatcgaaactcagaaagcaaagagaaagatagtattatcgggtgtcttatgtggcccacattgatgcacagcagtcatgctttcatattcaactcacaaaaatggtcagcaaattttccattaatcacaaatcacatagacatacccatatatgccttaggatgctcttctatatttgcacacacaggctcaccccaaagataatctctagtttgactgacattctgtcttcaatgtcatctttaggagctatatcatgggaactctcataatatggtatggtggaaagaacatgaggttgggaatcagaacacttcgggtctgctcttagctctgctagtaacttattgtgtgatcccttccccttctgggtctcaatttctctatctgtataatgtataaagcgtggtttgtatcaaattgatggtttccagtttttgaaaaaaggaacgctttttgcaccttaaactacctaaggaatcataatgagaggaaagattaggtaatagtgaaagaattaccaagtgttggtctaacagaagttggataacagaagttcctcagtgatggggaactcacttctttcttatgtcatctgttgtttaaacaagtctggttattaaaatattacagcttaaggaattcttagagatcctctatccaatgattcacaaactttcctttagcagccaagtgctttatttctcaaaagaattgtacacagatacaagtggagctagtttatttaaagccagagcctgtagcttgggcctcaccagttcagcctctttctctctatcccagggaagccctaggtcactcttgcaaaatcttagggctccaaggaacacagtttgaaaaccagtgaagtatatgccctttaaaggttctcctaatcctgcaattatgattcaaagattcttttgaaataacaacaaccaaaccttctcttgtggagtcaaagattaacctgcctttcaataataactgccattcaggtagaaatttatagtgaacagagcaattttgtatgtattacctgaattgattcttataggaatcctataacatgagattctttctcttattttacagaccaaatagggaagctgtgagaatgatgtgattggcctatagttacatagtcagaaaatagcaggaccagaacttgagcccaggttctctcctgattccaaattctctctattccactccacctgtaggctgtagcaccactgcagttctgtagctctgggctttacagtgaggggccaaggcttcattgaaggccacttgggtcatagtatgggcttgttgcatttgaagacatttcatgttggctgtcaagtcttagatttgtatttccaactcacagggcctggtcacagccctaaccatctcttataccttctcagcttgggaagctgaggtcgactagccaataagaacactgggaaggaaacccaaggactctgactggatatgctctgtgccaaaacagagggttcactcagagaggaaaaatataaaaaagaaaaaggagaaggttgctttaattcttatcactttttcatctggatattttgatatcatgtgtttgacagagattcaaagtttaatcttcccaagcagtttccaaacacttatctcattttataggctacagagctttttcatatatatgatcccacttaatctttacaacaattctatgaatcatagagactattatttccatttcacatgccaaggctcaaagaggttaactaacttgctccatttggtcacttaacacatggaaccagaacttgacctagaccttcgggtttctaaattggttatcttgacaataacctagtgcaaaacactatagcagaatttgtatgacttgggatcactggggctttccttggcccaaccaccaagatggaaagccccctccccttacattaacaaatctgcaagccaatatcagttcaccatctagcttgccagactaaatgatttctgaccccaagtcttttaaaagaatagcttcaaaagaaagccaattaccacattcacaagaactgttcttcatattatctataattacctacaagtacaagtaatttgctaattcaatagattgagttcttgacctgtaagatgaactgtgctaggcccctaataagataaattttgttttaagttttctgtgacagtaaagatgtatgaaaattgcctagtagagtacctggcacattaataaatgataactgttaatttggagtgggtgagtagactgggtgtgcacagtatatttagaatcaaatttatctggtttggaatcctagctatggactagttctgtgaccttgagcaaatcacatgtcttctctgtgcttctgtgtcctcatttgtaagatgatagaataatcactacctttcaaattgttgtcaacaaaaagattatgtataaagagcacctagtaacgtagcctgaaacatagtcaatgctctgtaaatggtggtttattattatgagacttgaatgctaagccactgctttcacgaaactcaattttagctaccacttgccttgcctagaagctcatgcatggaccccaaggtgaaattgtgttctctgaagacctcggctggcagatgtactacagcagcaaagatttccaaactggcctttctttgagcccattctcccagactagacaggagactacaagtttctgctgcacatgaaaaaaatatgatgtcaatcggattctagtgagaaaacagagtctcaaagaaactgcttctgctccctagcgtgtttaatgtgtttcagaacctgagaatgactcctctctgtttctccagaacagcctaacacagtggcaaatgggtgttgagtgaatgcatacttaaggaaatctgtagggttgcagctactctttcctcaagtaatcccttgatagtcatgtaggctacttcagagattgggcattagagaacagagtcaggtattataatcagattagactctagggaggttagccagccatattgctgatatgtgcacagttactgggtttgagtgctaagcagctctcattaaggacggttaattaatattatggccaaattaagctttcccttttctctcctctttgttagttcggtggcattttagggagaaaaaaataagcatcagtatggacaatttgcttgatacctgtacaatttaattctcatccttccatgtgccttcacattcacacattccaccagaagaccaaggttcaccagccaaaagcttttcttgctccccactgcctcctacccaagatattcagggtcaacctcccaggcctcttctctaagagatccttggttgctacatgcttagaccctgcttcttatttcctgctgagaagggtcagtccaaggcattctgtgctacagaagggttccaagcaggaactactctgggatctgaggctccagccggtctgtcagcgtgtcattacagtgaaggtgggaagcacaggcctgggagctaagactgctaagatgagggactctagaatccctgatacctggaaggcctaggatctaaaagaaaagaacagggaaatggggctatatgagtggacagggaccaaccaagcagaacaatgtgtctggataatgtagacttcagacctgatcctatggctgacaaaagctggtgaccttggtagttcctgagctgtaaccttcattagtggagtagaaaaaacactggagaagagaatcagaacacctgggttctagtattagttcagccacatataaaccatatgaccttgggtaagtcagtttatttctctggccctcatgttccttgttggtaaaataagtgccacatcacctaacctctgggattattgtgagagttaaattaggtcatcaacaggaaagtgagaagtttgatctaaatttggggaagcattcctaatgaggtatgatgacaaaatttcagataattctggatttgttggtgagaagagagagtgttggtagggacgagctctgaggtgatgcctttataactttaagcatccaactgtttcaaaaactccaggagaacatggccatgtctgttctacctgtgtattattgtagacgtagcttctgggagcctctgctctctgagcttaagggaggtaatttggagatcatttaattctcattttacaaaaggaaaaaaaattgagggtctttaggccatttgtttaggtaatatttcttaagtgcccactcaaatacgtggactgtactaagtactagggaggtaaagataaataagaagatatggtccctgtcttcaagaagctccaagtcttgtgggggagacagacatgtatatacatagacttcaatgctgtgtaatgactgctataattgggtgaggctacacaaggtgcaatgagaatgtaaaagaagaatctttaagccttcttcttggatgagttgggaaagccttcacagaagaggtagcctttgagtgaagacttgaaagatgagtagtgtttaccggatgaaaggcctgagaaggaggaatgcattctaggcaaaagtaactgcctgtgcagagataacagagatatagaggcatgtgagagcgcaagtggcaagagatcagtctaggtaggcaggtcataaagggcctattcatgtataatgatggcagtaagatgaggatggcagtagggtgggaaattagtagggccagggtacctattgagtagaaaagaatggagaggaaatgccaggcagaaagaggatggacgcaagagagggaacatgaaagtggtgaacaggtggcagtggctgtcaagacatctctccataccctgtacactgtatgtaatatccatctcccagggttgttagaagggtcaaaccagatcgtagctggaaaacagctttgtgaagtgaaaactgctgtttatgtgggggaaatgattgttaaactgcatctttggaaaggtgaagtgatcaagagcacagaccttggaatctgactgctttgctttgtaacttggtctgccaattactagctgtatgatcttggacaagttccttaacctctctctgactcacttgtactggttcacagaatggagataataatagtacttaccttactcattgttgtgaatgttaaatgagataatataagtaaagtgcttagaaaagagttaaatgtaccccataaatacatacaactatcatgtacccaaaattatttttaatttttttaaaaaagagcaatccaatagcaaaagaaaaaaagagttcactcatataagcagtcaataagtgttagattatttttctcttacaactgacaatgccctttttgtctccatcatcatctcatttgagcagctcagggaagtagggaggataaggaatattatcctcaccatatagtttgtgcttttccccaccaccccttaatggccagcctggatggtccctggggatccttaggggatgcccgaataccagagcatctctgcccaacagggactcagacttagctcaacccgtcagtacccagactgaccactgcctctgcctcttcttctccaggcttccgcaacttacacgtggacgaccagatggctgtcattcagtactcctggatggggctcatggtgtttgccatgggctggcgatccttcaccaatgtcaactccaggatgctctacttcgcccctgatctggttttcaatgagtaagtgctcctggggcccagacctcactaaaatacagcagcttggccagacctggttggtggtgatggtgatggggtgacagtgaagcttagctcatttgatctgcagttgtcgcagcggatgccccagccagccaatccagtatgaggcggctttgccctggctttcagccaactggcaggagcccaggaggatggtgctgagaccacccctttcacacccaagaaccaatcctagtcatatttctggtctgctttgcagcttatctcaaaaccacatggaaagattcctccccttcacatataaaagaggcagaaagactctggctttaagggctggagtttcttgggttcttttgctaccaccaaaggctacttctagtcaccatttgctgagcaactagtttgtgccaagactatgctagatactttctaaatcctagctcattgagtcctcatggtgacctgacctcacctttttatagataacactatttttttatggatggggaaaatcaggctcagcaaaataaagtgactcacccaaagtcacagagctagtgcctgttggagacaagattcaaacgtatgtccctgtcgatctcagctcttctgcgtcatggtggtaactgatgggaaggagtacctctaccgctctctggctgtgtgaccttggtactgccattttccttcccttaaacagctttaattaatacctgccctgccaccagctccatataacatcatgaatttggccagtggctcagattttggaattacatttttctccactaaaatctcagttctactattttcttagtcagcatctttgggaaagacctttaacttttccgaccctcaatttcttcatccattaatgataacagaaccttcataagtaatttcttatgataactaaatgggaattgacagatgtggaatgtctggcccatagtaggcaagaaggaaaaaaaaagtccctttctgattcaccctttccctaatagtgatacattttttttccccgagatggggttttgctctgccacccaggctggagggcagtggcgcaatgatctcagcccagtgcaacctccacctccctggttcaagcaattctcctgcctcagcttcccgagtagctgggattatagatgcccgccaccgtgtccatctaatttttgtatttttggtagagacgggatttcaccatgttagccaggctggtctcaaactcctgacctcatgatctgcccgcctcagccgggcatgataatcttttctatgtctgctgtatgaggtccctcgatggcattgtgaatggagctggccagagaaatcttcccaaggaccttgagctagtctcaccacagagaatccttccagtcaggacaggaattgaccttcccccctcttcagccctctaacccagaagagtcttaaaataaaatctacaggccaatggttccttccagtacagcactgcaatgcgagggagagtgagcgtccccagctgccctctcccaaccctgccagcctggtagccaaaagctaagaataaccactaggcttttggcacaaactgctttgtggttttcagatctccgcaaagttgcctatgatgccatcttctggggcaggccttgaaaagccccctaactgttcatctcccatccttaaacccctgctgcccttaagcagttgaatcaactccatgagcacctgctctaccttccccagagccctgagacctttggagctttgaaaagtgataattggttgttctctaaatcctcatttccttctctgcctctaagtaagcatgtggcatcccacctcggcttcctggtccagtcttgttcatcttataaaaaggcctccctacggggtcagaggcctagacccatcaaacccagggctcctgaaacaataggacccctattcctcctgtaggaagccactgtgttagagctctcagggtgtctacaaacatctagataagtgtttctcaacatggattctgttgacatattgggaaaaataattttgtcattatgtagaatatggttaacatacctggcaccagcctactctataccaaataggattccagtcattctgacagcccaaactgctcccacacatttctgacacccactgaagaggcagtactctccagttgagtgcaactaatccctgccagccttcctaaggtgctaatggggagcctcagacccaaagagagagagaagaacttgtccaatgtaggtcaacccatttgctgatctcttcaacaccaagctctattatcagccctgtttttttctttctttctctctttgtagagatcacatgttgtgaggataatgagcttgaaccttagctgtgtgaccttgggcaaattactgaacttctatgtgccgcaaattttatctggagactgctgaagagtattataatagcacctttctatatgtcatttattgaacacctgctatgtgtcaggcactgtgctcagtgttttccaatcttcatttctcctcttattttctctcttgcactcccaccaaccttgttctcttcctaaattccattcctgcctcatttttctaccctccattctcctctctcttccttcctttaactgtctccctagtatttttccccttttccccctttcttttccccttcccccatgaatttcttctctttcctttccccttctctttcctccattccccactttttctgcccctgaggcctgcagcaatgttaaaggaatcctcattccagcattgtgatttcaatggtaaaaagattgcagcattgtcatcaacagaggtgggaaagtacattggagactggagcagagccagacctcagggtcagccaatcttactaaaaaattctctacagtgaaagagcttggagcaacactgttctgctcaattgatttgtgataccatctaaacacttcctctttctagttgggcttcagcctgagttgaataattctacaccatctgccctcttctctctttctccaggacagccaagatctctctgagataggatgctgagcttccacccagacaataccaggcctgctcatcctatggagtaggctagtggcttggaaaccaaaatgtcaaaccatagcctttaggctccatctgggaggtctttgtcctcaccacttaagtgggtgtcaaatttccttccctttctgcacacgctgcacaatcaatttctgtcttacacacacacacacacacacacacacacacgatttttgaagtgctgaaaactggaaggcctactagcatgaggatgctgtgtcttctcttagaggtatgccatggtcagccatggaaccgagaggttgctcttccttgaaaagctggccaagcattggccacttccccatataatttataggtgataatgtggtgatctgttcagaagtgactataataaatgcaactcacatatgtctacagtttccaaactgtggtaaggagcagccagcatatgagggaatgggctccccttcagcaggggacatttaaactagacattcaaaaacactccctggcagatttaacattggaactcgttttgaaagaacaatgtggaatctccttcactgggagtttttgaataagtatgaaatttctagtattccaggccagaggcaaaggggtcaacaggatgaccaaacacttcgggtcatttgcaaatcttgatgtcctgatgttaagagctgactactggggcttctcctaaaaatccttcatgttgagctgcctggaaggcaggttctcattctggctgtagctgagatgttagaactgtagtcagggagaccatgtgcctcccccattgtgttcatttggttaggctttcctgtccctgactcagaaaacagaaggggcacagagacctggaaattccatgtgctaacccatatcctggccagagaagatgagtagttatcagggtgtcaggattttggaaaacagagagagaaaaaaaacaaacaaacagacaaacaaacaaaaaaaccttttcctggtccctggagcaccagcaggagaaacagcaagctcttcttggaaaacctggcgagggatggcaatcagagacattccctctgggcttattgtaaacttcccctcattcctttttcctctgtgtatctccttcccaggtaccgcatgcacaagtcccggatgtacagccagtgtgtccgaatgaggcacctctctcaagagtttggatggctccaaatcaccccccaggaattcctgtgcatgaaagcactgctactcttcagcattagtaagtgcctagaagtgcagggaatgccccctgagggcacagagattcagagaggaccacttttgccattaaaacattattagggaaaagccagctcctggacatttcccttcttcattccccctccccatccccactctactctctctcagcatcattttcctaacaagaaacaatttcatgactagaagccaatttatttgctagaagtcaacctccatcagattccccacctatccccagtctgtctttgggacaaggcctttttgactggttacagcaggtctctgaatttttccatagcttctgctatagaaacagacatgggccaccttgtattctttgcagggcagtagagcaggaggcatttcctcctggaaagatttcctcttctgccaacaggaggagatctatgtaagcaactcagataggatttgtatggcagccaaggaacttttctttaatatcttttctaagagccctctcttagcccctacggagggagaagggcaaaatttgatattcaaagctatgtgttttggttatctaaatcagggttttactgtgaatgacataaaagcttaggtcctaaaaaatgagtatctgagaagagtagaaaaagaaaaggttcaggaaatttgatttacttgactcctttcagatcggatccagctatcctttcccctgagatctccctgacagactgaaggccccaagcacacagacttcaactaacaggaagccaagtagatggttccctgtgggggtgggggtcaagtctgtggtcagaaaacttggtgctttgtctaatgctccttcgtgggcatgcttcccctccccattctgtcttcatcccacatcagttccagtggatgggctgaaaaatcaaaaattctttgatgaacttcgaatgaactacatcaaggaactcgatcgtatcattgcatgcaaaagaaaaaatcccacatcctgctcaagacgcttctaccagctcaccaagctcctggactccgtgcagcctgtaagcaaacgatggagggtgctttatcagggagaacagcctgatagagccaatgataatatgcttctctagagtctggcaccacctgttgggaggtgcttccattcccctctggctttgagtgtggtccaggaagaaaatgtggtgaagaaaagaacacgggtcacagtgtcccagctggatattgtgaaaggggtggaggagttgagaacagagcagttgggactcagggaagggacttgcagcagatgaattctctaggcagacaaaacagacctggatgtttttcccctcttctttgagtcatgttcatgtgagtttgtctgtctgtgtgtgtgtgtgtgtgtgtgtgtgtgtgtgtgtgtgtgtcagagagagagagagagagagagagatggagtgcggaggcttgggtgagagcacaagctggagaagtcttgagtcagagagcttacaatggtataagacatctcttgggagccctcagtgactccatggagaccatttctttctctctctctcgctgtctctctctaacacacacacacacacacacgacctcatgggggaggaccaaggaagtacggggaagggggaggaaacaaaaggctgaaagaccaaaaatcagaggttggggaagaggctagcagaggccacctccttgtcaaccctgtttttctccctcttattgttccctacagattgcgagagagctgcatcagttcacttttgacctgctaatcaagtcacacatggtgagcgtggactttccggaaatgatggcagagatcatctctgtgcaagtgcccaagatcctttctgggaaagtcaagcccatctatttccacacccagtgaagcattggaaaccctatttccccaccccagctcatgccccctttcagatgtcttctgcctgttataactctgcactactcctctgcagtgccttggggaatttcctctattgatgtacagtctgtcatgaacatgttcctgaattctatttgctgggctttttttttctctttctctcctttctttttcttcttccctccctatctaaccctcccatggcaccttcagactttgcttcccattgtggctcctatctgtgttttgaatggtgttgtatgcctttaaatctgtgatgatcctcatatggcccagtgtcaagttgtgcttgtttacagcactactctgtgccagccacacaaacgtttacttatcttatgccacgggaagtttagagagctaagattatctggggaaatcaaaacaaaaacaagcaaac

SEQ ID NO: 4661 - DNA, 151255 bp, human
acactgaatttggaaggtggaggattttgtttttttcttttaagatctgggcatcttttgaatctacccttcaagtattaagagacagactgtgagcctagcagggcagatcttgtccaccgtgtgtcttcttctgcacgagactttgaggctgtcagagcgctttttgcgtggttgctcccgcaagtttccttctctggagcttcccgcaggtgggcagctagctgcagcgactaccgcatcatcacagcctgttgaactcttctgagcaagagaaggggaggcggggtaagggaagtaggtggaagattcagccaagctcaaggatggaagtgcagttagggctgggaagggtctaccctcggccgccgtccaagacctaccgaggagctttccagaatctgttccagagcgtgcgcgaagtgatccagaacccgggccccaggcacccagaggccgcgagcgcagcacctcccggcgccagtttgctgctgctgcagcagcagcagcagcagcagcagcagcagcagcagcagcagcagcagcagcagcagcagcagcagcaagagactagccccaggcagcagcagcagcagcagggtgaggatggttctccccaagcccatcgtagaggccccacaggctacctggtcctggatgaggaacagcaaccttcacagccgcagtcggccctggagtgccaccccgagagaggttgcgtcccagagcctggagccgccgtggccgccagcaaggggctgccgcagcagctgccagcacctccggacgaggatgactcagctgccccatccacgttgtccctgctgggccccactttccccggcttaagcagctgctccgctgaccttaaagacatcctgagcgaggccagcaccatgcaactccttcagcaacagcagcaggaagcagtatccgaaggcagcagcagcgggagagcgagggaggcctcgggggctcccacttcctccaaggacaattacttagggggcacttcgaccatttctgacaacgccaaggagttgtgtaaggcagtgtcggtgtccatgggcctgggtgtggaggcgttggagcatctgagtccaggggaacagcttcggggggattgcatgtacgccccacttttgggagttccacccgctgtgcgtcccactccttgtgccccattggccgaatgcaaaggttctctgctagacgacagcgcaggcaagagcactgaagatactgctgagtattcccctttcaagggaggttacaccaaagggctagaaggcgagagcctaggctgctctggcagcgctgcagcagggagctccgggacacttgaactgccgtctaccctgtctctctacaagtccggagcactggacgaggcagctgcgtaccagagtcgcgactactacaactttccactggctctggccggaccgccgccccctccgccgcctccccatccccacgctcgcatcaagctggagaacccgctggactacggcagcgcctgggcggctgcggcggcgcagtgccgctatggggacctggcgagcctgcatggcgcgggtgcagcgggacccggttctgggtcaccctcagccgccgcttcctcatcctggcacactctcttcacagccgaagaaggccagttgtatggaccgtgtggtggtggtgggggtggtggcggcggcggcggcggcggcggcggcggcggcggcggcggcggcggcggcgaggcgggagctgtagccccctacggctacactcggccccctcaggggctggcgggccaggaaagcgacttcaccgcacctgatgtgtggtaccctggcggcatggtgagcagagtgccctatcccagtcccacttgtgtcaaaagcgaaatgggcccctggatggatagctactccggaccttacggggacatgcggtaagtttttccttccagaaatgtcgcctttcggcccagggcagagtcactctgtgttctggggtatctagcggctcctacctgcgcgaacactcagattgcccctgggagagctcagcagggtaaacctagagctctcccgtggactcccggcctgccagaggtttaacctgagctctcctaatttctgctgcgtgccctgggtgctgattcctgccctcccagattcttcaactcccccaaccgccccaaattctcactacctcctggtactcgaggtcccaaacagaaatcctattgcacgggccaccttcagagataaagctcccaagccctccactcttcctttcctcctgtcctcaaagtctgagaacctcaacaggaatttgggcaatttctcctcttcaggtctgttaggatttcactttcagcctgcgcagattagagtcaaaaagaccggcccaatagcttctcagcgggtatcctccagagaggtaaagtgaaattctcggttagggaaagaaagtggtctctgggtgctgaggtctgctgtgtgaaagggtgaacttctttctcctgaagcaactggggacttgctccagggctggaggtcagtagagataatccaaaccgtcatgtttagagtaggcagaggggcaactttcttggtaaagacttcacaggatttgcactcacagtttctcaacgttggttgactatgttgaaagtagttgcttgggtcggttttctcttgtaaagtgtttattttctctgtggattataacagatccacagccccctacttcaggtttgcatcagatctataaagaggagaatattcttttaatgtacaatttaattaggcttgactctgacttacaaaactgttggaaaacatttttttgtaaagcatttcctgctatttcagtgtgctccaaaatctccactggggagggtggagtgaggttttttattatattcctttatttttaggacatgtttgcattttagaatatgtgcagttagctctaacaaattgagtaagaactcttaatgacctatgagccgtaatcttaccccaaagttttaattagcatatgagaaaagtggcaggcaattgcatcgtgcttattaaaaattattcctcaccgcagttgttgagcttcttggagaccatgctgaagattttctcccccagcaaattaagatattagtttatctgctgagggaggacagactgaattggggaattaactcctcaggtaggccaggtgctgatgtccctgtggacttttgtcttattctttgtttctatggctgttttcttttacctgtgacttctccgaaatttctttgttagccttaacatctttgtttggggacttaaatccagcaatttgccttctttcactgatgctttccttcttacaaggtagatagcacagtgttagtaaagaaagaaagaggagggtaggatttcatattatttcgtgggctgttgaagaaacagcttcttaccaggctttacattccattaggtttttaatgtttgacttacaagattttcagagggttcatttgatattgtcaaagtcttttccagttaatttagactcttcatttttgtaatgggtttatgctatgggacaaaaaaagtattcttcattttataagaacaaatttacttggtagggttaattttttttctagggctgtcactagacggtggagcccctcttctactgtaaacttttcttgggggaaaatgtctaaggtgcattttgacctgccatgatactaaacccagacactggaaccttccatcttctgcatgcctcccccacaacttacttacttaacagggaaaaaactgatggttccacatatttgctaaaaaatgtgtgccttcaaagacaaaaccaaaatttttagggaataactatagagagcaaaagttactcccatcaagtagacaacgagcttggtgattttatttcaggtcttaatgaaaaaagcttctttatgaggaaggttatcatatcttggtgcctccttgacagtccgcttaaattaatgacataaactaatgagaatttagcagttcctgcagaaagtacaagtttattttttttttctggtttgtgattgctgcactgaatatgaggagtctagttaaagggacaactggtgttcctgtcttgtgagttgacgaagactttccatttctaggatatagaaaatccttaagccggtttattgaaaattaatcaatttaatcagaatgcaatcaattccaatacaaaagttagtattttctttctttttattgaaaattaatttaatcagaatacaatcaattccaatccaaaagttgatattttcttactttctctttttttccctcattttgtagggatacaatttggtgaaaggcaagagatttcttaagccaaagcaagagtgtcttccctctctgtgttgcatgcattatgtgccatgtttgagctaaaaatctcaaaattgggcaggcttccaatgacctgttgggtccctccctttaccattcatgtgtgtgtttatgtacataattttgtggaggggtttttttaaaccttagtaacatctgcactcactctgtgttcttatacatttacagtgtttctgctgagaggagggaagatgcaaaggtggtctcttttacttaatttagcatgtggtttgaacagaaggaaaaataaaaagtgatggggcttgtgtgcaaccctgatgatattttatggagctgtctgtcttctctctgagatcaaacaggactacaactttgttaattgaccactggctcccttggcaaaagtagggcttcttatattccagcaagcagcacaataatatgacaaaaatttattcttgggagttgggttctaagagagtgcatgccagaattagagtttggggtttagagaaattatccagatgccaaaagaacattttaatttttctcttggtaatttgttctggtctccatagtaggtagtattttagtagtgctttgatattgacaagtcttgctccctttctctattagatttttcaaaataaggcattttattaattcctctttccttctcctctctcctctcagttatcaagcatttttatgactatcttacaagcaacagtttgtcttgtaaagcagaattttcctttgaaaccaagacagattatttctgcccataggcttcaggaaccaatattttggcaagaagcatcttttctttgtggtcagcaaataggtggtgagttctgtctggatcccaacaatcaacacctgaggaccaaatagccacactgggtggcaccccattcggaagtatacacaggaagtagccctcttgcttgttcacagctcaagtcagccaaagattaacactggtgagagatattttcaaagaagtttgcaggcttccaattgcagggtcattttggggtgctttcttgcctgtactaattttatctcatcaagcttccattctttgagctgtaaactttgaaataatatactggatttgctggtacgtttaattttctttgttaagtgttttcattcccatagtaatttttcatctagtgtacatatatgcatttaaaacaaaaattctttggtctccttatgcgtatatgcactgcggcttgtacacgtacaagctacttggtgggattatgtgaactggagttagaaatgtggacaattttattatgattatttttaatggtgatatcaagatcaccagtttcattcggaaccttgcataagcagggagcagaatgcggactgggtgtggcaaagcaagggcttattttatagccaaacctgaaatcacaactctgaaaaataaaaaaaaaaaaaaccaaacaaaaaaatcaagttttgtgagcttggtcagagaaggaaaaggaaatctctccctaccccccacctccaccattttctctttgtctgcagcttcctcaagtgctgcctgtccccgattttcttttattccactcctttcatgtttttgacattgaaatacagactcttctttccacttctcagggtatttttcttattacacctgtggcatgctcctaaagaatttcttttttaaaaaaaatctgtagagtagtagattagattaaccccagtatctctcccttaagactagatgacatgaggggattgcaaaatgaatagctgggtttttttttttttttttttttttaccttgaggttaaagcctggttcaacagttgctgagagagttaactagattgcttgaggacttggcaatttcataaagtattttgtcttatgctgtctctgtctctgtcttgatctctgtctctctctgtctactgtaatgttggctactttctctcagagcctgagagacagctctgagacacttcccaggtctgttcggttcagacctcagtagctggatcacaagcagtacccaatatgcatatgagggtgcgtgctgcaagtgtccggctgggctaatctgcttaagcttcataaaaattaatcatttgaaaacaaagaaagatattaaagaaattattctatctccgacttcccctatcagcattccatcaagttctgggatgttaaattcagagaaagttaaccttatcttaaacacaaagttgacttttaaacaaaattgcttataaagttctgtacagttaccagcattggttgccctttgtcgtacggaagagaattatgaaatctcatatttacatagcattcttccaaaaaaagagacggtgttttccagtttattcactgcattcgtgtaagtgtgagtaggccaggaggggtgcttagtgattacccttttgctaggtaacaaagtagaaagttagattttctatgatatttgtttaccacgtaggggaacctctctagagcaatactcccaagctttttcttcttgaaatttcccacctgacagataatactttagattgttgctcttaaggacttctctcagtagctgctacatagagatgattgtccgtgaattattgcttgcacactcatgggtgatgctactccctctctctcatggcaattcttgctgccaacctgcaggccacaccaggattgagggcagctcatctcgataaatttatagcattaaagtgctgggtcatttgagaatgttgtcaatttaggttacttagtacctaagttttattctttaaataacagctttattgagacgtaatttacaatccatacaattcactcatctaaagtgtacagtttcatgctttttagaatattcagagttgtgcaaccattattgcaatcaattttagaacattttaatcacccccaaaggaaaccctatgcacctttgtgttcatccccctatattccctcagtccttagcaaccaataatctacttctatctatggatgtgcttattctaacattttgtatgaatgaaatcatgtaatatgtggtcttttgtgactagcttctttcacataaaatatgttttcaaggtcatccatgttgaagcacatatcagtacttcactattttttatagcctaataatgttccactatatggatataccacattctatctatccatttatcaggtgatgagcattacggttgtttccaccttttggctattatgaataatactgctgtgaacattcacgtgcaagtttattgtggacatattcagtccacatattttggacattttcagttcttttggatacatacataggattgaaatctctgagtcatatgatacctctgtgtttatccttttgaagaactgtcaaactgttttctaaagtgtctgcactgttttacaatcccatcagcaacctatgggggtccatttcttccacatccttgccaacacttgttattctctgtctttttcattatagctatattagtgggtgtgaagtggtacctcattgtggcttttatttccatttccctaataacaaataatgttcagtatccatgttcttattggccatttgtatatcttcttttttgagaaatatctatttggatcctttgctcagtttttagttgggttttttattattgagttttaagatttttaaaaaatatattctggatacatgtcctttaatagattgtgatttgtagatattttttcacattctgtgagttgtcttttttactttccttttttttctttttacgttcttaatggtatctagattgaagcacaaaaatgtttttaagtttgatgaagtccaattcatctatttattttctgttttggcttatgattttggcgtcgtatctaagaagtctttgcctaatccaagatcacaaagatttacatatgtttccttctaagagttttatagttttcgctatttacatttaggtctttcatcagttttgatgtaatgtttatatatgactgaggtaggggtccaacttcattcttttgcatgtagatattcagttctcacaatattgttgttgaatctttcctcacttaactgtcttggcaccctttgtgtaaaatcagttgaccgtaaatgtgagggtttaattgtggactctcaactatattcagttgatctatatgtttattcctatgccggtaccacgttatcttgattattgtaggtttttagtgagttttgaaattaggaattttgaactcttcaactttggtcttctttttcaagattgctttggctcttgtgggtcccttgaattttcaaatgaattgggataagcttgtcaatttctacgaagaagtcagctaggattctcacaggaactatattaaatctgtaaaccaatttggggagcattgtcatctcaacaacgttaagttattttcatccataaatatgcgatgtcttcccatttatttaggtcttccttttgtcaacaatttttattgttttcagattataagttttgcagttctttttaaaatttattcctaagtgatttattttttgatactataaattgaactgtcttattgattttattttcagattattcgctgccaatgtatggaaatataattgttttgtatattgatcttgtatcctgcaaccttgctgaaaatacctgagttttgaatgcttctgggacttatggggaagagggcttctgctgctgcactgaaagttaaagcttacttcatttcatcctgtatgaaggctgcatggggacattcttctcagttttactcagctataaattcgaactggtaatcccatcccctttcgggatgaataggagagtgtttttaaatgttcatctctttagagaacagcaggaaagaagcctagtaaggtttgggtagtttataatcccttttttagaatttggatttgggaactattagcaaggcagtgagtaataataataatttctatatagaaaactaacatgtagaggtgacaaatgaaatcactagctatattaggcttatgtttaggttatcgtaagcagctaaaatcataattttatgtttttatatgttgtcctttggacaaagtaaattccagtactccttctgatgtgcatttctagatggggaaaggattcatttactctcatataatttaagcttctttttagggatgtactccatagccatgaagcaaagataaaattcatctatacacagactgaactttgtcttcattaacactctaggctaagggtcatagctaatcagctacaactgtaatgtcctgataattgtgaattaactgcagggcacccagcaaaaggtttagttataatctaatagctgtctgtagagattagcctaataaagggattttttaaaaaagaatctggccgggcatggtggctcaatcctgtaatcccagcactttgggaggccgaggtgggtggatcacctgagatcgggagtccaagaccagcctggccaacatggtgaaaccccatgtctactaaaaatacaaaaattatccaggcgttttggtgagcacccacaatcccagctacttgtgaggctgaggcaggaggatcacttaagcctaagaggcagaggttgcagtgagccgagatcatgccactgcactccaggctccgtcaaaaaaaaaaaaaaaaaagaatctatcaatcaaccacttttcattaagcacctgctatgtgcccagcatgtgctaggaagagataaggtgaaaggggacacaattcagacagaatcttcttgaggtaactgcttacgaggagcttatagccactaaaaacaaaaacaaacaaaaaccaaacaaccaaaaaccaaacagaaatgcagtatcatcatgccatgatgcctgtatgagatcctggattgtacggtatggatttcttaaaatgtagatattttaaaaaaaaagaggaatgaatcaatagaggctgaagtggtcagcaatgttacctgtggctgcttttaatccttcgtggaagtaagtaggagcatgtctaaactcaagcaatagattaaagatcttgatgtatattttaaataacagaagttagtaccactggaaagaatgaactggaggaatgggttgaaatctatttctgcttattcaatagtgcaccccagtcaagttagttgccaatttcttcttcagtttctttggctatatcattgcacttggtgggtacatgtttatgatgtctttatctgaacaagtcagcaataatatgagtaataaattaaaattgaaggtgattaatggctctgaatttgacataagagttgttttcctgccttctaagtttccattgatcctgatgaattgcacaaaccaaacaattcggggagtaagggggcacatgatgatcttataagagctttgctgtattagacaacgtaacattctgaaatggcctaccacctaacatgggctctgttctctgcaggttgagtaggttccttgcttgtggaactgtagtcccgctatttggccgctagggggactgcaagtgccccgtggcaggatttccctgggaatggtgagcctccattgatggtttcaacacacagccaaggccctatcgcaggataacttgaaccagaactgcctagcaccagacaataaataagctactatggtacttactgtttcatttgggatgttgtttctcgaagtggcaagcattttttagtaatattttgactttttaatacctttctttgcatatggagcagaaaacagtgacactggatatattcaagtagcactgtccagtttatagagaagtttcatattccattattgcatttcattcttgtttctaccttttacaagtaactagagtttggagtattataatagtattcatactattacagtactattattcccattataaaaattgtgcaaagagtggttaagttacatgtttacaatcaaacagcttcaaagtgactgatctggaatttcagtcccattctttcttctccagatcatgtgttccctgcttttatctcacagctctttttaccttatagatgggaaacatgagagtcagagaggcaaaagaaccacaagtggtatcaatactagaaatttatgaatttcttaaggcttctaggtttgttacccatccaccagactgatggatttggttgtgtgagagttctgggtgccaataaccttgccattctactttacagactgcatatattcaataaatgcttattaagcatctactatatgccaaattctgtactaggcaccaatgatgtagtggtgaacagaacagacaaaaatctcttcgtggagcagacagtttaatgagaggagacatgtagtgtacatctgagcatgaaaagtgccatgcagaataacttcacagagtgtagggtatagagattgatggtgagagggaatattttatatttgctggccagggaaaaccttactggaaaagtaaattttgagtagtgacctgaaggaaattaggaaatgagctgctatttggacatctggagttagaatattccaggcccagggaaccacaggcgcaaagggcctgaggcaggagcacacttgctgtgatggaggacaaagaggcccatatggctggtttaaataagtgaaggatggtagacaatgagatcagagttaatgaggttgcatggtaggtcttccttaggactttgaattttactcctaagcaggttgtattggacggttttgagcagggtaacatgacctgacttacattttaacaggctccctcctcttcataacatctgtcactctgatatattatacgtttgtttgtttacttactgtatgtggggggaagagactgtgggagcaaggggggaagcagggaaacaagtacactgcagtgatctgggtgagaggtgaccgtgtctcagactaaggtggtattggtggagaaggtaggaagtggctgaattctggatgagttttgatggtatagccaacagcatttactgacagattggatattcactgtgaaaaaaatagagatgaggatgattgccaagtttttggtctgagtaactggaaaaatgagattgccatttactgaaatggtgaagactgtatgtagagcaggtgcatgggcagggtagaaatcaagagtttgatttttgacttataaagtttgaattatctgatgaacatcctgatggcttcttctcagttagttctcatgcagtgccttcagctttgctgttcttcaagaaaattaaaaaggaacttagagatcgcctaggctgtaggtaccctctcccctctttccttttactttatagaggtctatagaagggtagggacttatccaaggtgaaacagtgagctggcgacagaactagggcacaaacccagttctcttgaattctgaatcagtagattttctttttttagtgtgattctgaggactcatttgggcaagagtgagttttttgttattgttttttgtttgtttctttgcccaaacctaaaaccaggtaattaaactaaatagtgaataaaactgggaaactatacaaattggttgctctccccaatcacactgaaatattattatttttactgaaccacataccaaaatatttttcctgtaaaaacacagtaagtgaacttttaaaggcaattgagcttttaacaaagctagaatctacagaggacctggacagaaatggccttaaatcctaggaaattagagttcatggaacctgggagaccatcttgtccagctagctcattttatgggtgaggtgcctgaggcaccaagatggaaagggacctggctaagctcatacagcaagctagtgcctgagcctagtcagagcctgttttaagggttagtcgtatgttgttttcttgaaaaaagttacattggaaaagtgaaaattctttggtccatactgagaacaaagaattatacataatcatatataataataatgatagcacttcctgaatgtttgctgtgtaaactttggcaccttgcatgaattgattcatttaattctcatgtcaactttaggaagcaggcctagagaggttaaggaacatgtccaagggtcacacagctaggaagtagcagaacttgtgtgcactcccaggaagtctggcttctaaccacaaggttctaactactgtgcaataccaggagcttctcagattacccttcacctttaccaacccaaatgactggtgacgtaggtgacttcattatgctctgcccctattatagtccactgatcctcaccaaataggtgggtggcctagaggttaaagtagaggcagagtgatggaaaggggtggttagaagaagttgatgactcatgatagggattggaaaacaggactacaggaattattgaaaagggcctagagatcccaaggaggttgatctccgactgctacaaacctgggcaattcaatgcctgcttaaataggagagttaagataagaaaaataaaattgccaatttttacagtcagacattgttttatttattttacatgtattaattcatttaatcctcaaaatactccatgaggtagctacaattatcatttctatgttgtagatgaagaaacaggcacagagcaattaaataacatgcacaagattagagaacaagtaagtggaagtgccaatattagaatctaggtagttcagctccacaacttatgttattttccactatatttatggaatgaggtaattttcttataacagaaagtttttaaaatgcaaaaacattgtgcctgaacttcaaacactgaacaactcatatccttaatatgcaccagtttcttttaagcactcttagaaggaaggatacttaacctaatgtcacatggtgagtaagtagcagaaccggaacttgaatttgagactccggactgccagacctctttccactctatcacttgggctcccttctaacattgacttgtctccctccattcctcctccgtattgttctgcccttcaccttttaattacctgtctccatcaacaagattggacagagaattgggagagtgagcagagtccatttccttccagagactggacaaaaggaacaaaatgttaggaaaaaatgtcagcatgtgggatttgtgggatttacactaaataagaagggacacttcccaggactgacaagatgctacctccgtccctctaggccccaatgtgttgtgcaggatcccataggaagtcatgaatgtggttgtcagataacctttttgttactgtggaaatggaagcaggctactgcaaaaatctgtctctccaggttttcttttaaagaaggtagtcttgctaaatgataactatttcagcatttatttgaaaatgggcagtgcaggagagaaagaatttttccaagcttgtcacattgggccacctctctgaagcattgtccaacttctaattagatgaggagactgcataaaccaagagttgagagtaaagatggaaacacttgatgtttggtgtttgggtgcagaaaggattccagaacatgttttgggtctctttactctgtccatccctccttccctttcatctttgtttaaaaaccacagttagcaaatgtgtagtctgtttgcaattgttcatctgaaaaatttgtttgatcagccttttgaataaaaaagaccaaattagactgagatatttcagtcaccaactatctaataatagaccaaaaattttaaccatgctcatactttcatatggtatgtagtttgctttagacattttctgggcttcagtgaggtgctagattgactcaaaatatggcaggtcagatgtgggattgagcagggtggactcttctctacccttcccaattcagagttccccatcaaagatgatctcatagtgtttgaaaaaccaagctgaaggctttgggaattagggtgctgaagggatatgctgtttcccaaagccttctcagtcattccttctccccccagttcagattcttaacacctctttccaggattagtgcagtgatcccacgtcctttctctctagctctctctgctactctctaattcctattgtatttgtgccaccagatctttccaaagtttagctccaatcttgtctgtatactgctttaaatgtctattagtctttaagctccttaagggtgggagtcctgtcttattttttccctattcttcgtgcttaatgcaaaggaagccttgctgtatagttgtgtaatgcatgattacaatttcagcttctccccattggcttatgggttaaagtccaaattatttaaatctggtgttcaagtccttttatgatctgcttatttttccagcctgaattcctggagttcccttacaaaactcttaaaacccagccaaaaggatctagtcactgtcactttaaaccatcctcactctcttgttttttgaacatgttatttttcttataatccctttgaccttgaaggctatcccaatttcaatactatccattcttctatgacagccccctacaaaatgaatattctcaacctcccaacccaaggagaagtgatctatatgacacaatatggttgaaagaatgttggcttcacttctttatctgtaaaccaggggctagaaatctctagtttataagattttgtggagaggggatcatatgtgattatggatgttaggcacaagtcaagagtgcataagaccttttggatttatcccttttttctttctccatcaatatggtacttagtcccttaaatcagaagtacttgtgttaatgtctgataacgtccttctaaatatacctctaaacatctgtctctctttagggcaaaggttggatatatctgcaaagattctctttggatataagatatccacagcacataacttaacagtggtgtacacagtaggtattccataagtatttctttatgaaatgattcagagtcaatagtagtaagtaactgccaaaaacaactgatggattgtaagttccattaacataaatacagtcagccctccatatccatggattccatatccacagatttaagcaactgcagatggaaaatatattttagagacacagtaaaaataacaattcgacagtaaaaaaatacaaataaaattatgtaaaacaactatttacataacattgtattagctattacaagtaatctagatataaatgaaatatatgggggatgtatataggttaaatacaaatatgacaccattttatatgttttagttaaggaacatgaatatttttggattttggtattcatgggagtgggggaatggaaccatgccccttcaaataccaagggactattatatgggacacagaataaaggagttgattgtcttgctctgttaaattctggtcagacacatttgcaatgtattgttcagccccagtattcatggagcatctccttttgtaaagcatggaggagctgtgagagagacatggagcagtgaacataactattgtttcaacgtacctgaaggattatcatggaataaagaagttagatgtttttctgtagtaccccaaagggcaaaagcaatgaggacagattacagttcagtaaacgaaagaggtttttttttttttttttttttttttttgagatgggagtcttcactcttgtcgcccaggctggagtgcaatggcgcaatcttggctcactgcaacctcgcctcccgggttcaagtgattctcctgccttagcctctggagtagctgggattacaggtgtataccaccactcctgggtaattttatttattatttatttatttctttatttattttagtagagacggagatttcatcatgttggccaagctggtctcaaactcctgactgcaggtgatccgcctgcctcggcctcccaaattgttgagattacaggcgtgaatcaatgtgcccagcctgaaagatattttcttagaatagcttctttcacccttcatcagaagttgtcaacatggaccatatgagttttgtttggtctatatggtgtatatgtgtgtgtgtgtgtgtgtgtgtgtgtgtgtgtgtgtgtatgtgtgtgtgtttattgaattacttgctaacattttacttcaaaattcagatttccaccatagggaatgaagatctggcaatacaggactttcattcctacatggtaatgaccagctgtaggtgaaaagcagctgatcctctggatgggccatgcactttgcagtttgcccaggcagcactgatccgctttattcatttaagttacctgcttgactcttctagtcattcgagtatgtcatccccatcagatcagagacctaagcaaatcttgggtcccttgcttactccaagggctttcactcctcgtataggaggagctaaagaaatgtacaagcagcaccacaataggatcagacctggctttcaattctagcacggccacataacatagttggatgacctcaggacagtaacataacccctctgagcctctagatcttcattatctgtagagcactcttcttatagagttattataagaatgaaataaaacaactaggataaagggcatggcacttagtaggtgctgaaatattagttcccttcttctaattcaccacaccatatctgtctatctattggctgaatcacataaatagtaaattcacattcactgaagacattcaagaagagtctggaccctttgggaaccatgtatagggcaaaggtttgaactcatagtagatgatttttacagtcactttttaacaatttaaaagcctatagatgactccaaaatgcccatttggatgatatgaggcatactttgtgtagttaaggattttaaatacataacagagaggctgaagggccttcgggaaagaagctggggtaagagtcaaagtgtagtatgttgaccgatgttcaggaataggctttggcatctgacagattttgttttaaatactggctctgggtcttactagcttccagttctgggctgcttcacctctcttgagtttcagtttcttcatttctaaaatgaagatactaatgcttcctttgttgggtttttgtgaatataagtgagataataaatgtaaatatctagcccagggcctggtgcatagtacaagcttcataaattgtacctattattattagtagtagtagtagtccagacaaacagagcttgggaaaacgctagactctggctgacatacatgggcttttccccaggccactgctgcctggcttccccttccacaaagctttgagtctccaaaatgctttggctggaatgtaagcgtgaggtcattgcagataacaggggagcatgatttgcttcggtaatgcaagttattaagttacttccctcagcccagctgaaatctcttattggttgatgtgtgcttcaaagtgtgagacagagctagtctgaggagagagggagagtgagaagattcctcttcttggccagaggtcatggtcttccacaaggaacagaatgactcaatgcaaattatgggacctctttgagtttggggcccctacatttaaactagtaactccgttgcacatattggcacccttcccccaacaaaattactgggcaggaattttcttgaatccttccgtggcctggaatgatctcccttctcatccttgtgatccacacagctggcaaatggcaggcagcagaacaaaaacaagcctcttagcatatagggagagaaagagtcacagcagtactgaatttgcttgggaacctaatgttaacaaaggaccttcctctcaacaccccaaacagattaaaacatttttttaacagcaagttgtgtctcggagcagctctttgcttgggtatatttaaagatctgctgagtcatttaagagcaggctggcatatcctaagaggcaaggactataccccagtctatgggggagtaagttgagaggtgaaatctgtttggctttctcccatggaaacaaacaaggtgatccacttccatctcccacgactctggagagcatctactaagccttcttattctatcaactttgaactcctcagtgtataatagagtaagggtgagagggaaggagcagtcgtaccagtgtcattattggtatgttcaggagttcaatttcttcctgattcagtcttggcgggatgtatttgtttgggaatttatccattttttctagatttttctagtttgtgtgcatagaggtgttcataataccttctgatagttatttttatttctgtggtgtcagtggtaataacccctgctgtctgaaattgtaatggccctgctattggtagctgagagtagcatggaagtgtcaggttgatgggttcatttaattcttttcttttcagtttcagtcacatgcattgttaccatggcatatgacagttgctagaaagtgaaataattttttttctactttattctccactgcacttctaaatttattagtggagaaattagcagttaccaactgttcattataggtacacattggggtttccttagagccaattttccccctggttttcatcttgtaaatctgtaatcctaaaaattagcaaaacctagagcttctctttggtcctggcctgtttgaaccctgttccacagaccccaatcttctttcttgtttgaggcaactatccttctctttgcccaccgccattttccttcatctacttttcccttctctagcacctcagactgtcttcccacagtggcacagcctcccactccactttcactgtgccatctccttgccatcaaaaccatcctcacagacccttctgaaaccacttctaggaagggaaatcacaatggatccatgaaggatgctttctggatgactttaaaagattggtattaagatattttatcagtggtagcaacactgacttattcaggcagccatgccccggatctataagaaatcaggtaagctaaaagttgcttgagctggcaggagacctagttctcttttttcctttccctcttgcattttgtttatcgatggttttcaaaggacttagaggctggctttgttatagttagttggtaagagaaatggtggaggaccggaaaatgggagtggaacgaatgagcatgtttgagactaagttattacaattcctaggatgtataaattgcttgaaatctaccaagtactttcagacacattatcttttttactcttcaaaatcaacttggaggtaggcacaacagggatcaaatccttagttcacagatgagtaaactgagactggaggaaattaaaggagattccaaggtaactcagacaataagcaacagaaccaggatttggtgaattttttggggggtgggaggtacagagtctcactcaggctggagtgcagtggcaaggtctcgtctcactgcaacctctgcctcctgagttcaagtgattctcgtgcctcaacctcctgagtagctgggattacagacatgtgctacaatgcctggctaatttttgtatttttagtagagatgaggttttgtcatgttgcccaggccggtcctgaattcttggtctcaagtgatccacctccattggccttccaaagtgcagggattataagcatgagccactgctcccagccccagaccattaatttttgacagtaagtccaacttttttcaagttcacagctcagatttgctattgaatgaatgagtatatatgtcatttgggaacattctttccaacttttggttgaagatttgttttatcacttgtgaaaattttttttcattcttagcaatgtcagtttagttaaatgagcatttcatttgcgaattcactaattaattattttattcatcaatacatttcctgagtaccaactttctatcaaaccctgtgctggattctgaggctacaaagagaaataagataccatctcaggcctctaaaatctcacagactggggactgacatctcagtagtaaacatatgaacagcaacttgtgaaacgccattagcaaaatctcaagttatattcttcagtgactatggccatcctaaaaatggggtgtcttttatttggggtaaatgaagatgaagccttatgagaaattgcattttaatctaatcttgtcttgctaagaacagaagtggaatgtttcagcctctgtgtgtgtatttgtgtgtgtgaaggttgagtgtgtgatgatggatggggctgcgagattgttaagtaggatctatggggggccttaaatggtcctggtgagtcccaactttctggttatgtatttgagtagagtatgggggtgacaaagattgttgtttaagagttgattttagattttttccaagtaaatggtcagctgacttggagcatcatcattccacttgctttgaaaacctgccacttaaggctccttccagtcataggttaactctttctggtcaagtattactctttttgagcatttacctgtcagtgacaggtacaatgttagatgttgtctctctgttttcttgtttaatctttactttgatcctaggtagctcttattagttccactttataggtaagaaactgaatttcagagacttgaatgacttgttcaagatcacatagtatagtaacttggtagtttgggacttgaattttgattgttcagttttttgtttgtttgtttcctggcctccctgctgttttcactattccacaccacttcagctttatttttcatagaggccattaaatgtaccctccatcagccaaagcctcttgcctcccttcaacgtaactcttctctagcgtcctcttaataatcttctgaaaaggttttacagcctttctgggtactgggacccagagtcttaatccaggctcttaagtgccttatttaactgtaatatggaaaatcaaagtcacagctaattcaggaaaaatgagtttgggatgtgaatttcctaggcaacttgtcatctcttttttacttccttagcttcataaacttacccacaatgttccctgaggactaagagtaatggagggtgatgaggaaaggctttcctcccttcctttccgagagtcctttagccaaatgccacacctcctcctgtttccctagtctccgtgcagagatggaagtgggagatagacatgggttcctttcagccctgagttcatgccagggttttctttccctctagctggactgaggtaggaggagaggttgaagtccaccaataagaccatgagtgaagaagactaaagtacttgaaagagcagcagacctacgcttaaaatactagggtttgtgtccagactttgtgggttactatctgtataattttgggcaagtcaacagttctgagtcagagttcccttatcagcagattggaagataaattctaattatatagatgaaacattaagtctagaagtaatttgtaaattcagaaagggcttatagatttaaagtgtagccgttttgattaccacaaactaaatcctatacttcagggataaaatcttctcctgttttttctaaaagcctgtgcatgtgtggtgtaaggggtgggttttcccttgtaccagcaacttagcaattgtagtaacggggctgagggcagtggcatgcttcttcattgagcaagtgtgaaaagagggttatgcattcaggggtcagcagatggcaggcagagtagcccctccaaatctccctcccataccacaaagccctcttatttattcaaacttaacattagaagctcatttcaagtaggcacgtctgtgtctgggcgtctattttccttctttgtatatagcaggcatttgtcaacttggtgaaaagcattactcttctttccatttctgaggactaattgtgcttcttcgctagacacgagttcaaaacagtgggttgaaagagggcaagtttatgccaaagaatcagaaatagtcataatttagagagaattctagaggtcagttccctttcgtatggactgggcaactgaaacccagacagggaagggaattagaccaagttcacaagcacaaacactttactggcacattcagattggaaatcgagggcttctgctcccaggtcagaactaaatgccctttctagctagggtgttctttgatctcagtgattttgactctttctactgcactctggggacagtgggttctgcggtaccaactccaattaaagtgggaatatgtaccagcccctccccttggtttttatttttcagaggcctggcagtcagagggattctgatctctatatgcaatattttcacactactgtacttattgaaatcacatttgaatcttggcaattaacaaggcagtaattggcatcaggagggtatgttagtttgcttatctgcgccgtccctcctcttcccaacccactgtgtattgcagaatgttttatcagctctgatttgccaagttgctctcttctccagtaggtgctgcgagcagagagggattcctcggaggtcatctgttccatcttcttgcctatgcaaatgcctgcctgaagctgctggaggctggctttgtaccggactttgtacagggaaccagggaaacgaatgcagagtgctcctgacattgcctgtcactttttcccatgatactctggcttcacaggtgggaggttcttcaattgaaaacttagaactcagtttctagggtagtgagtgttgtaaggtttggactgtgacctaatattacgcagccatgacattatctattaggcatctagactagcttgcttgaatatcttagcatgttgactaatttggggcagaatatagtgtgggtgggggattttgtgtgtgggggggggttgggggttgagcaattcattattattaaaatgcaaaaagcacttaattcgctatgataagattgcctttttcatgcatactggcctacctgcaagacccctagagacagtaagcagcatacatggtgtcttccagttttcagcctttgtgcaaggaacaactgtgggtttctgcacatgtgttgtggtttgatgtttgtatgtgattgtgtaccagggtatgtgtgtctgttattgtgagttcatttctgagcagttgtgacacacagagatccagaaacagtgtcttaccctgtgtgctttgctagtgggaacgtgtcttttcttttgtgctcgtatctctgtgtaatcgagtgtcttgctaagtcaatgtgcctctgtctctttttaccagttctgtctttgtgtctctgtgccttcatgtattttttcccctgagtttgcacgtctctgtctatgtggatatctctcactccaggccactgtatcactgtgtctgtattacagctgtttatttctgtcggtgtgtggatttctatgtctgttttcatcttaatttgtgtgtctaagcaagactgttttggggtgactatttcagtttatgtcatagccattctttgtgtgactgcttctaggtatgtctttttctatgcccctattgtccccatctccatgtgtctctgtgtgtatatgttctaatgtatctgcctacttatcttagtttgtatttctctgggtgtatatccctctcttgcagttctgggcctttgcagtttttggcttatgtttttgtatatatccactagaattggcttcttatcttttttgtgcatgttttagtttgtatgagtgagcatatccaactctgtctttgagaagcagaactgtctgtgtttgcagtcagttgtgttggctgtccctgtgtttgtccctgtgtgtgcatttcattgtatgtgtacgcatccatgtatctttctgcttctctgtgaccagatatttctgtgtagctgtctatgtatattggcttctgtctgtgtctgtgttgttggctctacgtctgtgcatatgcacccaccgggttcataaaaagctcacctgctctccaaggaatctaccagattattttgtgaaataactcacgtttcgtttttttacttgccagctgctatggtacttaaaagtgtgttggtacgtaggtgtgcataatttattcatgtaggatgtcaaaagagtcagttaaaaattatgcacagtgtgtctttattaacaggacacttgtgtgtagagaatccttgagaaatgagtggttagatgataaatcttttcatattaatttcatgatgtcagtgaagtaaatttgcaagatatgggctgcataagaactatgttctttttaaaactcagcatattgatggtggagaaagcatttatttgtactgcaaagtcttatttctgataagacatcacaaataagaattattgtgatgagacttatcacaaataagaattattgtgataattcttatttgtgataagaattactgggttagaaggtgttacttttctggttttgtttgggtttttgttttgaagtgttactacagatggtgtcttagggacaaagagctctgaggttgacttagaacacatggagtacagataaaaaggagaatgaaaagtaacagagagatgggcatattccttgtttgaatggagtcatccaggggctcaggatggagtgcacaggaaatggagaggtgaaggtcatagagagaagtttagcaggaccagatctttccttgtcctgggctgctgtgaccatataaggaaggcagtaaggggaggggtagggatgaggaagagaccagctctcctctttctttctgatggaaggttaccacctctatttaaaacttctgttcttttggtttctctttctttctttgattatattattttctggacttgttctgccaaagcaagaaggaaattccacatgtggctcactcatttattatacttgtttctttgcacgatattaaagacagcttgttaagtgtcactgcaaacatcatacacactgatccactgatatgggcagggggttctttatgccagttctgctctcttcccagtgtatctgtggtgcttaatgggcgcaaccatgatttttctgatgtcagtctgtgatgtcagttgtccagtgtgtatgcaggctgcttaagagtacatacagttccttcacaattatggtagtccctgagaaggaagtggtcattaataaaagactaggttcagtagaaacatgtaagttgtctaggtgttggaaattaatacagtactgtgctaagggaacatatatctagaagttaactgaattatgctcaataaaaagagtacaaatgtttcataaatattttgacctaatcctcctgtaagattaggagagggatatttccgatattcaaataatttttttaattggcaaacaccttagacatactatttacataaaattgacatgacaaaattaagtcattgtgtctgttttatgataaaacaggctcttttgatttagttagaattattgaatgtaaaataatgaaaattaaaaaaaaaacaaggaggaggaatctatcctattttataattcagaccgttgaattgagtttttcttttgttgtattgatttaaatgcagagaagtctatgatgctggattccagtcagaagataaacatttgtatgtgggctctacattgcagccaaccttgataatttcaaacctcgattttctcatctgtataatggtaataataaagcctgtctcagtagctaccaaatgattgcatatgacaaacttctcacttatttaagggaaaaaataagaaaaagaaggacaatagggtggatttttcatatagtaaaatttattcagttagggtaatattctgagattgtcttctgaagcaaaccctgcaaaccctggccattctgttttgtttaggaaagaattcatcagttctgattctgccttttctggggagggaggctgagtattggattgaagaggagtcactacttttctgagatgatatatccgtggtaaaaattattaatgctttgcacatgcaacatagagtgttcaattttgttagtcaacaaatatttaagtggcagctgttatgacctcaggggtgtagtgacttccttattgtcctttaattattaaaaaagaaatctatatcagaatatcaggtaaactcttattacatcaaatattataataaagatactttttatattctctaaacaaagtagagatctcagatgttggttcatttatcaatataatattagatttgaaaattccagtatacaaaaggaaaaggacagcttcttaaagtttatagtgattttctatgaactatcaattccgtttttttctgttttactggtatgatggaaactaaatttcgagttgtaagtagtagataattagactgcagggtaagccttgagattacttcttttcaggtaggaaactctactgtgtatttggctagttcaacctatcatgggtagtcaaaaatagttacatatacaagtcagcattttttaaattgttcagttgtgcttaagattggtcctttccaggaacaatccagctttatcaaaaaattattgcgtacatgtaaagtgttctgacattttaatgctcacaatagccgaatgacgtgggtaagaatcttcgtcttcattttatagatgaagaaatgaagacacagagacataaattaactgggccagggtcctaccactagaatgtgatagatgataatttgagctcagcacatagttatttccctataatatttgttttatgattgtatagatgtctgctgaccaaccttaatctctgctccctaagattaaccattctacaaagcagaaactggaggtcattcaaatgaaagctctacacttttagagggccattaacaatgctcaagttaaagaaaagcaatcaaagacaactaaaatactggtaccttcaaacagtacttatgaattatttaaccttagataatttggctttgagttagaaagatagagtaagatggaggaaccaattcttccctgggttgatatttatttatcttgctcttttgaagtctaggccaatcatcctatttattctgaatggcccgttaacgtttatccatttagggacagcaggtttggcacaaatggattggttttctgaggtcttatgtagagggctgcactgactgacttctgaaagtcccccctaacccttcaaatctcagggtcatctggtctcaagccttcaattatgaatacatttctattgcctttttgagtaacagcacaacactgcaagctgacccactgggtggatggaatggggctcttgccctaccaccctttggcaaacaatttgagggtggcattgtcactacctcattgtatatagggtctcttgaggcccagaatggcaaaataattttcccagtgtcacacagcgagttattgtcagagtaaatatcaattttgaatttgtagaccacgtggttttacctcatcatttctgtttgttatgaaagttttacaaataattagaagtagaaataatgattaaaataaagcataactactaaaaaatagtttattgcagcaccacctaaattcatctcaccactctaccagtagcatacatttcacaattgggttaacattgctctggatcttatagctgttgaagaagacaaaattctttccattctccagcttatattttccccatttgtaaaacataatggaagtgtacggaaaataggagttgataatttttaaggcccttgccagcacattagtacataggattcttgcaagtggtggtttacttcacttcaactatagaaggcctatgcgacaccacccatagagggtagtttgaaagaaaatgctagtgactacgtgtgtttccttcctgacatattttatagaaggtgatgagttccagcattttttcagacttggatctggctttcattccccttctcctcccaccctctaaaacaacagaggcagcaaccatttacacactttccagaagtaagtaagtaagactgtattccagaaacaccctatatcaaaatggaaatatactcaagtgccccaatgacccattgggctagtttgaacgtgtgcagtctctgtgctccccgttttagcttaagcctactccctaacctgtcatatgtcacccagccatggagcctagggcaatgactgccatcatatctgactttatggcctctcagctttcaatgactagctttgtagcagaagtttagcctctcatccccataactttggaagtagtgttgagataaagaaacgttgaattgaaggttgtgttttctagatttctttcaattgctccttaggctttagaagataaattctcctaaaagagaggtgctacaattaatccaagcaaagggaaagatgtcagtaaaactgccccttttcatagaggtgtggcaactgctgggaaggaagaaattagcctgaggccatgtgattactaataaactcaaagcggcatttttttacttctcaatatgaggttgaaactataagcttaaattgctgactttctggcagcaccaaacagtaaggaaaccacaaagataaacccaaataatagagccaattttctttttttccgggggggatgacttctaactagtgatatgaggaaggataagaaaatgtttctttgtaggacatatgatctttgctaagtgcactgaatgtatgtagaggagacaagtctgctgagggtatgagaattgggccaagatttaacacattttcaaagctccatgaagaagcctactgagcagtgggagtggagcaggttggggatagtgaagtatttgtaattcatttttaaaaaggagagggagagagaaaaggaaaaactgggccacccatcctttgaaaagaaaccttgaaagaggtccaaatatccttagaaatccttgacttcttaaaagtgatgtttgttttttccccctgacaattatagaggtcagagagtttttcttttctattacaaaacattgagagtgtgtagaaataattgtaggtagcttagccttggctgtagtcagaacttttgtactgtgactttaggatctgtatggaatcgtatgatatgcggatacaccaaaaactctatgggttatcaaaatgggatagcattaaaagaaatagtgcttttgtttagaagaagaaatgaaatgcttgtgtccagatgcttaaaggaaggcagtgcagactttcagaaactagactttaagagctgtactcagatactgagaagggctgatggctgaaggaggaacaatttaaaagaataaccgtctctcctctccctgtatattggacataaaagaatatcccattcttttcagaaatgtaatacaacagtttagcttgctagtaacttcacatgctatttcctttacctcttatatttgaggtgtctatttggagtgggctgtgtttctagctattctgtttatctggtttgtttttgttggtgtaggaaactggtataaattttatttgggtaaatatcacctcaattttcaactaaagctttatttaagtttcacatgaaaaagacaaatgaggcaaaggaagagaaaaatgcattgtcagaatcagaattatgagaaaaaaagtcaaacaaacatatttgaaatgtccagaaaacctgtgagtttttatgtatactatacaggaaagatattctgtcatctggttgccaaactatggagggtgggagacttcgaatttttgtcaaaaagtattctttcattagaaagatacatgggtgtgcttccatgtcagcaacatgactgcagaccaggaagtcctcacggagagctggaatatgggtattttggactctctggttagatgcagcttttacttcacatcctcagtggtactactgtaaattttcattttcctgtggaataccctatttggttccattgtatatagttgacaactagaattcgttcgctgttgcttgagcccaactataacttcttggcactatacctatcttctgatgtgcctgtggaagagctaccataatgaatgtgtacatggacaaaaaaaaagagagagagagagagaattaaatcatgagtttgtgccttgggagctacagtttaaacatttgctgtttttctcacttaatgaaaaatttatttgaaaataacagcacagaaaggaagaaagacaggctggcaagcatcctcctcctaatacacttatccacgtttggataccttggtctcagcctcagaggtcatatttttagtaaaatggccaccagaaataaaggattttattttccagactttggtgtttggagctggtgtgctgagagctagcagagaaagccctactcaggtagatgtaccagagcaggatggttgctggtggatatggtggaataccttttatgtggttatctcctccttgtaactcttggctgcataacccttattttcttttctatttttattctctctcttggaaaaaaaattggtggtaaattttcatgtgagccatattgtctttttaaatagttttattaatataaaatgtacgtaccataaagcatacccatttaaactgtaaatgtcaatgggtttctctctctctctctctttttttttttttttttggatgctcagagttgtgcaacaattatcaaaatcaattttggaacaatttcattgccccaaaaggaaaccctctgcccattagcagttactccccatttcccccaccccctgacccttcaaccctaggcaagcacaaatgtactttctgtctctatagatttagccattctggacatttcatgtaaacagaatcatgcaatatgtcaccctttgtatctggcttctttcacttagcatgatgtttccaaggttcatctgcattgtagcatctgccaatacttcattccttatttatggctgaataatattccattgtattaatgtatcatatttgttttttccaatcatcagttgatggacatttgggttgttttcatcctttttttagctattttaaataatgctgctatgaacgttcgtgtacaagtttttgtatgaacatctgtttttatttctccttggtatacacctaggagtggaattgctgggtaatatggtagcttaacatttaatcttttgaggaactgccagatttttccaaagcagcagaatcattttacattttgaccagaagtatatgagagttttagtttctccacatcctcaacaacactcattattgtcattgtccttttcagcttttttgataatagtaatctcaatgggtgtgaattgggaccccatcatgcttttgatttgcatttccttgaagagtaaggatattgatcatcttttcatgtgcttattggccgtttgtatattttttgatcctttgctcatttccaaattgggttatttgtctttgcattattgagttgtaagatcttacaatatattttggatgtttgtcattttagggatgatacttcacagttatatgatgttttctagcaagcatttgcgttgttctactggtgttacatatcttagctgcattagccactttgctgggtatgaatgccagcagaatctaagtgaccttggcttcactactgagaatgcaacccaagaacagaaatttgtcagaaatttagcactgaagccccccacttcccaaacttatctgggacaaggagaatctacatttaaagctctatactttgtgttgtgttttttttactttagcttggttggatttaggatcttttctttttgttttgccttatgcatacctaagcagaggcaagggaggaaagggatatgaacctggtagaaaagtaagtaagctttattcagattggcatatccatcttaatatggttcaattggctgaagaagtatctcaactaaaactctggaatactttgaagtaccagcaatatgtaccaaatgtactttttatttatgtttggtctctatgtacttgtgtgtgaaacaatgagcacaaataataccctccttgtttttaagcaatttatattggtgatttaaaaataaaataaactcaagtgggaaatcatgaaaccccatgtaaaaacaataagagcatgttttaaaatcccacagactttagtttcaaatagtggttttgctatttcttagctgtgtgtcactgtgcaagttactttgtttctctgagtctttattggtgatatatgtaaaaacccaccttctcaaattattgtgaggacaaaatgaagtaattaacataaagttcctggtgtataataagtgttcatattttgtatttgagcacagggcaactgggtttttgaaactgcacattactgttgcagtcaaatctggcatgaaattagtgcatagacagaatgggctgggaaaatgaaaggactttgaacatttatattctgctttatttaggcataagtgcttaataattattgatagtttcttctggttatctgacattttgaagatactattacctagcagaaatttcttgtaataataatctcttacacttatatactgttttgtgcctttagaagtacttaatgctctttatttcactatctgttcataaacattctctgaagcaagcatacagtcagtatgaattccatttttcagatgagacagctgaggctgaaagacatagagttacttgtctcaattcacaaagtaaagtgccagagtttgaaccagagcccaggtcttctctctcaacgtagctctttttctccttcattatatcaggcatagtagcaacgtattcttttactagctttttatcttgaatatccttttagcgacttgcctttggtgttagtgtgcctataacattgtcgttgaatatcttaatacatttagtggtcttggcaagcagttttgtcttcagaaggacactgaaatctgtggaaaggactgcagaagattgggtgggcagacacctatcactttcggggctggtagactttctattgaagcaatttgcaaggctactttgtattgtctaaaagcactacttcagaaaagggttgtgatgtcaaaataggcactttgagtgaagaaagggctgtaagcatgggtggaaaatgtggtagatgattgtcttgagttattttctttaatgtcaaacaggcagtccttggaatgctacttcaaaaagtgttgtataatgttgaagatacagttacagatttccaacacgaaactcataaatatgcaattccctgtcctcctaggcacatgaaggaaaatttatgagcttcaggtttctatgcagctattaaagcatatttaatctgctttgagctcaagctcactctcgttggctctcttcgtttcttcctcttacatgagcaaactgcctttctttttgtttaaaaatagtaagtaggtttgttttcctccaggtgtcatgaatgcaaacattgtaatttctcatctgttcagcctttttgcacaacaaaatggcagcacccaggaggttgaaagggttaaattgttccttctctgagtagtaccataagttgttagtctgctactctttctcccagttggcacatgaccctaacatccaatcgctagtggtgtggccattttttggtcttattttggcctttcctcagccaccactcatcagttctcatgcgtatttgtcagatcctgctccccaactccacagttcttagttcatcttaagcatatggctgtctgtcttttctctaaagatcctcaagggaaaaaaaaaaaagcatctccagggggaatttactgcctcatagccctgacagagatttctgaccaaaccctaacgaaaaaatttcttccctccatttgtcttttattgtttttacaggggagatatgtaacataataacaattatattgcacataataattacttctacaaataataatctgttgtcaaaaatatacacagctttggatttccttattatggcccttcattaagttgtggtttaagaatagctatgattattacttttgtgataattataatccataatatggaaacttataaaattacctttaaagtgttactattattctggccacaggatggaaagttgttcgctagttactcatttataacctgaatgtactttttactgaatctaaaggtatcatctttgcttggcaattcccatgacttgtctttctgactcttcagatctcagcttaaaagctctcccttcaaagaagccttccctgaccactctggttttttcttctttttttacctctactccttttcccattacttgctgtcatagcattctgtttgtttcctttgaagtgcctattccaatttgtcattatgaatgagtttttttgttctgttgcttattatccattttccccactagattgtcaactctgtgagggcagagaccatgatactctgttcactcctatatacattcccagcactatcagactttttggcacatagaagatactcagtaaatatttgttgaatgaataagtcataaagaagagtttatattttaactcttagttgaataatctaagccaagaattatcaacctgggttggacgtgagaatcattaatgaatctttaaaacaatgacaaggcaatctatttattaattatctccaggtctaaactttagcacgtatatacattttaaaagcccataagtgattcttacgtatagccagtgctatctgtctcttctcctgtcctttcccctcctctccttactcctctctcatagttttaggattagcatggccccacaacaaatctttaattcacatggcaatttctaggatttatcatggaaaatgagccaaattgccttcaagaagtttttacgtacctcttatatagaatgtgatgttttatatgtacctcttatagaatgtgagcttttaagaggcatatcttattgcaagaaatttcaatgttgaaaaaaatattgaatatttataaagtcaaaaatgcaaacttttatatgattttcaaacctatgaagttatatcatgttcaggccttctttccagcatgtggctctcagccctggtactgtccttaaccataaacctcatctttgccctctatagggagaggtttatggttataattactcattttaaatagtgtatattagtaatgtacactatttgtatatttgttgactgcctcctatatgccaaccactatgctagaaattttgtaatattcttcacgatattcaagatattaacatatccgcattttataaatgaggaaactgctctcaaagaggttagtttacacagccagtaagccgctaagcctagattggatggaaggtatgtgagaaaaaagcagcatccataaggttttcattctcctaccctgtacgacagaggtaatagaaattattagttaaagaaataatagaattttacaagactctaggaagggagaatgtgaaggatacagttctcagttactggaatgagtgccagagtaccagtacatggcttgccttggggtttggactacctatcttaactcctttgctcctcccaatcttgatctcatttgtttgaaagatcatctgcccaacataaaaatgcatttctaattctgtaatttaagtcagtggcaagatcagattcagttaaagtttactttcctgacagctttttagtatcatatctattttgcaaaactctagtgataaatgtatgcacatttacacatacagcatctcttctgattctgactaagatattactgggttgtgtagaagtgatgggctctttagaagaaaggtttgatatactactaatctaaggactgaattttctcatctttgtctttgccccttttgactgatgaccagagcaggagcacataacattcttttgtgctaacagtatctctgcatcacattgatcaggagaattggcatctccagagccctgggatggtaacttctctgttgattttcaggaaagattaggtgatattttctccatgggaagaggatgtttgatgtgtgttggctttagcaaaaggaagcttgtggagtcaactgtaagtagacagaattgcctttgacttaatctgtttcagtcgttgttcatactcaggtcctccagaggacctttaagcatttttattgactttgtggtctattacacgaaactaaagatactgattctcagtcatgagtctgctccaaaattgcctagggaatcaaaaataattgtaccagttcctattcctggacattatgattcatttggtctggtatgaaggccaggaatctgtatttttaaaattcactcaagcaattttcatatatagctataattgaaaatctgtggctgaacttctccactcccgtatccatcgcaatacttccccaaggtggcatttaagatgggcctagagggttatataagatttcaatattaaaacatggattaaaagtgaagacttttcacatggagataatttggaagaaaaacttgcaaaaatgtgagagcattgagaacttttctttcccaaggaaagaagtggcagcttcatttttggtcattgcaaacagcagtgccatacatgaaaggaaagtggtggtgctcatcaactttgaataactttgtacagaacccttgagactcctctctgcttataaagaaaaagtgtcaactgtaaagttgatttatttatgaaccataggctactatgaaatctctgttcccagctagaggcctgggagagtaagataactacttgtttattccacggagccacttattagctttttctatagcacatacctcaaatgaagcatttcaataaaagaaccacattctattcacatgcttcattttattctgatttatgtaaaaattcccaaactcctcaagcagtgtttctttgtaaggcaataatcttcagttctgttgcaaaggtcaggagtgatagaatgaaaatggtactagatacaacagctctttggtatttgcatggccattacattgccatggggctgcaagacttgtgagtgcttgatattttgcttgttgatgaatgagtctgtgtttgtgctaatggagtgatttgagaggtagttctccactgtcagtcaagaggttggttttgaaagctgattgccaatggtcattctgctaaccactctggttctcctttagatagagacttattcagattcaagtcttcatgtactttgtggcataaacattgtacacaccagatgtattcaacaaccataaaaaaaaacaattaggactcaagtagtatgtcagagtgtagtcactgatgatatataattctccactaccaagaagatggaagcacactgttgagtagctacatcctacatatgttggccagaatttaggaatacacatgtgatctatacattttgaggtattgtctgacccctagaaaatcctggtgaagtttttctggtgtcagtttggtcttaatgtttaggaaatgcccacagactactcctgctttctgcttattcacatagtaaacgcaaagcacaggactagtttgtcatctggatcaaggagaaatgagttagcagatataaaataaatcagaaaggaggtagttctcaaatatttactccatgaatagttgctggatgttcattaactctatagcatttgttactacttattggggatcctggaaagaaaatatattgtctatatccactgttcactgaggccctctccctacccagaaactccctgtctccatcactcactctccacattcattgacccaggggaacagttcatggatgagtgaacttgagctctatcttaaaggatggagttcgatttcaaggcaagaggtataagagaaagttcagagacaacactggctatggtctttgtgaagaaaagtgaattgaataggctcctgtggagatcttaagtaagtacttctggagataaggttgaggaaaagtaggtttgaatcttcatccagaggtagcccctaaatgtgttgagtttattgaaagagtacttgacttggattcagacagatctgcatttgactcctgttttgccatttataagaatttgagtaattattgtttctaaataagagtttattgagccaagcactcagtaaatgtttgaatgggaaaattaactgccctgtttttctattgtcagatggtcctcttcgttggataacttggtaactgttgataaccttttctcaggaatcagaaggtagaaaggttgggaaaatataagaaacaaaaaggcatattcctatttttattttcatattgtcttccaactctcccaggcttctttgtttgcaaggctgacttttataatactttttgggtagagcaggtccttctttggtttggggttaaaccgtgagtaaccttattttctaggtctcagccaactttgaagggcatgaactcacagtagcctcactaggatcacttcagcagtgagaatttatctttcttgtataaaagtgtaagagttgatggcggccaggcgcagtggctcacgactgtaatcccagcactttaggaggttgagatgggtggatcacctgaggtcaggagttcaagaccagcctgaccaacatggtgaaaccccatgtctactaaaaatacaaaaattagttgggtgtggtggcacatgcctgtaatcccagctactcaggaggctgagacagaagaattgcttgaacctggaaagcagaggttggagattgcagtgagccgagattgcaccactgcactccagcctgggtgacagagtgagactgtcaaaaaaaaaaaaaaaaaagagttgatagcaaaataactatctgtagcataaacctcagtattctttatcattcagtatcaacattattactgaaaacaataagcaatatggactgagtttctgtggggtggaaatgtgaagtggatcatagcatgatataacttgtcatttggcttcctttataaacattatcaactacctcagctctatcaatcacttggcagtccgtagtgaacattataactcaaatgactagtcaggtctgttcattgcccatgtaaaggcatatacctgaagtgagaagtctgaggtaacttagcaataagcttgcagtacagtgtttagtgaagccgaggaattcaaggatttgagtcatgccagattgctccataaccatagcctatctttgtcacaagtaagaaggtttaaaaatcaccataccattattggtcacaacgtttggagatagggaagagtttgtggatggatcatggcagtgcatggacagtgattagcccataacacaaccagtgaacactgttgtacccaaagcacataaatcaccacatatactattaatatatttatggatgacaacagacactataattttatgtcagtgctttctgctgtgaaaaacaaagaaagttaagggtaccttttttatatttgcatcatatctccagaccttttcctttatctccttcttgcaagttcttctttctttcagctgactatctgctgttcctgctatggctcccagtggcttttcaagagggtacttgttttttaagagaagacccttgaaggacagagagagcctgaatcattcaaaataatgaattactcaggatgaaatttcaataatttgcaagtgtgtggagatagatattttgaggaagcataattttctatgtacccctcaaatcgtggctggagatgacagcctcttccacctccatataagaccatttcatttccttctacttttttctccctccttcccccaaacacacaaacatacacatatcctgtgcttcagtcacacagaacttcttactatttcatttcaattctctatggctttgcatgttctgctccttctgcctagaatgctcctttccttttttcacctggaaacatcccaattcaaatgtcacctcccttatttataccaactttgtctgtaactcctttatcacacttcttcctgtgattagtcaattcacttgtctgctgttacacctctatgagagatgaaaattccttctccatctctggaactcatgcccttcgcatatagtaggcaatctgtaaatgtttgaaggttgagtgaattaatgaatgaccttcaacctttcaggcttccaattttctctctgaaaaggacagccaaatgaaaactcataattttagaagatgaggttagacggttggtaggtgcatgcagagaccagttattatttaggtattatggaagtttatagttcttgtatgttgagttcagtgtaagagtggccccaaacatagttaatgaccactccagacccagttgttatagagttggccccagctgtattgcttctatttaagactaggataagaaatgacactttcctactttttaccttattgaaagggtagaggctcactgttatcaatctcagttcacttgttgattgcactggcttgccaagtgagaatattagcacctctgcacatttctatagctctgccacttatgagatctttccttcccattgtcatatttaataatcaggatagccctataaaatatgcattctcatttcccagatgaggatactaaggctcaagtaggagaacttacttgtttagtaagatcatacagctaggaagtgggagaggcaagagttgaacccagatcttcctagctcctagtccattgttctgtctactgggtcacactggaccagccaggaggcaggaaaatcagctggggaatgtggtgccaacgtgtgatgtttgcctaaatgtgtgcatccttgctggaagccagccatgattcatgctgcataagtattcattaatgttcatttcatttatttggctatccatatgctttccagggcgaaggcaagctaggacaagggcagacaagcagccttaaagtttgggtgctttccttcgaagttgagctgcctgtttgaaaatcacactttttggtgatagaagatggttccagtacagattttatttattactgcatctacatggatagacattttccaaagcatagctgaaaatatgtgtaagtcccagaatattttctgatttagacacagactttgagcatgataaccacatttagcatgttaggaaattctgtcagaatgcttctggaaaggctacctttccagaatgaaatgaaaaaagaaaaggatggactttgaaactggctagatttgggttatacttactcatagtgtgaccctggcaaatgatttaacttctccgaatttcacttttcttattctttgaagtgaaattttaaaatgccatcttgcctgatttttgtgagaatgaaaatgagatcccacaccaggaatttagaagctactcagtaaatattgcttctctcctttccccttccccagtcctgtcccccgagacattcagtagttattcacaggcatgcattctgaagtctgcctactgctccatgttgaaatgcactgctcttgcaaggactgattatctatttttctgtcttccaaggccccctgtgttccactccaccctcccaattctgggggcttccaaagtgggcaggtacagaatgttctgtggagcatcggaggctgttactcaatatcttggccagcactctcaactgctctttgcacacactccatatgaaggcaaactccagatcttggagcccatgtgtgtgtcatgcattgtactgcttcttgtacccaaatccatctcaagggtgagtagaccaggctcagacttgtcctgggagcagatttctcaagctgcccatgtccccacactgtttgattaaaaggaggtgcttcaaactctttggctttatatagactagaatcagaatgattggtggtgcctctgttctcaaggtatcccaaagcactttgtaaggaaatatgacaagcgctgaggccatgcaggccagtacaacagccgccacccagcacttcacaattagtcatgcccagcctgggatcatcaagcctgtttttattggaagagcaagagagagagggaatgctagctggcaatttccccaggtaccctttatgaaagtgcccttggctcttccaatttcatctgaataaccagctcaggcaaattttcctctatcaaaaagcagaatgtgatagtgacaagctgatgcccggctgatgccccaggacattgactaaatagacttggcctcacaattggtttttattctctatctcctttcttcccttttgttctttttctgtgtttctttccccattgccatctgcagagtgttctcagtcagaagtcagctgtggggtggacagtttgtcattttaagatcatccctattctgtctacctttcttatccctcatatcattgcttttagagcaaggacaattctggaagtgaaactacaataacactctgggctcctttccctctagtagtactcaacacacttgtaattacatgttcaaatttgtctttcttatttctacttaggttcatgaaggcaagggacatgcctgtgttgcttactttctcttggcaggcacatacagcaagtcttcaaaaaatgcttgttaactacaaattaagtgtttaagaagtccactgttaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaagaagtccactgttagtatcttttcccctgcctagtttgtaagcaactggcctcttctatttgtaagttacctgttttcatttccatatgccccaaagcaaactttagctcacggccttacagagtgtgtatgttagtatgttaaaatgaaatcaactttcctctcccaggccttctaattgacatgaatttgggagtagacttgcattggcctttgtcctgacagccaacagagtcctcttctgttgtattcactgttgccttccatgaggatcccatggagaaagtttgtcattgatatacattttgagggcagactcaacttgagtaaacctgattgagctttccccatctgcctcccagagatcactgcctgtgctttgttaaaaagagaattataggagtcctctcaaggcagagaggcctaaaattagacatggcagccatgcctttggtgtgcatggaggttggatacaggcagccagtttcccctctgttttctcccttgcttacacagccaaggagtggagccaagcctcaaggggaggagctgtatactcgagcatgccctgtggttcctggccctgactgagggactattttatatatcccaatagagaagcgtggaagacatctaggttgccactgtcatttgaaattggaatttttaaaagagaaacctgaagacttgaagaaagctttcttttgcctccccttacagttgatttttgagcttcttaaagctacctagtccaaagtacccacactcttattcttttgtctttcctactggttttatttttttttcatcttcccaggtgtttgatgatcactaagagcttcaacattgctcaccctgaccaggtatgaagccaagagtttggtttagggcataaaagaatgtcggaactcaaggactaggttgaggtggggaagggggatgaaggcttctttttttcttgggttaagcagaaataacttagatctcagagtgaaagccttgaattatcacatatatcactggaaaagactagttctttgctatgataacaattgttcatcatctctcccctgaggatttggggtcaaggcctggctacaccttttaatgatttcagtcatgtgacttaacctctttaaacttggattttcttcatctttacaatggaaatgatgacaataatcactacctcacagatattgataataatgatatctcactaggaagagaattaagtaatatgagggataaaaaggcatttgtaaatggtaaaatgagattatgattttgaaagctattattattttcctttcactgtctattatctcaactcttctattttcttgccttttgtacagcatggataatttagatgtgactctggacagagggatggatcagatgacttcttaagttatcttccagtttaggagttcgtaaactatactttctcctttccagactatcctagtaagaaaattctcttttaagacagagtagaactctggaattcatcagttttgatgtttcttaaagtgtaatctaagatagtgctcctgtattaagttctgatgtctgaccattgttcaaataaagagtaaaatgcaaatgacaggaaattggctgcgttctgaatcctatttttatttgggataacaataagcctgtatggtcactgtgacctttgatttgctgtttctgcaacctcacacttgtctcaggattcttcttccacttctgcactttatattgggtttcttccaggcatcatattaaactttaagccaggtatgtgtatatgcatgggctgtgggcctgaaaaaaattagcccgagagagaaaaaaatttaagtagtgggctagaagtaagcatgctactagaaacagaatttgggaacacagctctgggcctagaaaagcgacctgtcaacttgttacagttaacatcaataactataggatgggtttggtggaaaattatgctgaccaacagggtgggagagaatagggtcagaatatatatcgctgtaaggttgagaaaaaaagaagtgaaaaaaaaagaaatgcatagagagaaaaaggagtttagaggtaacatgttaaagtgtgagaaataaactggagagcttgacttctcttgaatatatttttaaataaagtactcctttcaactccaaatgcagcaggcttggttcccttctcctacctccattgcggatgaaagcttaatctttaagatgggcttgggtgggtagagtacgccccttggtgagcactgtgctctctgcaaccccaataaggcccaacagggctctccaaggaggcaaaattctgatgatacatttctgtttagtggaaaatgggtagggaaaattatgtcttagaatcaattaaccaaacataaaatcctccaaggggcttggtaggatgcctagggaagagccacgagataaaaactccaggctggaagggcattgttgcagcactgtcattctccagtttctcttggagttgtcaccaccctctcctttgttctcactgctgacatcatttgtaaaataatttcttcccttaaataaacaagacatacaatcctctaaatgactaaagaacagttacctagaagaaaccttagtggaaagtattttcttcatctaacggatgattgtctttacagaggtggagtaaaggatgtgcgagggagcataatcaagctaagagatgcatgctgacttaaaaggcatgatatatgtgaaactaagataatgtgttcaagagtgatgctttgttgatgcagaaccactgaattccttactattatgtttgcctgactatcggcctcttaataaagaacttgtggtttgagtgttcattgaaattagccatattaggtttatgtggggatgtgaggatctatgtctaccaattgcagcctctgctgcaaattggaggcagaaatctgggctgaacaataggtaagagtgtcaactctacagatctctcacatgctaagcaagcacaatatagggcaatccaggtttacacaaaggattaatttgggaacaattatcctcattttcacttcctaaaaagattttgaataagatgtcttttaagtaagaagctccctgaatgcatttaaaatatgatttgattatgtacatttcagatttttctacctttctaggagtatctctgttgtataaaaacacaaaattctggaacttttgaaaggaagatgtgcctctcttcatacatttgtcattcttgaacgattgtaaaatgaagtgactgcatatcacgtcatgtgccctattgatttcttttcttgttttaggaatattcccagaaaaaaaaaaaacttttttttttttaaaatctactaagcatgctaggtaagactgaagatgaatctatttaagttatgtcaatatctatttataaagatttttgtgatattcttttcactgtagaacttcaagcatatcctaaaaggaacggttagatacctctacaaactgtggcaatgacttactgagtaattgctggcaactgatttttggtgcttcttgttttgatagtatagcagtgcgagtaggtttcagaagagcaaaactaagacaatccagggaaatgccatttgagaatttctaactttaaaaaaacaagtaaaatagtgccaagaatattatctaactaaccccaaagtctacaatgtaactcttttattttgataatgctgttctaaccctatctacttcagtcctttcccacccagctggtttaggaatcaaattcccaatgtttcatcactgttaacattactgttttactcttcactttagttcttaaatggcatagtgtcttaaattccctcagcctctttcacatttgatttctttggaaactttttaccttttcattgaagcccatatgatcttttccgaaacagacccttatctttacctccttctttggagtctttctcctacttgaatttctgaacttcttaaaatggccgctttgggttggtgtcagtaattcagtaataagttttcttttctttttttttttttctttttttttgagacagagtcttgctctgtcaccaggctgcaggctgtagtgcagtggagtgatcttggctcactgcaacctccacctcccgggttcaagcgattcccttgcctcagactcccaagtagcaagtagcagcaccatgcccagctaatgtttgtatttttagtagagtcggggtttcgccatgttggccaggatggtctcgatctcttgacctcatgatctgcccgccttgccctcccaaagtgctgggattacaggcgtgtgccagtatgcccagccagtaataagttttcttaagtgctttcttaatattctgatatttttaaaaaagatctggactattttgtcatacaggcaacagaatgttaaaccatttcataaaacaatgacaaatatacatgaatttttcatcagttataaatgcatttcctttataacattgaacatgtttttgcaactgaaataagtacggttttcatttttagaaggcacatgataaagttaaggcagtggttaattaattttttcagattaatttttcagaaaagtgactgtttctgtctattgtcttaaccccaggcatcaaaggattttaatcagaaagaaccgaggaataatttggttattttagtgcctttttttgagacaaagtcttattctgtctcccaggctggagtacagtagtgcgctcatggcttactacagcctcgatctcctggttcaagtgatcctccaacttcactttcccagctaactgggaccacaagtgggcaccacactctctgcaatttattttaatttttcatagaaatggggtctcactatgttgccctggctggtctcagaatcctaggttcaagcaatccttccacctcagcctcctaaagtgctgtgatttcaggcataagccactacactcaccctattttagagctttgtcaagctttggaaagaaaaccatttataatataatagataaattatggatatttgaggcagtttttatcatagtatacatggtaaaccacagcccccctttataatatttgtatttaataaaaatgaaaatattacttttatcttaaacatgttttaacaaagcaagcatatgtagattagcactaattaaaacaaaaacctttgtaatgatagctgttttttatatgattacaaaaaatttactatacaaatttttatcctaatcagtgtgaaaaactgcaaatattagcttatagggctagtcttcagagtcctcttcctacctactactgctaataagccaatgaaaaactctctgatgtgtgtggtggctcaggcctgtaatcccagcactttgggaggccaaggtgggtggatcacttgcactcaggagtttaagaccagcctgggcaacatggtgaaaccctgtctctactaaaaatacaaaaaattagctaggcgttgtggtacgcacctgtagtcccagctactcaggaggctgaggtgggaggatcacttgagcccaggaggttgaggttgcagtgagccaagatcacaggactgcactccagcctgagctacaaagtgaaaccttgtcaaaaagaaagaaagaagagagagagagagagacaggctcctccgctttttcagttcctaaataattttccaatctagaatgcaaaagattctgaaggaagacagttaccatttcagatcggcagaagttgtggctttaatctagactcgaatatgttttacatcaaagggttgcctcaacagtgctcaaacctgcctctctgaaaacatgctgagcacgaaggttacttgaagtcttagcttgagtacttaagagagtgctatggagggattgttgatgagagctgtgtcacagctaatttttctttagtaattaaaggtttataaaaatcttacactgtatattgacaaatttagcaacaaaatgagcttgagaaaaaaatcaaggcctgccatggcatctttgcttttttttcttaaaaaaaaaactttttagaaagattatgcgactgtattatctgtaactactgcaatggtgtaaatcctgatggtataatttgctttttaaagctatctttacttcagtataacttagattaaatttattttaaatttaaatgatatttttctctttgtttattattttataatgtttcccatagaattcacaaaattcattagaaagatttttttttacttccttaggtcattaagattctgatttgtcaatggatttcacataaaccctgtctttccaaaaatatacaaaaaaaaaaaaaatagccaggcgtgatggtgcgtgcctatagtcccagctactcagaaggccgagttgggaggattgcttgaacccaggaagttatggctgcagtgagctatggtcacaccactgcactccagcctgggcaacaaagtgagaccccatctccaataaataaataaacaaataagtaaataattttcaccttgaaaagcttataaatgtatgaaatcacaatgagggtcgctgatatagtttggatgtgtgtccctgcccaaatttggttttgaattgtaatccccagtgttggagatggggcctggagggaggtgattggatcatgagggcagttttttcatgaatggctcagcaccatccccttggtgctgttgtggtgatagtaagttctcatgagatctggttgtatagcacctccccccttgctctcttgttcctgctttcaccatgtgacatgcctgctcccccttcaccttctgccataattttaagttgcctgaggcctcaccagaagccgaacagatgccggcaccatgctttctgcacagcttgcaaagccatgagccaattaaacctcttttttttttttttataaattacccagtctcaagtattctttatagcaaggcaagaatggacttacacagtctcttttgtatcagggagagggtcttcttggtgactccacttcttttctttgtttatgtatccttccagatgatgtatttatttcctttgtttttcaattgatatttactcttaaattaaactaattatttaaaaaagcattttaaagtctcattttagattattttgactatctgatttttaaaatggtttaaaaaatctatcttggcctccatatgcaatcaaataagaaacacattttaagcatattatttaccttgtggattctgccttcctcagtgtgttcagtctgtgtatattcatttctcccacactgtaagaagctagtcagatgtataattggattatcatgctacataatcttagcacactcattttaagcatacatagactagtgagcaccactcattacatgtcatttctctagagaaactagttgggccatggctgcaggactctcacttgaaaagacatgtgtggtgatgttttctcaggcagttaagcaataaagtgtaccctgatttgcactgaaaataaagattcctttaaagggagcagttctagttatctctctctttaggtaccatatgctgaacgtttttctatgcactaaaacagcaactaggttttatactctgccttacagcctacttcacacccatttcacagggagaggaacagagaggtaagtgatttgccccaaattacataactaggaagttatttgctcagtgtggaaacttgttcagaaggtcatttcattgaaatgtaggaagagtttctggcacttctcttgagcaggagtcaaaaacctttttttgcactagcccagatagtaaacattttaggctttgtgggccatatgatctctgtcaaaactcctctacttcgttgttgtagtgcaaaagcagctatacacaatcctgaaatgaatgggtgtggccgtgttccagtacaaccttacagaaaaggcaataggctggatttggctctgagactgtagtttgctgacctcagctcttgaactgagctctttaactgacctcagctcttgaactatggtacaagatcccatggtcctgtttggtacctccatttgccctccttttcactctctgggagcatagctaagttcaaaattgaattaggtacttgtagtaagagcatacttataatcctgggatcttcatgttgccagatattaacctcttgaagtttttcaccacaacctgggcacttttctgatttgctcacttctagccccacctttgggccccttcataagcaaacatgcaggttttccagagagctgtatgctactgaatgcagaaaatttggctcatactggcctatggactatctgctcactgccctgataactattttccaagggagtgggtgccctacctttcctacatgaagttttttgctagtcttgccctaaaaattctaggtatcccttgcttttaggataaatatgtttcactgggaccagctggaaaacgaaaaatagaattatccaactaccactttaaaattggacaaagacttttgttgttgttgttggagggggtggtaaacatcattttagcagaccaaatatacttttggtgaaaggcagcctgttgcaaagacacaacacttggacaagattttgaagccctggttgcctttactactgacttaactacagtatttgcggacttgagcaagttgcttcccttctgtgagcctcaggttattcatctttgaaatgagtataatacctgtgattataattacttatctggattctgcagagaattgaaggagataatgggtgtaaaagtactttagcgcccagcactgctccttatgaaaatgaggaaataattgagatgagtgagccattgaggcaacagtacaaaaagtgctgaaaactcactgcttaaataagcacctcttactgcttttgtggcactttgtagcaatgtttttttttttttttttgagacggagtcttgctgtcttgcccaggctggagttcagtggcacgatctcggctcactgcaacctccgcctcacaggttcaagcattctctgacttcagcctcctgaatagctggattagaggtgcgtgccaccacgcccagctaatttttgtatttttagtagagacggggtttcaccatgttgatcaggttggtctcgaactcctgacctcatgatctgcccgccttggcctcccaaaatgctaggattacagatgtgagccaccgcaccccacctcagcaatgtgtttttattctgactagaaaagtaatgtttggttttgtttggctctttgcttaatatacccataataagggtacctatttgcctttggaccattagttcaaatattattttattaatatggaattactgggctccagaagccatagtcttcttagctgctccctatccccactctcacctcaatttttttttttcacttttgtttttcttctcagggaaaggtttgaggcaaagaatgtcttcttatgatccaaaaccaagcatggtggtgatttattcaccaagagattcctaagtacctgtgtgatggacatggtagaatctttgtcctgagggagctatctagatccattccttctgatatgcagccagtagccacttgtggtaatggagcaatagaaacaacactagttcaagtggaaacgtgagatgagaagtaggaggtggagagaactaaccagaagagggtacccaaataaaccagaaatatgtatgtgttagagaaggggcctattgagcgggtggcagtggcatgtgtggcattacttgctcctgtattctctgctttttacttagttgtggctttggtggtatagtctcaaatctaagttacgtaggtaatattgttatgtatcatgttttggcaatgtagactaaatacttgctcataagagtacaggacaatgaggatagtttggttttgtttactgcatggaaaatgcaggatgtttagtaaatagattcatggcgtagtgagttcactactaaaatcagactctgagaatgggtttgatttaaatggctagtttagaagactgaatttaggccacttgattgagaaaggccattttgggtaattataaaccaccaacattgtgttttgaatgttaaagcttatatttgtcttccagttaccagaatgtaagcttcttgaggagggagagaggagttttcttaatctctgaacctgcacctttcttctgtgcctagcccagtgcctggcaccaaacaggtgctcaatcaatgttgattctatgctaccaacaaaaatgagtccatgatgtttactattcaacaaatgaatacaattttagagtaaatttttactgcttacactacatgtagattttctttttagagatttcgcaatgctgatttatttcaaaataagcttgaagctaagcgacaaagctgaatgatgatttgttttttatttatttttaaatccaaacttacaattttacatgtcattgccagaaaaatcattaaataaattatgatatgcgcatatggaatactttgcaaccattaaatcaaccattaaatactatgcaaccattaaatcaaccattaaatatgttggtatatgcaaatgtgcatataccaacatattatatagttgagtaagaaaagctagtttcaaatgagtatgttaatatcatctgactcttgcaaaaggaaaaccatacatttgaatgtacatatatgcatatgtttatatgtgcatagaaaaagctatgaggggatatacctcaagttgctaaaagtggctccacctggagagggacatggaaaggagttggctaaaaactgaggtttgttatggtatacacccctgcacagtttgattttttaaaaacaatgattataaattacttttattatttataaaaatattatttaaaattttggtactaaaaacagagctccatcaacaggtcaatggataaagaaaatgtggtacatatatacaaccgagtactattcgtcataaaaaaatgagaccctgtcatttttgcaacaaaatggatggaactggaaattattatattaagtgaaataaggcaggcacagaaaggcaaacattgcatgttctcatttaatctgtggaatctaaaaatcaaaacaattgaactaatggatatagaaagtagaaggatggtaaccaaaggctagaaaggatagttggtggggcaggggagggtgaggtgagcatgtttaatgggcacaaaaaaatagaaacaatgaataagacctattatgtgatagcacaataaggtgactatagttaataataatttaattgtacattttaaaataactaaagaggtataataggattgattgtaacacaaagaataaatgcttgagggatgtatacctcattctctataatgtgattagtacacattgcatgcttctatcaaaaattttcatataccccataaatatatacatccattgtgtactcacaaaattaaaaaaaactgtgcattaaagaaaaacaaaaataaaaaccatagttcaagttataaacaaaataaaggtaatttggaggaaaactgtcttcagttatattggatatttgggggacatttttgtatgttagttagcaaagatcacttgaaaaagaagattcttccttctatgattcaagggagcctagcaaaaaataaatgaaatgaaataaaataatacaaagagaaaagattattccataaattctgcttacttatttctggcaaacttgttgacagcacatgtgaccttttggtaaaaagacatttttatatttttagttaagtttcaaatataaattgtttgtgtttttaaaataaattaaatggatgatttcagccagatcattatgaaaacacatgagatattgggttatgcaatgactaacagtgtgtaccttttcttgatatttattcataaactggggaataaaagtacattttggcccatttactccttaaataattttatgtctcccaaggagagttgtaagttgcttgatagtaaatgctatgtattttgtaccttagtgtatatattatgggatttcagcgttagaagagctcttaaatgccgtgttcatagtccaacctgtcttctgatgcttgaaatccccttgcagtaggaaatgcaaagtagagagcagacactcaataatgtagttagtgaattatttagaaagaggcattttgagcccataatgtatgataggtacttctacatttattattttattctttgcagacctgcagaaaactgtaagaaaaaagtttatttcagattcatgtgtttatttgattaatctcttcataggtttcatttttcagctcctgtcagaaaatacagattcttataaggttcaccttttacccataagaataatagtataaaggggataatgtgaaatacaatcacttcacagactgtttcaattaaataagagctcgtagataattcagtccaccacaccccattttacagatgttgaaattgaagcccccaccaaaaggaaaagacttgttcaaagtcacacagcaagtcagtggtgaacctaattaggccccctgccttccattttagtgagattcctgtgctgatagtcatacccatatcaaatcctctttggcagttatagcttgcccacagtaatgtgtcctgaaaaatatgacaattaattaagttggagacagaaccataacctctttataaaaattttctggaaagtttacatgacagtaagtaatatataattagaaaggataattcttatttcatatttatctttttgtttcagaataataaactaagctatctctactcagtccattttaatacaaaaatatttttacccggactgagtttttatgctttttaggaactttgtatctgcctcacttagttaaaatcctagctgcactaatcacttactgtggtgggcagaattctagaatgaccctgaataccttgtccttgtatgattccttcctctttaagtaaggataaaaactgtgaatatgatatcactcccttgattaggctttgttatatggcacagttaactttaagaaaggaccaatcacacaagccatttgaaagcagagggtttgggtattttttaactggtggcagaaagccacgcagagatttgaacattgaggggaatttgaatttgatgtgccagtactaacttgaagatagaggaggctgcatggaaagtggcctttaggagtgatccctggctgacagccagtaagaaaatgagggcctcagacctacagccataaagaattctgtcagtgaacttgaacttggaagtggattcttcctctagaacttccatataagagtccagcctgattgacaccttgattttggacttgtgagaccctgagcagagaatccagttgacttctgacctaaaaaaaaagtcagataataaatgagtattgttttaaactgctaattttgtgataatttgttatgcagcaataaaaaactaatatatttaccatgcaaggcaaggcatttatcctctcatgattcagtttctttttacctgacataatggaattaatttatactgctgtgaagttgtagttgagaaacatgacttctaaagtaatagaggacatgtattattaattttagtagtattaatagtaatgatactgattctcccaggcctatacaaatcctttgatacacaaatgaatagtaaaggaacataaattgtctctaggtagactttcccacaatgcaattttaggatacagaggtcatatgcctgttattctactgtggcagagaaaatatggagcctggaaaactgttcatttgcatcacatacatcttgggagctcactctgaacctggtaccataataagctctgtagacagtataaagaggaaaggaatcagacatggtgtctgacctcaagtgtctcataacgtagtagaagaggtaaaatatgggtcacactaactctactgcaaagtaggaagtgcttgtcgccttgagattgacaaaatttggtaagagttcagaggagattgtctgtgaactgggccttgaagaatagttaggatttgaataggagaaggtgaagaaggaaggcattccagctagggagaagagcacaaacaaaagcatagataaccttgaacatcatcatatgggataattcaatagttcagtataatggaagtataagatgcataaaaataagtgtagtaggaaacaagtttaaaagtatagattggggttagtcatacaaggccttgaatttcaggctaaggagtttagacattaacatttgtttttgaacaaaggggtgaactgatcacatctgtgatttagaaagaaaattctagcaatagtgtagataagggttgatggtaaagtttggaaggtggtgaggcagaggctggagacagggagcacatttaggatagaaagatgataaagagatgatttagaagagttgttttggaaaaggagaagacagaaaatgttttagaggtgtcatagagataaaattggcatggcatggtgcaaggaggtaaagcccaatagctttgtaaggtgctgagatagattgaaatcacagagttaggaagttttagagtcaggattagtaccaagacagcttggctctagatctcatacttaacacttacagtataattctgagagggtgggtaacagcaatagtcagaggaaagaacccttttatacatgatggtacaggaacaacactggcttccaaccccacagctgctctttaacagaaggtcagaagctggggagaaatatgtgtgtgtgtgtgtgtgtgtgtgtgtgtgtgtgtgtgtgtgtgtgtatgtgccatttctgggactaaggatgggaagtagattagttgaggccactgcagtggggtctgcaagttgctagcactcacccgttccaagaggccttaaaggtgttgatctgttccctgggcatcaccacattccacaaattaatgttcctctgagagaatagggtgattcaatttcactgtgcccgaaggttacttttggggttcatgtttgttctaagtctatgctaatgatctgccaactgtctgtttgtcactttctctaacccttagcatgtataaactgatctgttgggaaatgtgtagcatttataggatggtaggatttgtaacatgcgatcacaggactgtttatatagagtccctgggaaggggagagaagagtatttctgttacaaatgtggattctttggcccctcctcaaacttactgaggttcaagaattgacatttataataagcacatatccattttcaataaacatgaaagtttcataccctcttttaatgtttgaaatcctcaaataaattagtcattggtgccagagtatcaaataattatggtacagaatgtatttctctgaatgacaccttctcccagagattctgatatatattcctctgcactcaccctgtttgataattaccagtatatggaccatttacctgaagaataagagtagggtttcctactgttgttgaaaatttgcttgactcttaacaacttgtgtgtgactgtaacaagatcacacagggtaaacaatattagcttattcaaccactggctgaagaaatttaggaaagtgaacacatttttctttacatttctctttgttctgtgagccttttatgctggaatagttttcactgcaggctgttattgtctgcctccagaggagggagttgacctagcagtggtaactggagagtgttttttgaaacctctttccaaggttagttgccaatggcatctttggaacagtgtccttcacttttgtccctcagggaccagtgtgagaatgggaactttatgatctggagctggttaagtgaagtccaaaaataattaagaaagtgtttccttccctgggaatgagttcagtaggaatctcaatgtattgtagagcactaaggactcagcctcaggcatttgcaaaggattcttccagttgcctgtgttacagaggacacagttggcatttccttttggtgttgaggggagatgtgtacatggttgtgagatgactcaccctttttgcttagatagttccactttcattgtggacagactctttggagggccagtttggcatgcacgtgtgtgttcattccatcctggagcattctttatgagaaagccatttgttgagtggtttgccattttgttttacagccactctgtgggctatgaaatggtcatccggccgctttatttgtccctaaaaaaagcagtttttccctttcttatcttcatggctgccaagcagcagaaagagtaactcagggaagccatgtgatagccttttatctgtctgttcagaaactgatgatgtattggatttgataattcatcaaatctgaggtttactggtttgtatttgcctcaaaatgggcatataatattttgtcaggtaacataatagacagatcattggcattgctttattgaagtgaattaattcaataagcctgtaagtgcctgacatgtgccaggcactgtgctaggcattctgttaacagatgagacaaatctctgtcttttaggtgttttcagtcgaacaggggagacaaatatatgagcaaattgctattttttttaaatttcatagtgtacatgagtataaggtgctgaatatgtgattgattctgagggaaaagagagataagggaaagttctcagagaaagtcaagctgagggaagaaaagcaccccagacagagggactagcatagagctatgctagtacattgagtttaagggaatggcacatacttcactgttgcttcagcagacagcaggcctgttaggttacaaagggccttggatgacatgctgaggggttttaaaattttatttaaattttaattgacaaaatataattgtatatttctgtgaggtacaatgtgacgttatgatatatgtatgcaatgtagaatgattaaatcaagctaatttgtatatctaccacctcacatacttattttttggttagaacatttaaaatttattctcttaacaactttgaaatagacaacacattattatcaactgtagtcaccatgttgtgcagatctcaaaaacttctaacaaaaactttttaccctttgaagatattgaactgttttatgaacacaatcttagaaggatttaaaaaataatttgctattcaccaagtacttcttacgtacactgtgcatgaaatgattattactttttctaatattagttttcttgattgaggcttggcaattattagtttgtatgcctttagaaggatcataagcagaggtttatcccagtaggatttgcattttagaatgatgactttgggagtaaaatacagagaagtgaaaccagagatagtgggatcattctggagtctgttgcctacactgaacagtagttgagcgaaaaaggatgggcagaatgtgttggttctgggtattgcaaattcatggcacttgagtgaaaaagtttaagccttctattggctctttgtgaatatcttcaacatgcatgactacaaatagaacacatggttttgttgttattgttgttgtgtttttgtttttttttttatttgagatggagttttgctcttcttgcccagactggagtgcaatggcacgaatttggctcaccacaacctccgcctcccaggttcaagcgattctcctgcctcagcctcctgagtagctgggattagaatcatgcgccaccacacccggctaattttgtatttttagtagaaacagggtttctccatgttggtcaggctgtcttgaactcccgacctcagatgatcctcccacctcggcctcccaaagtactgagattacgggcatgagccaccgcgcccggcccacacggtatttttgaaagaacagtgagcttggattagaacactagtgtccaggccctgctgctactacataagtaattatgaatccatagccatcttgttgctcttcttctctgagccttggtttctttagctataaaatgggaagttgaaactttctagctacttctttgagttatgagtaacaagttaggtaatacacttaaaagagaatgtgctatacaaatactggttcttaagacagctgttgttaatgtactgagtattatgcttacctcacagggttattgtgagcatcaaatgggataatggatttgtaagcattttgtttaaagtgtgattcaaatgttaagaattagtaaaaatagtaaaagaacaattcattctccatccagatgttctgtccccactgtgacttatgtgctcattcagagttgtacagaaaaacctccacttaattttcacaagctggagttccacatgtaacagaatcatatgggaccaaaaaattctctgtattggcttcttccctgccgtattttggctctgggaccaacaagacacccattttgcatgagctgcctgccaccaactttgcgctcacatctagttctgttgcccatgtgcaagctgaatttgggcccgggcccccagatctaacatgaaactcaagtttccttctgttcaaactgtccaggcataatagtcttaaagtccgatgcccagcagagccgtagatttttcactggccaaaaatcaacatgaaaccagatgtatctgtaaatctagtttcataacactttgtagtcaatggaaatacagtagcaggcagaccagaccagagtttactatttgcagtggaattaataaccacatggaaactttgcctttggtatctgcgagatggaagataaaggtgcgaattcaaagcagttcccaccttaccctctaaattccaacataaagaggccttgaatgtccttctatcttattgtatatttcattaacagaagtatgttcctagctacttagtcattctatctctattctcctttgttttaacttcagtggtgccagcttaagatgctctggctttcagctttcatggagcacgtcatgtttttaaacttatctttagggacagaaatgttaggaagatcctagttcctcatctctttgctcctgacaaggaaatttagaattgcctaaagaaaggatgtattggccaacctaataataaatcagtattagtgaatctaaagcatatttgaaaaatttgtaacatgagttgaaattcagacctgcaatgaagtgtttttaaaagatttaaaatcgaaataatataaaagaatgttaaaaacaagtaaaacatatcactagttaatcactctaccaaaattcatttttatgtttgcatatttaaccatttttattttctatatttgtccatgaacatgtgtttttatatattgtttatattaaacatggttttaatcatggcttatttcttttatgttttacttcttttcctttgacataaaatattgtattttttaaattttaattgcttcttggcatacccttccaatattggtggctatatagattgaagttaaaactaattacaatcagagaaaattaacaattcatcccttcaatctcattagtcacaagttaaatactcaatagccacatctatctagttgctactgttttgaatagtacagatataagacattttcatcaacacagaaaattcacttggaaagcattgccctggagtaaatgtgccagactgtactatatcatttttctcttgttggacatctaagttatttcttattttttaaatattttatataacttgacggtgaatatacctatgtacatagctatttgctttggctgaattatttcttagaatcaatttcaaaagtggagttattaggtcaaagagcatgagaagattttttggaacctgcagtgtattgccatagtcctctcaaaaaagtttatgtcaacttaaagtacttctagcagcatatgattgtactaatttcgctgcaatctcaacaacactggacattataagtttttattctaccctattttccattaaaagatagcttatgcttgattgactttgcattttattttattattaataatgatgtggtttccttttttctagattttatttttatttaaggcatcctttgattttaacctgattttttttctctaaaaattattctaagaaaagacaaaggtgatacgaaatatatcctgagtttttatttttttcttgcatgggatttgtatatttgcacctttgcccatttatactatgatttcttagtgtcttccctggcaattttaatgaagacttcatgtatatcaatttttccacaaatataatctttctaaaaatatgttttttccacaatataattcagacgtattctccgaaatgttggaaaaacttaagtaggcatcaaagcatttgaagatttgtttaaaggttgtttttataccagttttaaattgtaatttaagggtcataaaataggtgaaaattaaatcatttttcagtaagggggcaagaccacttaactcttggaaaatacaggaaacgtagatttctagaggccaagaaggaggtagggattattttgtaactgcccccaaccttctaacctgtaatgaaacaaacactgaaggcccttaaacatttttaggcttaattggctgtccttgtacttagggcacatctaaaaatcctgaggcaaccactcaagagaacatgcttttgttaattcaaagggagctgtcctacgagtgtccagaatcctctgtagtcttgggcctggtgcttgagagacccaaaggaaaggtcaatggaattacagcttagtgttagagctttcatgcatcacactaattaattaatgtcataaaggtctctctcctgttatgggaaaaagcagcaaataggaacttctggtagggtgcttaaagttggtttgatattttttattagcatttttaactaatacaagtaatacatgcttatggtagaatgataaaactgaaaaaaaaggtatgaaaatttagaagttctcctactcatgacctcaccccttctttcactcccagtttcactcctcagagggtaaccacagtgactagcttcttgtgtttggttcctgagattttctatgtatatatattgttagatatatgcatggtatgttttcaaaattcctgttacactataattactgttctacaacttaattttttcacttaattaatagaccttatatatgcttttccatatcggtatatatagatctatataagttttcttaaaggttgcacaactttcaattgtatggctgtcttgtaatttactttttgtttcccttactaatggatatttcatgtttccctaactcttttgatattaagagtagtgctgcaattaacatccttgagaggcagtatatatggtgtttaagatgaatggttctggagccagactactttggattgaatattggtgccaccaattccttgctgtatgaccttaggcaagttgcttaatttctttgcctcagtgtccttgtgtgaaaaaatggaggcaataatggtcactatccagtagggcttttatgaggatttagtaagttaataatgcactttaagaacttagttatttttagattaagtagtgaaggactatataattgttagtataattgtatacctttattatcatacttttgcatgtatagcaataagacaaattcttagatgtttaaccattggacataaggaatgtacgcattttaagtactggtagatattaccttttccctgccaaaaattgcaaatattggatattaactttttaaatcttagtaaatctgataagtataaataacagtttatcatcattttaagttgcctatcttaattttgtgtgaaaatgattatcttttcacatgtttttttggccatttatgtttctttccatgtgaactaactgttcctggccattgcctatttgttgttgctgttactatatggcttttcatctgtttcttattggtttatggagctctttgtatatacaggaatttagcctctatttatatgtgtgacaaatactttttccaatttatctttaaaatttgtttatgttttcctattcatcagtctaaaattatgtagttaaattcatcattgttttttcttatgactttagagtttggagatcatgcttcaaaggtctttctaggtggggatgatttaaatcatgtactggaagtatttttgccaaaaagactcacgaattatggatgttagagctaaaagggaccttagagatttcctagttcaaccaccttttcttcatacctttttaatttttctctgcagatgaaaagaagtttagtcctaaagaaagaaaagagtctaaaggttctccagtaagctaatggcaaaaatgtagactggaacttctagctcctgatgtgtatttcagtgatcattcaatttaaccagatggtttcacaaaaagagctttctactaaaaaataaaatacatacttaagcaactcagagaattttttttttatttttcagattaattttcacttagagattcatcagcatatgtactatacatgtacaaatcacctgtgtgttttggatatttagttaaacaaatgtgcaaatattttaaccaaaggagcatattcatttgtgttttattttcttaatggttttcgttatgaatgtgaaatgtgtatttaccttaacagaaattaagtatatttttggtctgacatatatgagaactgaaaagcattggcttggctgctaactgcattctcatctttctttctctgctttggcaaagtctgggattaaatctaataccttttaaactgtttgggacttcagccagagtgacctgtcttgaattcagaactgcgcagatcattccccattctaaggccctctcatgcctcctcattgcctgtaggatgagatccaagtaccttagcatagcttatgcactgtagtcacttgacctctagcacctatgcagtcttccagtcttatttacacattcctttgcacatgctgtttccccgtgtggggcaacttttttcttgcctgtctgcctgcctaagccaacttaaataaacatcatttctgtaacttctgtgaagccttttccaatctctccactccaagacgaaggtgtttctataggcatgacttctggaatggcagatcaaggatctggtggaccctctactcagtgaaacaaccgtttaactagtaaaaatgatcaatcaaccatttaaaatcttcagaaaatatcctaagggcacatagcaaaaagagaaacatttattcaagaaaagctattaagcctcagtaaaaacagcaagagtctatggcatttgagtcatgacctgttcctaatccttcccttatctccattcttcaggcaagtgcaaccaagaagatggaggcttcctctctctcaaaatcttactccatagttataatttcacccacaatggggcagaccacaagcatctcttttttttcccccagccctatattacagaatcactgttctaggaaggcatagcttagaggattggagattccttccacacccactttctacgtatgagggctttgccccagggatggtaagtcaagaatacagggatcctgcttgtgcctgcctcagctcatatataaggtaaagcttccacactaggaaaggcaaattaagaggactagggaatataccgttatccccagggtccacttgtagaacaggggtgtcattctgggagaagcaggtcactgccccacttgtggaacaggggagtcactcgtcactgtccctggttcaaattctattgcagtgacagaggttctgtcccagggaaaggcaggttgttaggatggagaactccacagttctccctgaggtgactgactttatttggaacagagcatgaagaagttcatgcctaagggcactgtcaaaaataatggagatcttggtggtgagcaattaagagtggattggtagctccatgatactagtaacaacaagcaaaacagcagaccagcatggaggataccagagaaccagacaaaggaatcactaagaagagcccttgtggaattgcactcactgctgggtgtgtggaaagttatgcatgtgtgctttactgtaccctctcaaaagcaacctaaacaggatgtggggtaggctctaaagcattcctcaagccacacatggatccatcagtaaaatgtggagggcttaaggataaaaaggcttaagtacaatctctggccctacattttctaaatgttatgccaccctgaccaaggggcaactcctacaaagccaggcaaaataataaaatcatatttgtctctagtggaatggataactatgcctaaaactgtgccctttgaaaagcaactagagagataatttctgaagtgtttgtccctacctgaatgtgtggcaaaattctaaactccctgaagtgtgaaagtggtttccaagccacatgcacatccagtagtggtaaagggtgaaaatctaactggctaagagggcttcatagcaacattaaccaaaaagtggtttatgtagtctttgcctgcttcataattccctaggcattctatgctattctgtactcagaaggcttaaagtcaggttagggaaaggaggcctatgaggttactgtgcagaggcagtgctgggaaataaatgaagttaaataaatttaggccatcgtggtttaaagaatggattgtggagataagaaggataaaggaaacccagagtcaagaaaaataaaacttttcattggtgccatgccaacccatatccgagcctgaggcaaaaggaaaaatgtgctccctgatatacacttatacaaaatatcaactaattttatttgttggactgaatagaaaaagtcaacaaaaattaaaaataaaaaaatcatgactatatttttaataagtggtttatgtaaacccagagttgaccaatgggatgccagtctcaaccataaaaacaaacaaaacattgtgagtaacaacaccagaagtctcaaagtgtcagggaaaccaatttcacagaagcagttcagccaagtcactaaacaaacaaacgactaagcaaaaaacaagaatgagtctcagaaagggtcaagtcagtatccagagttgttacaatatagtatctaaaatattgttttgaactaaaaattttgaggcatgcaaagaatgaggaaagtatgactcatacatggtattatatgaaaaaatcaacaaaaaactatccatgaggaaacaaagatgttgaaattcactagggaaagactttaaaaaccagctatttaaatatattcaaagaactgaaggaactatgtctaaaatactaaaataaagtataataacaatttcttgtcaagtagagaatgccaataaagagatagaagttataaaaaaagaaaaaaatggaaaatctggagttgaaaattataataactgaaatgaaaaattcactagaaaaggtcacaagaagatataacttggcagaagaaacaatcagcaaattagaacatagatcaatatagattattcattttgaagggtagaaagaaaaaaagaatgaagaaaactgaagattcccaaagaaatgtaggacatcttaaagacacatcattaggagaagaaaagaagggaaagaaaagagcagaaagaatattttttaaaaaatggataaaatcttccaaaatttaatgaaaaacatcaacctacacatcaaagaaaatttttttaaaacttcaagcaggaaaatgtaacgatattgatacttagatacatcatagtcaaaatattggagtcaaatataaagagaaaattttgaaattagcaagagaaaaatgaaatggaaccacaataagattaacagctgattctcatcagaaataacagagagcagaaggcagtgcaatcccatattctaaacgttgaaagaataaaaaaactgtcagtcaagaatcatatattcaacaaaactatctttaaaggtaaaaatgaaatgaagacattcctaggtaaacaaaggctgagagaatttttcattagctgacatgccttgcaagaaatactaaaagcttcctagacagtagctttaatctgcatgaaaaaaaattccaataaagggaaatttgtaaataataaaaatacatcattatatattcttttccacttaacttatttaaaatcaatttcttaaagcactatctgtaaaattgtattgttatttgacaataaaatgtaaaagaggggagtgggaattaagctaaattggagtaaggaaatggtatcacatggtaaattgaatttacagaaagaaatgaaaaaattaagtggcaaatatgaagagtaacattaaaaacttctataaattaattgtggcctcctttcttcccttagcttctgtaaaagacataagactattaaaaatgacaataattataaacacattgttttattagtaataaacatagacaaattatctacaacaattattattatacaaggagagggaatggagctgtagaggagtaaagtttttataacctactggaactaagtcagtataaatatgatgtcgattctgttaatttgagatatatgttagaagccccaaagtaatcactgagaaaatgatgcaaaaatacagttttaaaaagttaaaaacatagtttagcttatgtgtgcctagtactccattattatttttttattatattttaagttctggggtacatgtgcagaatgtgcaggtttgttacataggcatacatgtgccatggtggtttgctgcacccatcaatccgtcatatacattaggtatttctcctaatactatccctccccctgtcccctaaccccctcaacaggccctggtgtgtgatgttcccctccctgtgtccatgtgttctcattgttcaactcccacttatgagtgagaacatgcggtgtttcgttttctgttcttgtgttagtttgctgagaatgatggtttccagcttcatccatgtccttgcagaggacatgaactcatcctttttatggctgcatagtagtccatcgtgtatatgtgccacattttctttctgcttgttcccaggagaaagtggctgaagattccagagagaagctgaatgcagtttaattctttttgccataaacacgacaacccattttcctgcaagctgtgttagtttgctctcttcttggttcattcattcatttattcatagcttccataaatatttaacaaacactaattaggggccaagccatgtgctaggcacaggggataaaactgtgaacaaaacaagccccagctactcttaaggaactgatagacaaatggaccagcaaacacgctggtcctgttttgaaggcaaagcgcctggtgctcctgatctcatgagcacagagcatttagcctaagtctcatcctcctaaggcctcagaaataaggccttattttaataagtgcaagtcagtcatttgaagactaaatcatagaatcctagaaaactagtaccgggagcaaggcaaaagaatgggatgagcatgaaacatatattcagaagttgtggtgtgtaggtatataagccaagctcttttcttcacttgcttgctaagtcacttagcttttctgcctttttgtttgctctgtctggaaatggagttaatgaaatatatctacatgatagggatattgagacgattaaataagatgctgctgtcacccagtatgcccttaccctgctgtacttagaagtatatgaaattcattttctaaatttttgtatgagtgtttcatgcatgcccaccaccatggaagctaccttaagacagtgagggactttgtttaacttgtttgtactacatcctcagtctaatggtgtctggcttatggtaggcaccaaatataattttattgacagaaaggatgataatgaatgtgaaggcatttttaagtttatgaagtgttgtgcatattgttgttaattttaagctgttacgttaaagaacccctaatccaactctcttgagttttatagatatcatagaagatatatcttcccttgacatagaagcttcccttgaaggttcccttgactcatgtatttgcctcacagtgattgtgcagatcccacaagataaatttatgtgaatgtgctttatgtgcttgaagtgctccacaaatatgggttttataagatgagaaaatagagtcagggagaaaggtgactgatccaaggtcatgcaaagagttagtgtcagaatttataatggaatttcaggctcccaactcccactccagtatactaaggcagattccagagaagaaacagtggagagcaggcactgatgagggacaaagaaaagcaggctccgtctggctgcaacttgtctcttcatggcaaaaagaaactaggaaagtgctatgccagagacgacatgataactttgcagaatggaaagagcttgtttaccacattgaatactttatctgtgtttatctaacgacagttccaccagctctttaccacttgacttttgcctaattcaaaaatataccaactatgaaacattttccttctcagtttttattctagattacattttgttcaactttatcttaatgtgtagtgtagaaagagtaaggtaagagtatagcaagtggttattttccatttctactgaggacagagaaataatctaagggatttgtattagagatgaagaagtgcatggccaggacatgagagatactgtgatagaatggatattgtgaagtctttggtagtttttgaggggaaaaaagagaaggttttctttgtctgatatagtttagcaacgtcttaatttaggattcaaaagttgttcagggtccatcttggccttcaaattaagatgccctttgagagataacattgttgttttcaaactctgttctgtgacttaagaatgagaggagaaggaagaaaagaggagaaaatttgagggaaaagtgcccaagcagcgtcaaggctagacactggaaatttatcaatgaaagccacatggtggatgggaatcagatatgtgcatcaattatttgtgttccaatccatatagaagtaccgtataatgcaccaagctaataggtgctttgaaagaagaccatacaagtggagatgtgttcctattctatctagggatagagtcaggaagggcttcattgaataagtggtagcctcttgggctgagacctgagttatgagatgatgtggcaaaggagacagatggctgggggcaaggtggggtcattgaaattggaggcagtagcaatataagcaaagctacaggggcatgaaaaagcaaggttagattagtgaattgcaacagggtggtactgctggaaggtcacatggaaaagattgtgaaggtattgagataagaagctagaaataagctttgaatgccatcctagtactttgaatttgcatgctgtaagccaagtggttttcacttggtcatttaataaaattacagattctcaggtctcacctgtaacttcagattcagaagagtctgctaactgaaggtggaatcagtgttccatattgctaattagctcctcagaggattctaatatatcagtgagttatgaccactgctgtaagccataggtagttattgaaagctgctatggagaggagccacagaagcagatgttttagataggattcctctggggtcctgtgtaatttatggactggagaggatcagacaggaagcagaaagacttgaataagacagttgcagttattttggaggcaaagattctctctctctctctctgtgtgtgtgtgtgtgtgtgtaattgtaggaactatttaggcagtaaaattaacagatattagtcactgattgactgagtggatggcagtgataggtggggtgcgttgagggaagtgtattacattaagtccaggatgactcatggttttctaagttgagtcattggggattgccatccaatgtgagaaactatatagtcttatcatagttgatcttggaggtagacttgaattaaaatcttgaagccatcaattgctgtatgtgggtcttgggcagaacacttaaggtttctggacctcagttatttcttctgtaaaatgaggaaaataatgcatacctcatgcatttgttgtaaagactaaatgaggttaaagtatgtagagtgtagtttagtaactgggacgtatagtggtccagtaaacatcagctgttattattgtgctatatgttgtgatgtgtactggagtgagatggggtaggggattttttagtctctgccaatgactcctctccccatgatcaaaatcagaaaatcagtctcttatgtgttgaggagtgagacacttctcccaagtgtttaaggctaataccttgccttgttttgccttgggccagacctcactacacatctgtttaagagatcagggtaagctctgttcttggtgagtatctcaatggggctgtttttctagttcttgtagtttctttgggccaacatgaaatgtctaaccttggcttcttggttgtggattctcgtcaacatttcactgctacccaagttgtgtctgcttacatgatgctatcttccttcttttgggtttctgaagccctcagacacttggctgaacatttttcacatttcttaagctatatcatctgtgttttccctgccacagacaaagtcacaaaaggactttaagataggttttggttttttttttccccagggtttttatacattttgggtaagggcaagtggtaaatgctgcttttctgccttaaccagtagtgtctgacagaggaggtagcatgatgattgcagagctcactggactgaaagtcagatgctttacccgcctagactctagtaccaaggggaagatggagtgagatggggtaaatggggagaaattaccatttattttgagtgtgccaggccttttctcatgtattgtctaatgcatttgtcacaattctctttgggtttgaaatgtgattttcttcattttatagataaggaaacttatgggaagggaggttaggttcatcttgtgcccaactttacatggctagtgatcaataatagtgagattcaaactcagatttctctgccccaaagcctttgctttttcctcttttgacactgtaactaatgagaagatgtatttaactctgagtctcatttgcctcaactgtaaaatggagctctgtaactcttgctctgtatgacagtaaatctcctcagaccagacttatgataggggataaggatatttgtatctttgggcccctaatgtattgaaagtgcttctaagtgcctggcacatagaagggcactcaataaatatttaccacattttccagaaagagggtagctccataatgggtgagatacattttggtggctactgtagtgtttaatgcttttaccatctgttaaaatgattttggagtatagctagataactgatgatggttgttatatagattttttcataggttgcctgttccaaattctatgccgtggaagaagttaaatatccagaatttgacaggaaatattattctacaacagatccctggcgtaagaatgataacacctgtgttctagtctcagacttgcctctgaataactgtttctcctggtcaattctctgtctctatctaggcttgaaatttcccccaaatgatgaaggagttggactagtttagtggggttcagcctcgagtggccattaaaattatttggggatctttgaaaaaaattagatgcccagatttttgtcgttgttgttgttgtttttgtttgtttgttttttaattatactttaagttctgggatacatgtgcagaacatgcaggtttgttacataggtatacacgtgccatggtggtttgctgcacccatcaacccgtcatctacattaggtatttctcctaatgctatccctccctagtcccctaaccccagacaggccctggtgtgtgatgttcccctccctgtgtctatgtgctctcattgttcagctcccccttatgagtgagaacgtgcagtgtttggttttctgttcctgtgttagtttgctgagaatgatggtttccagtttcatccatgttctttcaaaggacatgaacccatccttttttatggtggcctgatattccatggtgtattgaactgctcactccagttcaattaaatcagaatacagaatgttgagaggagcatcagtattttaagaaggccccctagtgaagttcaatgtgcagccaagggtgagaaacactggactagatgattgataagggccatccaactttgatagtcaacaagagacaatgctatagagtatggtggacagagcatgggctttagagttagccaggtatgcattcagaccctggctctgttacttactagttgtgtgatcttgaagaaatcaaaatggagatacactatgtacctggcagtaatagttgtggggattaagcaccttcaccagagcttaggacataataagcccccagtaaatagcttctttaatatcagaagttcagatggaagatgtgagaaaaatattggttcagtaagatttaacaggtaaattaaaatcaagtatttgaaaacattttcctgtttctttagcaatggattccagaaacataatgtggaaatagctctcagtccttagatttgatgacattgcagaaagaaatctggctagtcgtcccatggctgattggctatgatggctagaaagccattggaaaaaaaaaattggctcacagaagacagcagatgtggcttgggaaatgcaaggacatgactgtaataaggatttgtctatccagccccatttatgagagtgattccaggagaaaaggacagatttgtattgtcagtgggatacgctgttaaaaaacacttttgctactaccactccagctgtcttggcatgtttgttggtgatgtaagctacagaaaatggaaatcaccaatagggctatagcaacctgatgcatagtgacaagtaattgttctattcatggttatgtgttgtacagagcacttgctgcatgtcaggtttgagacttgagtatgcattagggccatggacacccccatcttatctttaagtagatttcaaagtaaatatttgatgaatatgtaaaatatttagtttggtcagtcatagggctgagaacatggtggcagttacctcctagtatctgcaagcaaaaaaagttttttcttcctatagcaattgccatctcagccacttttgcagcatttctttttgctacactttgcattaaccatttgtgcacttgtcttagcctcaaacaggccatgaaagctccttgaggataggggctatgtctttttcatctttatatatgcatcatttagcagagctgtccctttataatgtactaattactgaatgaagggatgcatagatgaataaatgaatgaaaagtaggagtgacctgtcttctctctttcttcacgatggggactagtgtgtgtatataaggggataatttttgtgtcacataaaatataaccttacttagaaggcaagacttccagaatggtggaatgagaaccacccccccgcccccataaatccgccctttcatgaaagcagtgaaaacgctagcaaacgttgtgaaaattaacttttccagaactctggaaaggaaacagaggcttccaacaatctgagaagaatgtattcaagaaaaacttcggtaagctctctgatcacagtggaaataataaacaattagtaatagaaggatagttgggaaattcaccatttgtgggatataaacagtggatcaaagaagaaatcataagggaaatgagaaaatactttgagattaatgaaaatgaaaatacattgttccaaaacttacaggatacagccaagctaaagcagtacttaaagggaaatttgtaactgcgaaggcctatatcaacaaagacaaatgatctcaaatcaagaacctaaccttccaccttagactaggaaaggaacagcaaactacaaagaaagcaggaagaaagactaataaagactaaaagggaaataaatgaaataatagagtagaaaaacactagaatcaatgaaattaaacattgattctttgaagagatcaacaaaactgaaaaaaactttagtcagattgaataagaaaaaaagagagaaaattcaaattatcaaaatgagcaatgaaaatggggccatcactacctaccttaaaaagaattttcaaaggattaaaagaaaatgccattgcattagttcattctcacacaactataaaaaagctacctgagatggggtagtttatgaagaaaagcgctttaattgactcacagttccacagtctgtacagcaggcatggatcatgaggccttaggaaatttacatcaggtgaaaggctaaggggcatggaagacatgtcttcacacggcagcaggagagagagcaaagagggaagtgccacacacttttaaaccatcagctctcatgacaactcactcactatcatgagaacagcaaggggaaaatctgccctcatgatccaattacttcctaccaggtcccttccccaacactggaaattacaattcaacgtgcgatttggatggtgtgacacagagcaaaaccatatcaaccatactgtatgccaaaaaattagatgacctagatgaaatggacaaatactcagaaaaacacaaactatctaaagtgaccagtgaagaaacagaaaatctgagtagtcctgtaacaagtcctgtaacaaaactggattagtaattaagaaacttcccacaaagaaaagcccaggttcagtcttcactggtgaatactatcaaatatttaaggaagatttaatccttcacaaattatttcaaaacttggaagaggctggaaccctttccaactaattctgcaaagtcagcattaccctgatgccaaaaccaaagatatgacacaaaaataaaactgcaggctaatatcacatttgaatatagataactttctaaaaatctcaacaaaatgctagcaaacagaattcagcaacaaataaaaagggttataaagggtgaccaagtaggatttatctctggaatgtaaattaacattcaaaaacctaagaataggaggaaactttcttaactttgtaatggacatctctgaaaaacacacagctaacatcatactaaatagggaaagattgaaatttttccttgtaagatcaggaacaagacaaggatgactgttctcaccatttcaatttaccattgtattgtagattcaagtcaaggcaattaggcaaaaaaaaaaaaaaaaaaaaaaaaaaaaaagaaagaggtaaaaggcacccatattggaaaggaagaggtgaaaatatctatattcacagatgacatgatcttatacaaagaaaaccttaaggaatccatgataaactattaaaacgagtaaacgagttcagcaaggtttcagaatacaagattaatgtgcaaaaatcaattgtatttctgtacactagcaatgagcaatctgaaaatgagattaagaaaacagttcactcacaatataatcaaaataccagaatacttaaaaataaatttaacaaaagaagcgtaagacttgtatgctgcaaaccacaaaacactgtggaaagtaattaaaaatctaaataaatagaaaaacatcccttgttcatgtactagaggactcaatattgtcaagatggaaatactccccaaagattgaaggaaatccctatcaaaatactggctgttttcttagcagaaaatgaaaatctgaccctaaaattaatatttaaatacatggaacctaggataaccaaaataatattgagaaagaaaaacaaagtcggcgtacccatgcttcctgattccaaaccttattacaaagcagtggtaatcaagagtgtatggtattggcataaggacaaacagatcaataaatggaatactattgagaatccaaaagttaactcttacatttaagaccaattgactttcaaaagtgttgctaagacatttcaatgaggaaagaatagtcttttcaataaattgtactggaaaaattggatatccacatgaaaataaaagattttggaccacttcaaacctgcaaaaaaaataaaatgatctcatggtgtatcatggatctaaatgctatagagctaagatgataaatctcagaagaaaatatcaaagtaaatctttatgaccttgaagtaggcaatggttttttggctataacaccaaaagcacaagcaataagagaaaaaaaatttttttaaaaaaacccttgattattttattaaaattttgttgtgggtacaaagtaggtgtgtatatttatggggtatatgagatattttgatacaggcatacaatgttcaatgatcatattaggataaatgaagtatccagtacctcaagcatttatcatttgtgttacaaacaatccaattatactcttttagttatttttaaatgtacagtacattattattgtagtcattcccttgtgctatcaaatactatatgttattcattctatctaactatattattgtacccattaaccatccccactcccctgcctcccagctacacttcgtagcatctggtaaccatgatttcctcttatctccatgagttcagtagtttcagctcatggagatagacagaactaattttattagctcccacaaattagctcccatgtcagaacatgtaaagtttgtctttctgtgccaggtttatttcacataacataacgaactctagttccaaccatgttggtgcaaatgacaggctctctcttttttttttttttttttttttttgagatggagtctggctgtctcccaggctggactgcagtggtgcaatctcagctcactgcaagctccgcctcccaggttcatgccattctcctgcctcagcctcctgagtagctgggactacaggcacccgccaccatgcccgactaattttatatatatatatatatatatatatttattattattatactttaagttttagggtacatgtgcacaatgtgcaggttagttacatatgtatacatgtgccatgcaggtgcgctgcacccactaactcatcatctagcattaggtatatctcccaatgctatccctcccccctcccccaccccacaacattccccagagtgtgatgttccccttcctctgtccatgtgttctcattgttcaattcccacctatgagtgagaacatgcggtgtttggttttttgttcttgcgatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaataatgccgcaatgaacatacgtgtgcatgtgtctttatagcagcatgatttatagtcctttgggtatatacccagtaatgggatggctggttcaaatggtatttctagttctagatccctgaggaatcaccacactgacttccacaagggttgaactagtttacagtcccaccaacagtgtcaaagtgttcctatttctccacatcctctccagcacctgttgtttcctgactttttaatgattgccattctaactggcgtgagatgatatctcattgtggttttgatttgcatttctctgatggccagtgatggtgagcattttttcatgtgttttttgggtgcataaatgtcttctttttagaagtgtctgttcatatccttcgcccactttttgatggggtcgtttgtttttttcttgtaaatttgtttgagttcattgtagattctggatattagccctttgtcagatgagtacgttgcgaaaattttctctcattttgtaggttgcctgttcaatctgatggtagtttcttttgctgtgcagaagctctttagttgaattagatcccatttgtcaattttgacttttggtgttttagacatgcttttggtgttttagacatgaagtccttgcccatgcctatgtcctgaatggtaatgcctaggttttcttctagggtttttatggttttaggtctaacgtttaagtctttaatccatctcgaattgatttttgtataaggtgtaaggaagggatccagtttcagctttctacatatggctagccagtttttccagcaccatttattaaatagggaatccttgccccattgcttatttttgtcaggtttgtcaaagatcagatagttgtagatatgcggcattatttctgagggctctgttctgtttcattgatctatatctctcttttggtaccagtaccatgctgttttgattactgtagccttgtagtatagttagaagtcagggagtgtgatgcctccagctttgttcttttggcttaggattgacttggggatgtgggctcttttttggttccatatgaactttaaagtagttttttccaattctgtgaagaaagtcatcagtagcttgatggggatggcattgaatctataaattaccttgggcagtatggccattttcacgatattgattcttcctacccatgagcatggaatgttcttccatttgtttgtatcctcttttatttccttgagcagtggtttgtagttctccttgaagaggtccttcacatcccttgaaagttggattcctaggtattttattctctttgaagcaattgtgaatgggagttcactcatgatttggctctctgtttgtctgttattggtgtataagaatgctgtgatttttgtacattgattttgtatcctgagactttgctgaagttgcttatcagcttaaggagattttgggctgagacaacggggttttctagatatacaatcatgtcatctgcaaacagggacaatttgacttcctcttttcctaattgaataccctttatttccttcttctgcctaattgccctggccagaacttccaacactatgttgaataggagtggtgagagagggcatccctgtcttgtgccagttttcaaagagaatgcttccagtttttgaccattcagtatgttattggctgtgggtttgtcatagatagctcttattattttaaaatacggcccatcaatacctaatttattgagagtttttagcatgaagcgttattgaattttgtcaaaggccttttctgcatctattgagataatcatgtggtttttgtctttggttctgtttatatgctggattacatttattgatttgcgtatattgaaccagccttgcatcccaaggatgaagcccacttgatcatggtggataagctttttgatgtgctgctggattccgtttgccagtattttattgaggatttttgcatcaatgttcatcaagcatattggtctaaaattctcttttttggttgtgtctctgcccgtctttggtatcaggatgatgctggcctcataaaatgagttagggaggattccctctttttctattgattggaatagtttcagaaggaatggtaccagttcctccttgtacctctgatagaattcggctgtgaatccatctggtcctggactctttttggttggtaagctattgattattgccacaatttcagatcctgttattggtctattcagagattcaacttcttcctggtttagtcttgggagggtgtatgtgtcaaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcagtctatcaattttgttgatcctttcaaaaaaccacctcctggattcattaattttttgaagggttttttgtgtctctatttcctttagttctgctctgattttagttatttcttgccttctgctagcttttgaatgtgtttgctcttgcttttctagttcttttaattgtgatgttagggtgtcaattttggatctttcctgctttctcttgcgggcatttagtgctataaatttccctctacacactgctttgaatgtgtcccagagattctggtatgttgtgtctttgttctctttggtttcaaagaacatctttatttctgccttcatttcgttatgtacccagtagtcattcaggagcaggttgttcagtttccatgtagttgagcggttttgagtgagattcttaatactgagttctagtttgattgcacggtggtctgagagatagtttgttataatttctgttcttttacatttgctgaggagagctttacttccaactatgtggtcaattttggaataggtgtggtgtggtgctgaaaaaaatgtatattctgttgatttggggtagagagttctgtagatgtctattaggtctgcttggtgcagagctgagttcaattcctgggtatccttgttaactttctgtctcgttgatctgtctaatgttgacagtggggtgttaaagtctcccattattaatgtgtgagagtctaagtctctttgtaggtcactaaggacttgctttatgaatctgggtgctcctgtattgggtgcatatatatttaggatacttagctcttcttgttgaattgatccctttaccattatgtaatggccttctttgtctcttttgatctttgttggtttaaagtctgttttatcagagactagaattgtaacccctgccttttttttgttttccatttgcttggtagatcttcctccatccttttattttgagcctatgtgtgtctctgcatatgagatgggtttcctgaatacagcacactgatgggtcttgactctttatccaatttgccagtctgtgtcttttaattggagcatttagtccatttacatttaaagttaatattgttatgtgtgaattttatcctgtcattatgattttagctggttattttgctcgttagttgatgcagtttcttcctagtctcgatggtctttacattttggcatgattttgcagcggctggtaccggtcgttcctttccatgtttagtgcttccttcaggacctcttttagggcaggcctggtggtgacaaaatctctcggcatttgcttgtctgtaaaggattttatttctccttcacttatgaagcttagtttggctggatatgaaattctgggttgaaaattcttttctttatgaatgttgaatattggcccctactctcttctggcttgtaaagtttctgccgagagatctgctgttagtctgatgggcttccctttgagggtaacctgacctttctctctggctgcccttaacattttttccttcatttcaacttttttgaatctgacaattatgtgtcttggagttgctcttctcaaggagtatctttgtggcattctctgtatttcctgaatctgaatgttggcctgccttgctagactggggaggttctcctggataatatcctgcagagtgttttccaacttggttccattctccccgtcactttcaggtacaccaatcagacatagatttggtcttttcccatagtcccatatttcttggaggctttgctcgtttctttttattcttttttctctaaagttcccttctcacttcatttcattcatttcatcttccatcgctgataccctttcttccagttgatcgcattggctcctgaggtttctgcattcttcacgtagttctcgagccttagttttcagctccatcagctcctttaagcacttctctgtattggttattctagttatacattcttctaaatttttttcaaagttttcaacttctttgcctttggtttgaatgtcctcccatagcttggagtaatttgattgtctgaagccttcttctctcatctcatcaaagtcattctctgtccagctttgttccgttgctggtgaggaactgcgttcctttggaggaggagaggcgctctgctttttagtgtttccagtttttctgctctgtttttccccatctttgtggttttatctacttttggtgtttgatgatggtgatgtacagatgggtttttggtgtggatgtcctttctgttttttagttttccttctaagagacaggaccctcagctgcaggtctgttggagtacccggccgtgtgaggtgtcagtctgcccctgctggggggtgcctcccagttaggctgctcaggggtcaggggtcagggacccacttgaggaggcagtctgcccattctcagatctccagctgcgtgctgggagaaccactgctctcttcaaagctgtccaacagggacatttaagtctgcagaggttactgctgtctttttgtttgtctatgccctgcccccagaggtgaagcctatagaggcaggcaggcctccttgagctgtggtgggctccacccagttcgagcttcccagctgctttgtttacctaagcaagcctgggcaatggcaggtgcccctcccccagcctcgctgccaccttgcagtttgatctcagactgctgtgctagcaataagcaagactccatgggcgtaggaccctctgagccatgtgcgggatataatctcctggtgcgccgttttttaagcccgtcagaaaaacgcagtatttgggtgggagtgacccaattttccaggtgccgtctgtcacccctttctttgactaggaatgggaactccctgaccccttgcgcttcccgagtgaggcaatgcctcgccctgcttcggctcacacacggtgcgctgcacccactgacctgcgcccactgtctggcactccctagtgagatgagcccgctacctcagatggaaatgcagaaatcacccgtcttctgcttcgctcatgctgggagctgtagacctgagctgttcctattcggccatcttggctccagaaaaaaaaattgttaaattggacttcatcaaatttgaaatttttgtgctgcaaatgataccatcaagaaagtgaaaatctcacccacagaatgagagaaagtatttgcaaatcatatatctgataagggtattgaatttagaatatataaagaactcttgcaactcaatataaaaagacaacccaattttaaaatgggcaaagtatttgaatagaaatttcttgatagaagatatacaaatttaaaaatgctcaacatcattagtcattagggaaatgcagatcaaaaccaaattgagataccggtttacacctattaagatggctatagaataaaagaacaaataacaagtattggctttaatgtggaggagccagaacccttatatattgctggtaaaatgtaaagtcatgcagccctttgaaatacagtctgcaagtctttaaaaaattactatttgttatttggtttttcttcacttttaatttaggttcagaggtacatatgcaggtttgctatatagctaaattgtgtgtcacaggagtttagtgtacacattatttcatcacccaggtaataagcatggtacccaataggtagtttttctatcctcaccctcctcctaccctccaccatcaagtaggccctggtgcctcttgttcttttctttgtgttcatatgtactcaatatttagcttccacttatcagtgagaacatgtggtatttggttttctgttcctgctttagtttgcttaggatactggcctccagattcatccacgttgctgcaaaggacatgatctcattctttttgcatagtatactatggtgtacatgtatcaaaaatgttactgtttgacctagtaattctattccaaggtaaatactcaagagaaatgaaaacatgtccacacaaatacttgtacacaaatgttcattgcagcattatttataatagccaaagagtggacgacaaatgtcttccaaatgtgggctccaaatgtccaccaactgataaatggaaaaacaaaatgtggtatatccatgccatggtttatctgtcaataataagaaatgaagtactcatacatgctccaacatggatgaaccttgaaaacattatgctaggtgaaaaaagcaactcacaaaagactacactgtatgattttatttgtattaaatgtccataaaagaaaaatatttagagatagaaaggaaattagtttttccagggtctgggaggagacagtatgaggagtggctgctaatgggtacaggatttctttttggagtgatataattgctctaaaattagtttgcagtaatagatgtgagtatgctaaaatgggtgaattttatagtatgtgaaatataactcagtaagcccattaaaaacaacctaattaaattaaaaccaagctataacagaaatattatatggctttggcagtttagaatagtgggaaaatatggagtaagggtggggaaatagtcccaagtataattctggttttgtcactactagtgtatggacttggacaagtcatttgctttctctaagtatcagtttgcatatatgcaaaatagaggtaatgatacctacctcagtggtaccttttcaaaaccttgttcttcctcatctctcctctaccactttctcataatattattacagtaataaccatttattaagcactgtgtccgcagtggtgtggggctgctttacctccacaacttcactgaatcctcactgcagtcttgtgggatctttatttctttgcccattttacatgtaaataaattgaagtcaaatgagttgttcaaggtccttctgttagcaagtggcagagatggacatgaaaactagatcttctacctatgtgtctttccacttcaactaaagaatttattaaagagaattgaaaagctatgaactaaatttcggtaatacttttaatagtaaacattgctgccctcgtgaatgaacacacactaaatttcaaatctcacggtggcagggaataaagatgctacctatcttaagccattacttcaccaacttctccaccaaaatattccttgtaaccacaaataagtaagcacaatagatctataaggagagaataattgtgaactctgattttatcttaaaaagtcatgtagggatgtcatgttccacaatgtgattaataaaatatattttgttactaaacacaaggaaaaatattatgttccataaagatgtttggtggttgcctcgacctcttttagtttgaaaagtaggtatgtatgagaaagatatgtgtttacatgtttacccttgccttctctctgtctcttcccctctctctccctccctccccaacccctatgccctacacccccgcaacccccacatgtatttacctttctctaaaagctctgcatagccaagaaaagtgctcttttttatttttaggatattagatatttcattttcttatggtaagacaaaagattaaggcaaccaagacttacaatgtgcctaccatgtggcaggcacagaggcaagggcttttacatgttatttaatgtaattgtaattctcacaaaagccgtctagagttgaaaatatttccaactctaaatgaggcaaatggagcacagagagccttaattatttcacccaaagttcagtggtagaggcaggattccaacccaggtctggtgggctccaaatccttgttgggttgccattcctcttgctaacaaataaaactggtctgtgacttttgcatttcaccccgcttccacagtcactggtgggacttacttaagttaatcagattcttcaaagtatccccaagtcctcctttgaaaagaaagttgggggacaggaggaggagcagaggagaggagataaaaaggaaaggagtcagggagagagagagagagagagaaacctggtgatctcagctgggtgccaaggtttcctaagcccaagttccccatggttgagcctgtattgtcaggccaacagcttctagtaatccacttttatttaattaatagtgaaactgttgaagaattgcaagtggtgttctggttcagaaaccttccgttctatggggcactgcttttgcttcagattcataaaaccaaatgctctgcctcaagataataagtgaacgtgtaaccctcgggaggtaagaaaaaacacaatgtcacgtgcaaattctgcacttgttctcaaagcaaacctctcctgtgtttgcaattaggatgttatctaggagcatattcaaaacttttgaggtttttattttagtttttctttcattatgtgctgttttagtaatatcaaagaatacatgtaatatataatttatatgtcataacaataaaattaatgttgatgagcccagattaaagaatcaacaacattaacatcatgattgcatcaaccctattagaatggaagctctgtgaaggcatggatttttgtccattttgttcactgctatatccccaggacctagaggagtgtcagccacataataggagcttagtcaatattttaaaaataagagcataaatctacttatatcctctttcctcttaccatcactcccagcctcccctcagaggtaaccactatcctatatttgggctttattattcccttgcattttgataagttttcacatgtatattcccaaataatatattgcttgcttttgcttctttttaaactttatataatggaatcatattgtatgtatcctattgtgaattatgtcttttacacaacattagtatttgagattcaactatgtgtagctcgattccattccttttcattgctgattgtagtttattggatatgtgtgccataaattatttttctcctgtcagttaatgtttatcatttatgctttaataaacaaaactgctatgactgttcctgcatgtgcctcctagtacatatgtgaccaactttctctaggatataagcctgagagagggactgcagttggaatttacatttccaaagcccaaagtttagctcatgagtcagagctgcaatgtgccctttgtccacactaggtcaggatcagtgggagtgctacccaaaatattttgctagctggggagtcagggagaagcagagactgacctagtgaggccaggaggcactatctcaggtctctagtcaaaatgggttgcaattagtaaaagtccagattctgaatccccttcactatttatcttcctcttcctcctttacagttatttttgttcaaggtgcactttattaaactcatgcctaacaaacaaaactctaatgaatattttgtctttcattgattgtaaattcaattaattagattgcttgaaaaaattttaactgtattttcactttagtatggatgaaaatttcgatttctttaaaaaacattttttaataataacacaacataaagtctaccctcataacaaaatttaagggcacaacaccatattgttttttttttattttattattattatactttaagttttagggtacatgtgcacaacgtgcaggtttgttgcatatgtatacatgtgccatgttggtgtgctgcacccattaactcgtcatttagcattaggtatatctcctaatgctatccctcccccctccccccaccccacaacagtccccagtgtgtgatgttccccttcctgtgtccatgtgttctcaatgttcagttcccacctatgagtgagaacatgtggtgtttggttttttgtccttgccatagtttgctgaggatgatggtttccagcttcatccatgtccctacaaaggacatgaactcatccttttttatggctgcatagtattccacggtgtatatgtgccacattttcttaatccagtctatcattgttggacatttgggttggttccaagtctttgctattgtgaatagtgccgcaataaacatacgtgtgcatgacaacaccatattgttaactgtaggcacaatgttgtacagcagacgtctagaactttttcttcaggcttaactgaaactttatagccattgaacagcaacactccatttccgtttcttaaaggtcctttacaaaatgagctttctgcgtgtttccattttgtttatctgataacttttttttctttttttattatactttaagttctggggtacatgtgcagaatgtacaggtttgttacataggtacacacatgccagggtgtttggctgcacctatcaacctgtcatctacattagatatttctcctaatgctattccctcccttgcccctcacccctcactggccccagtgtgtgatgttccctagcctgtgtccaagtgttctcattgttcaactcccacttttgagtgagaacatgcagtgtttgattttcttttcttgtgttagtttgctgagaatgatggtttccagcttcatccatgtccctgcaaaggacatgaactcttccttttatatggctgcacaatattccatggtgtatatgtgccacaatttctttatccaatctatcattgatgggcatttcagttgttccaagtctttgctattgtgaatagtgccacagtagacataagtgtgcatgtgtctttatggtagaatgatttataatcctttgtttatatacccagtaatagaaatgcttggtcaaatggtatttctagttctagatccttgaggaattgccacactgtcttccacaatggttgaactaatttacactcccaccaacaatgtaaaagcgttcctatttcttcacatcctctccagcacctgttgtttcctgactttttaatgatcacgattctaactggcgtgagatggtatttcattgtggttttgatttgcatttctctaatgaccagtgatgatgagctttttttcatgtttgttgaccgcataaatgtcttcttttgagaagtgcctgttcatttccttcacccactttttgatggggttgtttgtctttttcttgtaaatttgtttaagttcattgcacattctggatattaattaacctttcgtcagatggatagactgcagaaattttctcccattctgtaggttgcttgttcactctgatgatcgtttcttttgctgtgcagaagctcttgagtttaattagatcacatttgtcaatcttggctcttgttgccattgcttttggtgttttagtcatgtagtctttgcccatgcctatgtcctgaatggtattgcctaggttttcttctagggttttcatggttttaggtcttacgtgactcatcttgatttaatttttgtgtaaggtgtaaggaaggggtccagtttcagttttctgcatatggctagctagttttcccaacaccatttattaaatagggaatcctttccccattgcttgtctttgtcaggtttgtcaaagattagatggttgtagatgtgtggtattatttctgagacctctgttctgttccattggtctatatatctgttttggtaccagtaccgtgctattttggttactgtagccttgtagtatagtttgaagtcaggtagcatgatgcctccagctttgtgcttttggcttagaattgccttggctatgcaggctctttattggttccatatgaaatttaaagtagtttttttataattctgcgaagaaagtcattggcagcttgatggggttagtattgaatctgtaaaacactttgggcagtttggccattttcatgataatgattcttcctatccatgagcatggaatggttttccatttatttttgtcttctcttatttccttgagcagtggtttgtaattctccttgaagaggtccttcacatcccttgtaagttggattcctacatattttattctgtttgtagcaattgtgaatgggagttcactcatgatttggctctctgtttgtctgttattggtgtataggaatgcttgtgattttcgcacactgattttgtatcctgagactttgctgaagttgcttgtcagcttaaggtgattttgggctgagagaatggggttttctgaatatacattcatgtcatctgcaaacagagacaatttgacttcctgttttcctatttgaatatcctttattgctttctctttcctgattgccctggccagaacttccaatactatgttgaataggggtggtgagagacggcatccttgtcttgttctggttttcaaagggagtgcttccagtttttgaccattcagtatgatattgggtgtgggtttgtcataaatagctcttattattttgagatatattccatcaatacctagtttattgagagtttgagcatgaagcagtgttgtattttgtcgaaggccttttctgcatctattgagataatcatatggttttgtcattggttctgttgatgtgatggattatgtttattgatttgtgtatgttgaaccagccttgcatcccaggggtgaagcggacttgatcgtggtggataagctttttgatgtgctgctggattgggtttgccagtatttttttattgaggatttttgcactgatgttcatcagggttattggcctgacgttttctttttttgttgtgtctctgccaggttttggtatcaggatgatgctggcccataaaatgagttagggaggattccttctttttctgttgtttggaatagtttcggaaggaatggtaccagctcctctttgtacatctggtagaattcatctgtgaatccttctggttctggactttttttggttggtaggctattaattacttcctcaatttcagaacttgttatagttctattcaggtatttgacttcctgctttaggcttgggagggtatatgcgttcaggaatttatctatttcttctagattttctattttatttgccccagaggtgtttatagtattctctgatggtaatttgtatttctgtgggatccgtggtgatatcccctttatcattttttattgcatctgtgattcttctctcttttcttctttagtagtctggctagtggtctatctacaaaatagactgtttatctgatatttattttgtaattatctaataataaccatcattatcatcatcagcattatcattatcatctcctttacccatacatacatttgtgtctttcaaataataatcccatctttgaagtgcatcctcatctttagcagtctgcactctgctttcttatatcatttattatcttattttataattatttatttccagtccttcttctctaacagatagtagtttcttagggccaaggaaatatctcgatcaccactatatccccagcacctaaccctgtgcctggtccatagggccagatgctaagagttgagttgaaccattgtacctaatcttaaccttcattagcacaacatggtttgtcagtggttaagaatctacactttggagtcagactcacccaggatggaatcctggcattgccacttattattaatagatgcgtgatcttgaacaagtttacttaattgttctgagcatcagtttcctcttctgcaatatagggatgatacacagctacctggtaggttgttgggaaaattaaatgggatgatatgtatgaaatggcctggcatatagagtgcctaaatacatgttcttctgattctatttggacagtttgtgttagtaacagaagtcaaaaaggtggagaaaggagaaaggtacttgtgaaaattttctatttcttctccatgtttcattcaggactgaggaagggggcacagtttttacccaaggaaatgacatttttagccaaaagaaatgatcttagcatttagctgaattatatattggaagtaagctccttccatgtggaacttatggccttgctagccttggtttgttggaagtgctcttgctggctttctagttagggtagggaaaggaaggcttgtggggaatgaagataggccatgatatcaagccactgggtttgcaaatcagtagaattttttattgctttctgttgtacttgggacttgaataaaggctgatatttgtgtcttgctggtaaagtgcttgtaaagtgagtgaaagttttctttgctcttgtcctgacatagctgttcacttggggttgaggggaggataacctttcatgttttttttttttcttcattctgatgactgtgctgaacattcaaaccaaaaggccattggtggaaagtaaaggtgagtggtgagaagacaatagggtaatggaaactgtgttggacttgtaatcaaattgtcctgcacttcccctctccaagtcttaacgtttttcatctgtacagtggatattaaaatgagaaaataagcttgtcttcacagagttttcgttaggtgttgacacaacaaacaggctcccattagggctcattttccttcattccttagtaaggaagaagtgcttataaaatatagcagttgtgctcttgtgaatgatagcatgggcagttgtcatctccctgaagcagatgtaacccagaatgtcacttgagttttgtttaatgcttaggcataagacataggaatgacaaaagctgacctttgggtagtgagaacaatgttccattttgttcaaacttgaattttttactataggagactgagaattaaccttccatgaaggttttaggattggctttctggcccttctccttcatatccacctgaaagagcttgggcgcagaagttcttgcagaaaggcagttagacaaggtgacttctgaagctccagtggccaagtattttgatggtagcctaaaagatgtccagaatcattgtacatcattttttcaacagaagcttcaggcatagggattatgcttggtactttatgttgtggaatggaatctggcggatgtccatgtgatctatagaaacacctaaggaaagtgaagaaatgagggaaaaaaaagaacaagacttttatgataatactaatcacgatccttgtgtatttattccaatggcattttatccattatctgatttatattaccactcacagcagcagctcaataggatgggagatattatctctattttatagatgagatttgaggctcacgaagctaaagcaaggaacatcaaatcactttgatatttggtctggttttgttataggtctccctttggatgaggtaaagttacaaacctgggttcatatcatttaattagtctgaaaatgttgcctggacaccaccttcagttagatatcttaacctcaggcttcctgccttcattgctcccgcatatagacatagactatgagattggctaatcccagagaacttccctaatcccttggcaagatccaaaaaggctcagtcacaccctacaaccatcatctttaggagaagtctcagaaaattcagcttcacactaactaacttgagcaatgaataatagtcatttatgcctgcaggttaatgctgaagacctgagacttcacttgcctatttctgccattcagtgacatgtgttgcattggttttttgtgtctttccagtttggagactgccagggaccatgttttgcccattgactattactttccaccccagaagacctgcctgatctgtggagatgaagcttctgggtgtcactatggagctctcacatgtggaagctgcaaggtcttcttcaaaagagccgctgaaggtaaagggtcttgcacatgcacttctctttccctttctcctttaccttccagagagagacactaacctttcagggcccaggattttatcatctcagaaatagagtcattggcaaggccctatcaaataacttaggagcctaaggaagcaaatttttgtacttgctagttccctggtttcagcagccttgtttgtacaggcaatttaggcagtgaaggtggtcccagctggggcttggggctcagtgggtcctagaaatgaaagaaaaattaatgatttgaaaagatttaatttcctcccttcttgttttctactctgctggctagtaaaggaaaaatttgtccttattagagaggttagaagtggagaaaccccaactgagtccccagcctgttccttgggatgaatatgagactgttccttagcaaaggcttcctggcctcggccccagaaagggagtgttctcactcttcagcagactatcagtctctgcacctgctccctcctgttgtggcctccttgggacctgtctttgcattaatagttcctaggtaggtaagaactcagagtgaagaaacacatttattctcctctccagagacctgatctcaaagcctgtccattagtccctaaccttaatctaaggtagcatcttatatctggctaaattggctcaagccctagctccttagttttatttagcttagaacaactcatgtctgctcaacctctagaggcgctcagcccacattctgcagtagaaactcccattttcaggcctcttatatacggtaatgtctccttcctctaaccacccagggcttaagcttcctgcttatccacttcaccctgtattgagggctttcttctcaaagagacattgatgaggagcccctagagagagatgctgtgctctgggaccagaccccttgttaaacaccagtattcacctctgccccaactttccccaaagaggtacttcctgccaaggcctttctctttcctctcactggctggaagtgttgagttccacttcagaaccagaacagagaacctttccttctataagagctataaaccttgagaacagtcttaaaacataggtatgtaggccacaccattcaccacgaatgtactgatactcatcagaatatggaagaagcaccagagagtttgaagcatctagagaaaaggtagaaagagaatgccctttaactgacctcctcagtgatagccaatcacaatgatgagtgttgattcatcattttggctaggtggcagaaatatctataaaacagaagctgccatgttgttttcttccagtcctcagggcctacaagaaggcagctatcatttggtattactgaaaacatgccccatgttcagctcatacccccaaattacccattgctactgtttatgctgggctaatatgaagcccagggccctaatgtctaggtctaggcagtaaggcctagagcagtgcctaaagagcctgagagcagtgccttcctttcttcagagtactcatgaaaggatggctgtcagaaaaggaaatgaggatgggttccagagacttcagaccaccccaacttccccagtgagaccctggcacctccccataccctctcacctagcgggccctgtctatagagcagagaatgaaacagagcactcatctagaggtagtgtgtcagcaagcccaggcactgcaccacagtaatagcagccatatcagatgggaaaggagttcaagtgaacaaacaagcaaattcaatagtcagatagattagattatacttgatgcttcctctgagttttacaaatatgggtcactaaattgttattttcagaaaacaggggaaatgctcaatcacattgtgaaagggaagattttgctgtcatatcatacatcccacatgggagctttctgcagaagttagagctgaaggagggaggcaggcagaagggcaactggcagggctgcctgggaggagctctgcaatgaggtggatcctgtgccatttgagaacagggaagaaaagaaatgaggttttggggagggaatcacccaactcacagaacacacagaaatccagcaaggtttcaaaacgctctacaccttagagtctgttaagttagggaaactctgtgagctcatagggccaaatgcacttgcctgcttgaaatatgaaaaatcagcaatggattccttgaaaaacaatgaaaagggaaccttctgagccccttggttattttgacatatggaccatagatttcagtcctgagccctttgaaggtaggagaaggtggtttagaaaacacacacacacacgcacacaaacacacaccagaatgaagcaaaaaaaaaattactggtgttttctttctcctcccatctgtgaagctgttggattgattttactgccatcattatccctgtttgaaggcagggggctgtcttattacccaaagaggacatttattgatttggttttctttttccatttttacaatgcatctttatcgcccatatggcctttctggaggtggttttcagtctggcttgttgaaacatcaaattatacctgtcttagagaaaatagaaacaaaaatctttctcttccttacttgcttgttgtagtcagttaactcggactgagtattcagagtcttgattatcacttaattcatagtttcataaatctctggaatgggcataggtacaggacttaaaagcctggcatctcagacagaaatatgtttttagctttggtggtttataacagatgggacttttaggctgtcattggtgcagggctcagcacagagtcagttgtaatctggacaggttttgttgttgaggaagagtgggaagagggagtcctacattttctccttgtcagtaatgttggagaattggggtgagggtgaggctgggcagggagggtctgcatagaaaaaagggtgcggtgagaaaaaataatgctactaagccatgagggtaaaatgaccaaattctggttgagagaaacttggtcaaagtgtgtatggggagagaaagttggtcaaagtctgtgtctgagtgcttggtgggatgaactctgggttagaaacaggcatggagggaaatagttggtttatggagtgggtaggatgagtggggtggtgaaagggaaggcattttggatgctaagagaccaggaagtcaaagcaaggcaatacacataaacagaggtaagggctcagagaggttttagttgtgtagacttggataagaaattttcccttttggacctcagttttccttgtttgtaaaacaacggacttgaactagatattttaaaatgtgcttccagcttagacattttgtgaccgttctacaaattacaaacataatcatcatcatttcagcaaactcacatgtatttatacctgcataagtttttggtcttgctttcctagaaggtgactaatcccagatcctaatcaattaaagaagcaatcttcagatggggatagagccagctgagagagtgtactatggatggagtgagttaaaactcaggactcagattttctccttgtgatcattgctgggtaacttcctttcttttctattttctcatctggaaaatcaggatatgaatccccatctctacctcattatgtttcaaagagggttaattaatccatcatgtgcattatgtgctcaagaatttactatttttcagacattttctagtaaaacattgaagattatatgtccatttgttttgtacacatggagtgctgtttggtacacatcataaaattgaaactgtagtttacattctgaactcaaagaattacaccatcctcactgatgtttacaataggtcccaatttagtttctttagcaaattttatgtaagtatggctttgattctctctctcactccaggtttttgttagggaagaaatgcaagtgaaccctcattgaactctttctgtcctttaaatccattctttcccacctcaactcatgtggaattgaatgttgcctctagtttggagtctagcagagagtttttggtgcatatcagtgtccccttcactccctgacttttcaagtaacatttcccagaggcaaattaactctgctaagaggatctgcttgcagcttcaacagagccttcatcaggtatctttggccaaggagttgactgatcctgactttgcgagtcctagagatcttttcacaaagctcctctcatgtttctgcctctgattttcttaaatgtcacagacagactttagatttaggggttggttaactttttttgtaaagggccatgtagtaaatattttaggctttgtagatcatatggtctctgtgtcaactactcaactctgcctttgtaggatgaaagcagccatagacaatactggaactaatgggagtagctgtgttccaataaaactttatgggcactgaaatttgaatttcacttaattttcacatgtcgtttaatattatttttcttttttaccatttaaaaatttagaaatcattcttagctctttgggcctcacaaaaacagatggtagagtggatttggtttatgggctgcagtttgttgacctgtgctttagctaatcacttctgtacttataaatctgcataggttttatgtttttccatctcttggtatcttagtaggccagtcaaagtttgaacaacttgttagcacagaatacctggcctagtggcttcttggtcctgagcttatttactaaacaagagaaaaaataaataagtctagaaatgctagaagaggatacttttttgttttaatgatctagtagatcactcctccttgcaatacccagaggagaaactgaaaatatttcaaacattttctagacttctgtgttgtaaatttgtggataactatgaactatatatgaatgaacttttctggatgacacatatattccagatggtaaaaaggaagggctttggggactctctggtaccaagtgtcatggaaaaactgtgtgtctcatagaaagtagatcccaggaggccagcagagttgtggatctgccatatattacctcatgattctgtcttcgcacactcaccggcttaattctgggcctccccataacacgactagaccacaggcttgcagaagaaataatttagctctgtaactcattgaagttggtgcccacccaagtctctgtcagtgcccaattcgggagccatgccaagaatttgccattgctgcttcatggtggccttgtgcctgcttatttatagcctgtgcattttatgaaacagggattaataagaagttgccatagcacttgcaccattatgtaaatatctgtaatgcttacataacttttgtcacttgcaagaccttttgagtccattgccttctgctaccatgccttaccaatttcctagtcccttattattatttttcaattcattatatttaacttctgtgatacacgttcagaatatgcaggtttcttatataggtatacacgtgccgtggtggtgtgctgcaaccaacaacccgtcatctacattaggtatttctcctaatgctatccctccactagcccaccaccccctaataagccccagtgtgtgatgttcccctccctgtgtccatgtgttctcattgttcaactcccacttatgagtgagaacatgcagtgtttggttttctgttcctgtgtttgttttctgagaatgatggtttccagcttcatccgtgtccctgcaaaggacatgaactcatccttttttatgactgcatagtattccatggtgtatatgtgccacattttctttatccagtatatcattgatgggcatttcggttggttccaagtctgtgctattgtgaatagtgctgcaataaacatacgtatgcatgcgtctttatagaagaatgacttataatcctttgggtatatacccagtaatgggatggctgggtcaaatggcatttcaggttctagatccttgaggaatctccacactgtcttccacaatggttgaactgatttacacccccaccaacaatgtaaaagtgttcctatttctccatattctctccagcatctgttgtttcctgactttttaatgatcgccattctaactggcattgacatggtatctcactgtggttttgatttgcatttccctaatgaccagtgatgataagctttttttcatatgtttgttggccgcataaatgtcttcttttgagaagtgtctgttcatatccttcacccactttctggtgtggttggttatttttttcttgtaaatttgtttaagttccttgtagattctggatattagccctttgtcagatggatagattgcgaaaattttctctcattctgtaggttggttgttcactctgatgatagtttcttttgctgtgcagaagctctttagtttaattagatttcatttgtcaattttggcttttgttgccattgcttttggtgttttagccatgaagactttgcccattcacaattgctacaaagagaataaaatacctaggaatacaactcacaagggatgtgaaggacctcttcaaggagaactacaaaccactgctcaaggcaataagagaggacacaaacaaaaggagaaacattccatgctcatggataggaacaatcaatatcgtgaaaattgccatactgcccaaagtaaattatagattcaatgctatccccattaagctaccattgactttcttcacagaattagaaaatactactttaaatttcatatggaaccaaaaagagcccatatacccaagacaattctaagcaaaaagaataaagctggaggtatcaagctacctgacttcaaactatactacaaggctacagtaacccttatcaattttttatgtgcctctccatattctgcagtcagaagcttcttcagtcctttcagggaattgctgggtgactatcaaactctggtagttcatttttgcagttggctgctgttgtgaggataagagttagactcactttctcttcagagatagaaattatgtattaattctctgggttctagacccacagcaaggagcatactgctcctcaaaataactgaattctgcgagaagccatcattgtaaaacaacaatatcttcagttatagtagccatgtgtgcaacttctggaaactgttattcagattttcatgttccttccctgtctcttcatagctaggcagctgctttcagccttgtacagatgctagtgagctttctacctacaaacctgcagaaaattgaactgagatttggaggtgaaagactcttgataaagggaacaaggtttagaattctcagtccctttgctcccaggctgtgttgtgactactgaggcactccagtgaaatcactattcctcctatctagactaatgcctgtctctgcagagcacctcataagaacaggcctggtagtaatatcctcatgcattcagtcagtaaatatttacagagtgcttactacatatagggtattgggctgacatatgcaagatacagggcctgcttccaggaggttatagcttattgatcataaatgtggcattttttttttttgagacggagtcttgctctgtctgtcacccaggctggagtgcagtggcacgatctcggctcactgcaacctccacctcccaggttcatgtgattttcctgcctcaccctcctgagcagctgagactacaggggctcatcaccacacccagcttttttttttttttctgtatttttagtagagacagggtttcaccatattggccaggctggtctcgaactcctgacctcgtgatccacccacctcagcctcccaaagtgctgggattacaggcgtgaaaatgtggcaatctttaaagctcttcagtggatgaaaggccaccctatctgctgtccttttgaacttcgcaactttcttggtacagagtgagaggttattctcttggttttccatataagtaaactgaggctttgccagttcatcaacaggtagtaaataatatatttggaatttgaacccaagtcttctggggtcaaaggcagcattcactctgctctgtcacagcagctcctcaaataagccaacatagaaaccaagtactatgcctaggcaacaagaaaggcagcaatgaagagcaacagcagagtcaaatatgagagaaggaagttaagaaagatgttaagtactgtggggagtaactgagaaaccaccaagtatcgctaacatcacagggaacttgtcttcctaagaaaattccaagcacttaaaaccgctggtagttcatcagcaactctcttcattagatgtgcgagggacatgtgggccatagtccttctactaacttatattcttcaggggaaagttctgattctgatgagacccagcatggtagctcttaattcactgttgtcacacgactatagaacaggaagcacaacttaacacctgtgctcatgagaattttgctccttatgaccaagctaaagaaagagcttagacaggatgtgtggctataaatgtagattaatggttccttggctctttggtttgagccttctcagcagagcatcccacggagtgttttccatggggccacgagcaagagaaatccacttccctcctcctcaatgtcagaaaatagagaatattgtctttcaggatagaattaaaaagtcatagaggcagcaacttgttttcctatattagggttttaaaattctgtttttccttcctctcctgggtcagatcattgtgtggatggaccttgatttcattgtggtatctgtatgtggaccctgaagaccatggacttctaacaattccttaagttacataagcacattcctacaggtcacaagctcatttacttacaggatggttgatttggtcacaggttatttcatgaaaatacttaaaagatttgcagtgttcaaaactgcagtatctttaaacactaaaacttgaaggaagggaatttagaaatcaaaaaatctggtcaaaccatttcatggaaaaggaaagtgaggctcagagagaggaaattactttcctgggtttgtatagcctataaatggcagaaatgagagcctccctgccatttctagttttctgtctgagagactctcctgcctaatagctaattagcagagtcacagaggtcattaccttgcaattctcaagaattatgtgaggcagcatagtaagcatttatggcccttggttcctagaaggagcttagtccctgatagtcatctctgcctttgccattgtgtgagactgtcttctgtaactgtatgtcttcctccctagtaagttaatgagtaataaaggtattctatagtgagaggactctgtaagacatttcttggtgtgaggattgttccaaggttgttttgtgtgtatgtgcatgtataaacttttttagggagcatattcatagcttttacatggatctcagaggctctataacccagagaagattacagaataccagtcttgtctttggtaaggattttatagacccatcctgactacagtgatatccaacatggctatgtaatgactggcactttccccacataacatatatttattccacactcagtgcctactgtgtacatgagacctataccgggcactgggataagagacatgaaataacagctaaaattgtttattgagcagtcagtatgcattagatgctttgtagtcattttcttattcaatctgtataccctcaatttacaaatgaggaaactgaggcacagaagagttgagtgatttgcccaaagtcatacaaatagtcagtggctatgtgatgaatagttaccaacataaaagagtgagattactgctgtactaaaagtaggtacataatcccctgagcagacagtatgagagaatgatttattttacctggaaagtttaggaaggcttcacagaggagttaagggttgatctgggtcttgagggatggataagagtttgccagatacaaaaaggtaggaagagaacttcaggaggagggaacaggctgagcaaagacacggcgatgtgaaagtgggaggcttgtttggggaacattatggaatctggaggttattgtggggaatctcatcagatgcagcaagctgtttgacaggccttcagttggctctttgtaccttgctccctccgcatgctgagctgtccatagctgccctaggctggtgtctgggattttcggaagaaggttactatccaggtagtgtaacaagatgcagtgcaaaagcaccagattggggctctggctctgctgctgacttaccacctggccttaagcatgtctagttccctctttgtacattaaaatctccattggaacagtaacatggttgtattaaatgatcttgaagattttacctgcacgttttgcacatgtaccctaaaacttaaagtataataaaaaaattaaaataaaaaataaaaatataacaatataaatctttaacaataattttagtagtaaatctctacaattttacagataatccagatgcatccattggccaatggttcactttgtatgcataatatttgggaaacaggcagacccaatttcaatccttagttgtaagacttaatacatatgtgatctcgagcaaatcacttttgtatgcctctataaggataataatagctcacagaattattttaagaactaaatgatgtgtaataaagctactggtactcagtaagttttgtatccttttcctagagtgagtcttggtcataggcatgcgtatacttgcagcgtccctgggtaggccgaaagagcaaataagagatggtatctatggtattccccaggtaaaggaggccttgggttggcataagatttcacttctctttagagttacttaattagggaccagaaaggccatcagcatttgtatgagaatataacaaaggtcaatctcttcctctttactttttacctcccagtacactgtgagtaacattccccagccagcccagccagcacgtgttcattgcctctcttgacttccagactttggacttgaaggtgtcagagctctctgtgtatctttgtccccaacaagataagtctgacctccccagcaaattcaagtcctaagccactgtccaggagaaaagctagcaaggtcataaattattctccatattttccagccattggtttcccttgtccagccagaggtgtgtctcaaagtatgctgaggccagattcaatagaaacctgagccagcacctgtgtaaataatttttaaagctccttttcctgaagctggatgaatatttttaaaaactaagctggattgtcttttatctagcatgccgtctcctacattcctagtgctatggacctcttggaggaatgtggtttggttatagtggtattgtcttgtctgttgtgggggagggagacatttctttcagaagcaaggtaatactttggtctggtctatgactctattttgtttaaaatgaaactatggcagtatagtggtattcattctgcttcccataggttaactttacatccctctgtcttcacccactcttcagttctgattcttttaaaagcagccaaccaaaaccagcaagtacatactgcttatctctgacttccaccagaatcaacttcagatcttgtccaaagctccatctgaagagaggggaataacacccagccaagagccctcagggcccatcagtaagtagacatcctgtccttgaggttccttaactctgctcagcttcagaatacagaaggggttggttcttcatttgtgttgtttataactaaaagcctcctactccccacttttttgcatagcttcttctgccatcccacctgtgtagcctcttcaactcccccaaaactcctctgtagcccatgtcacttggaaagagttttctttgtctcttttgcaacttgacaatgactagccagcaagtttaagttcaaattattgttccatgggagcagagatagatataggaaacaaaaaaaagggatatggaggtatagagtgatttcccacctacctagtgagcactactgagatattcaagtactctctacccaagaattctattgatataaaggtaaaaaacttgatcttaggtctaatatccgttagtagtgtgaccttgggaaaatgataccacccccaaaggcttagttttcttaactgtaaaataggcatacagatgaccacccccagaggattcataaggataacatgagataaggcaacttgaaatttcctagcatagtgatagactttcgaaaataaaatgaatcaaacactgataacagtacttcctagtacacaaatgagaaatcagtccctcatcaaattacagcacattttcaatgctccaattatgtcactgtagaaatgctaatgtggattaaataatttgtctgttgctatttatacggataatttgatagtagttatttttggacatggatagctttgaagccttacagatgagtccatccccaagtacccaaaactaaagaaagttggctagagtgatgacaaggtggcagcacagagctccctgcgttctgggccctgtcccctagctagagagaactccaggctataagcatttgtattctcatagtccaatggcagggaagaagggctggaggtgagtagttttcactcatttattttttcaacaagcatgtatggtatcaggccttgtatgcatccagagacaaatgtgaactagccgtgtcctcaaggagattccagtctggtgggcctgccttccaaggtcagttgcagctttagcactataaagagcacctacctgcggcagatacaatgtgatgggacatgacagagaaaaaatctataagcagagcctccccattcccaggcattgaaacaatcctaaccaagactggcatagtacaatgagcctgtccctatcagcaggtttggaagccttaacaacaacaacaaaaacaataataatggtgatgataatcatagagcctaatgttaccaaacattttccatgtgttaagtactatactaagtgcatacttaatcctcacaacaatgctataagatagtagatactcttactactaccctgattttacaaatgtggaaactgaggcacagaagactaagagaacaggaatacacctaattcacctcagttcaacaaacatcaagcatctgttttatgtcaggcctcgtgctggatggcagggagagagagatgagtaaagcatagtttcagtccagtgggagcaaatgacagcacacagtggggcaggtatattgcagcccttctgcttgatgctaagaactcagtgtcagtgatgaatgaaacacagtcattctctcaaagatcttaaagcttagtaggagatatctgtgtggaaacaaaaattaaatactgctgtgataagtgtcataagagataagtggaaaatgagagagagagatcactgtagcaattgattggtttaaatcaaagcccccaaaaaaatgttattgagaattataaaacaactaattgatttaaatcaaagcccaaacagaagtgtttgctaattttatttcaatttggttgataatttggttgaaatgaatttatttcattttttattccatccttacaatggaagattagtgcttgtttcccacccaaggataccaggatatttcaggggctgtattacaatatagttaaattattcctttatctcaaagcacatccacactttcccctatccttacctttactcagggtatctcttctgcctcaggtgctttttctccacatttccatattcttaagtcctaccttccttcagggcctcactcaaatgcctcctcctccatgaagcattcacccgactgaaaggtaccccgccctctcctgtactccacatcacttcatgggtgtctccacttcctgctttatctttcagtaatacacttacagttctctttcctccactagactgagctcttcagaggaagactcacttggctgaaaccatgattttactttaaacacattgaaaacctctactggagtgcattgtgtctggtgggcttcaaccttaattcttaagtatgtgaaaacacatcacctatctggaggtttacactttctgctaatgactttatttttaagcccaccaccctaacacaacaaatacttaaaacttgtcttcatttcctttaggtctggccctcatgcatgcatataatttatagagtcactgttttgctcggttgtcctcatgcctctatattattggaggtttagattgtttccatatactcaggttgtattcatgtcctttttttctttttaaatttccttagcatccatttccaccattggaaattcagggtcaaaacaggggtttgggattggagcatgtctatcacagataaccaatcatgtgttatgacttaagaatttatgaaagggccctctacctgaagatatcttgctactgatgctgtctcacagtgtctgaaactcccatcatatgtggaattgttttggaaggctttgcctcctgggacacattcagccataatcaagaaatagtattgagcattagactgtcagtatgtccattagcaagactgtggaggaatggaatcaccaatattatattttataggggatacagaatacaagagaagttctgaagagaaaattcttatgtagaataggaaggcttagatacagcatgaaagctgcaggctttgaggagccagaggtcaaatgaaagcattgagtatttgtttagatgaaagaacagaaagggaaaaagaagcagaggaagggatagtagagagaaatgtataagttttatccatttaacttgtaattgtgtttggctatgggcacaatagaagcagtgagatcactttattttattttattctttatagacagggtcttgctatgttgcccaggctgcagtgtgcagctcttcacaagtgtgatcatagcgtactacaccctcaaactcctggactcaagcaatcctcccatctcagcctcctgagtagctgggactacaagtgcacaccaccacgcccagtgagatcacttgaaactagggagagatgtgtgagttctgggcaaccagtagttggctttacatagaactgtaggggtcaaggccaaaggggacgtcctgttccaagtcaccttctttggacattagaaaaccacgaggggtttggaaatcagaaaaccagcagaggcaggaaaactcagggcagcatgggagattcagtatatacaaaaaggttcacaccagtaatcaaacagaattttaactgctgatgtggagtagaggcagctttgtctgctgtgtgataaccaaacctttacgaatagtaggtgtatatggggaattggagggagataggtggctgtgtttagtaattggttgacttcactgagatggtttggggattgtggcttccagatgatcagattttcttttttaggtagagactccaacatcattacagaactataaattacatgtggaaaagaaaggcctcctatgttagaatagaaaataaaatgctgtggggttgagggacagaggtgctgtctaggaagtcagatagcgttttccagttctgtccctcagagttccttgtcctcattgagactcaatttctcttacttttttttttatactttaagttttagggtacatgtgcacaacatgcaggtttgttacatatgtatacatgtgccatgttggtgtgctgcacccattaactcatcatttaacattaggtatatctcctaatgctatccttcccctctcccctctccccaccacaggccctagtgtgtgatgttccccttcctgtgtccatgtgttctcattgttcaattctcacctgtgagtgagaacatgcggtgtttggttttttgtccttgtgatagtttgctgagaatgatggtttccagcttcatccatgtccctacaaaggacatgaactcttcattttttatggctgcgtagtattccatggtatatatgtgccacattttcttaatccagtttatcattgatggacatttgggttggttccaaggctttgctattgtgaatagtgccatgataaacatacgtgtgcatgtgtctttatagcagcatgatttataatccttagggtatatacccagtaatgggatggctgggtcaaatggtatttctagttctagatccctgaggaatcgccacactgacttccacaatggttcaactagtttacagtcccaccaacagtgtaaaagggttcctatttctccacgtcctctccagcacctgttgtttcctgactttttaatgatcaccattctaattggtgtgagatggtatctcgtggttttgatttgcatttctctgatggccagtgatgatgagcattttttcatgtgtctgttggctgtgtaaatgtcttctttgagacgtgtctgttcatatcctttgcccactttttgatagggttgtttgtttttttcttgtaaatttgtttgagttctttgtagattctggatattaccctttgtcagatgagtagattgcaaaagttttctcccattctgtaggttgcctgttcactctgatggtagtttcttttgctatgcagaagttctttagttgaattagatcccatttgtcaattttggcttttgttgccattgcttttggtgttttagacatgaagtccttgcccatgcctatgtcctgaatggtattgcgtaggttttcttctagggtttttatggttttaggtctaacatgtaagtctttaatccatcttgaattaattttagtataaggtgtaaggaagggatccagtttcagctgtctacatatggctagccagttttcccaacaccatttattaaatagggaatcctttccccatttcttgtttttgtcaggtttgtcaaagatcagatggttgtatatatgcggcattatttctcagggctctgttctgttccattggtctatatctctgttttggtaccagtaccatgctgttttggctactgtagccttgtagtatagtttgaagtcagatagcgtgatgcctccagctctgttcttttggcttagggttgacttggcgattcaggctcttttttggttccatatgaactttaaagtagttttttccatttctgtgaagaaagtcatgggtagcttgatgaggatggcattgaatctataaattaccttgggcagtatggccattttcacaatattgattcttcctacccatgagcatggaatgttcttccatttgtttgtatcttcttttatttcattgagcagtggtttgtagttctccttgaagaggtccttcaagtcccttgtaagttggattcctaggtattttattctcttagaagcaattgcaaatgggagttcactcatgatttggctctctgttttctgttattggtgcataagaatgcttgtgatttttgcacattgattttgtatcctgagactttgctgaagttgcttatcagcttaaggagattttgggttgagacgatggggttttctaggtatacaatcatgtcatctgcaaacagagacaatttgacttcctcttttcctaattgaatgccctttatttccttctcctgcctgattgccctggccagaacttccaacagtatgttgaataggagtggtgagagagggcatccctgtcttgtgccagttttcaaagggaatgcttccagtttttgcccattcagtatgatattggctgtgggtttgtcatagatagctcttattattttgagatacgtcccatcaataactaatttattgagagtttttagcatgaagcgctgttgaattttgttaaaggccttttctgcatctattgagataatcatgtggtttttgtcgttggttctgtttatatgctggattatgtttattgatttgcgtatattgaaccagccttgcatcccagggatgaagcccacttgatcatagtggatacgctttttgctggtattttattgaggatttttgcatcaatgtttatcagggatatcggtctaaaattctcttttttgttgtgtctctgcctggctttggtatcaggatgatgttggcctcctaaaatgagttagggaggattccctctttttctatttattggaatagtttcagaaggaagggtaccagctcctccttgtacctctggtaggattcagctgtgaatccatctggttctggactttttttgattggtaagctattagttatatcctcaatttcagagcctgttattggtctattcagagattcaacttcttcctggtttagtcttgggatggtgtatgtgtcgaggaatttatccatttcttctagattttctagtttatttgcatacaggtgtttatagtatgctctgatggtagtttgtacttctgtgggatcggtgattatatcccctttatcattttttattgcgtctatttgattcttctcccttttcttctttattagtcttgctagtggtctatcaattttgttgatcttttcaaaaaaccagttcctggattcattgattttttgaagggttttttacatctctatttccttcagttctgctctgatcttagttatttcttgccttctgctagcttttgaatgtgtttgcccttgcttctctagttcttttaattgtgatgttagggtttcaattttggatctttcctgctttctcttgtgggcatttagtgctataaatttccctctccacactgctttgaatgtgtcccagagattctggtatgttgtgtctttgttctcattggtttcaaagaacatctttatttctgccttcatttcattatgtacctagtagtcattaaggagtaggttgttcagtttccatgtagttgagcggttttgagtgagtttcttaatcctgagttctagtttgattgcactgtagtctgagagacagtttgttataatttctgttcttttacatttgctgaggagtgctttacttccaactatgtggtcaattttggaataggtgtggtgtggtgctgaaaagaatgtatattctgttgatttggggtggagagttctgtagatgtctgttaggtctgcttgacagtggagtgttaaagtctcccattattattgtgtgggagtctaagtctctttgtaggtctctaaggacttgctttatgaatctgggtgctcctgtattggttgcatatatatttaggatagttagctcttcttgttgaattgatccctttaccattatgtaatggccttctttgtctcttttgatctttgttggtttaaagtctgttttatctgagactaggattgcaatccctgcctttttgtgttttccgtttgcttgataaatcttcttccatccctttattttgagcctatgtgtgtctctgcatgttagacgggtttcctgaatacagcacactgatgggtcttgtctctttatccaatttgccagtctgtgtcttttaattggagcatttagcccatttacatttaaggttaatattgttatgtgtgaatttgatcctgtcattatgatgttagctggttattttgctcgttagttgatgcagtttcttcctagcctcgacggtctttacaatttggtatgtttttgcagtggctggtaccggttgttcctttccatgtttagtgcttccttcaggagctcctgcagtgcaggcctggtggtgacaaaatttctcagcatttgcttgtctgtaaaggattttatttctccttcacctatgaaggttagtttggctggatatgaaattctggttttaaaattcttttctttaagaatgttgaatattggcccccactctcttctggcttgtagagtttctgctgagagatcagctcttaatctgatgggcttccctttgtggggaacctgacctgtttctctggctgcctttaacattttttccttcatttcaactttggtgaatctgacaattatgtgtcttggagttgctcttctcaaggagtatctttgtggtgttctctgtatttcctgaatttgaatattggcctgccttgctagattggggaagttgtcctggataatatcctacagagtgttttccaacttggttccattctccccatcactttcaggtacaccaatcagacatagatttggtcttttcacatagtcccatatttcttggaggctttgttcatttctttttattctttttcctctgaacttctcgcttcatttcattcatttgatcttcaatcactgataccctttcttccagttgatctaatcggctactgaggcttgtgcatttgtcacgtagttctcgtgctgtgtttttcagctccatcaggtcctttaaggacttctctgcattggttattctagttagccatttgtctaattttttttcaaggtttttaacttctttgccatgcgttcgaacttcctcctttagctcagagtagtttgattgtctgaagccttcttctctcaactcgtcaaagtcattctccatccagctttgttccattgctggtgaggagctgcattcctttggaggaagaaaggcactctgatttttagagtttccggtttttctgctctgttttttccccatctttgtggttttatctccctttggtctttgaagatggtgatgtacagatgagcgtttggtgtggatgtcctttctgtttgttagttttccttctgtcaggaccctcagctgcaggtctgttggagtttgctgcaggtccactccagaccctgtttgcctggttatcagcagcagaggctgcagaacagtggatattggtgaacagaaaatgttgctggttgatcattcctctggaagttttgtctcagaggaatacccggatgtgtgaggtgtcagtctgcccctacttgggggtgcctcccagttaggctactcggggttcagggaaccacttgaggaggcagtctgtccgttctcagatctccagctgcatactgggagaaccactactctcttcaaagctgtcagacagggacatttaagtctgcagaggtttctgctgccttttgttcggctatgccctgcccccagaggtggagtctacagaggcaggcaggcctccttgagctgtggtgggctccacccagttcgagcttcccagctgctttgtttacctactcaagcttcagcaatggcgggcacccctcccccagcctcgctgctgccttgcagtttggtctcagactgctatactagcaatgagcgaggctctgtgggcgtaggaccctctgagccaggcacaggatataatctcctggtgtgccgtttgtgaagaccattgaaaaagtgcagtattatggtgggagtgacccgattttccaggtgccatctgtcacccctttctttgactaggaaagggaattctctgatcccttgtgcttcctgggtgaggcgatgtctcgccctgctttggctcatgctcggtgcgctgcacccactgtcctgcacccaccatttgacactcccctgtgagatgaacccggtacctcagttggaaatgcagaaatcacccatcttctgtgttgctcacgctgggagctgtagactggagctgttcctattcggccatcttcacaaaaatcttactttggtttctagtgttaccacccactgttctttctcatctcaaccctgagtataagtacagatcacattccttgggttcttagaaaataatagaaatgaactctcattcatcaaaatgcccattagtaaatactgagggagaacaaactagaaatccagtatagaaaataaaaataggattatattccttggaatctcagaaaaaaacaatgaagagctttctttgggcattagacactttcccataaggtggctgactctcttttagtcatgtcagcttggcccaatcttcacttggtagcccttctttcttcttcattaatccatctcctatgctcctatggggtcctagagaaatgcccatcatgtacacacacatctaataacacaaagatcactctcgactagcaagcccttttatgatggtgtgagcatttgacacccttgttgctagtaacatcagtgagtgacctgacccatttttggaacagaatatgatcagtatgttgcctcaaggaggccctcactgttctaggaaatataattccagagtttgctgactcacaccatggaatatatgcataaaatggatcctgcagataagcctttctctgactagtttcagacatttttttctgggtaattttaaagttattttttatttttgtgggtacaaagtaggtgtatatatgtatgaggtacctgaggcattttgatacaagcatacagtgtataataatcaccagagttaatggggtatccctcaccacaagcatttatcctttctttgtgatacaaacaatccaattatattcttttagttattttaagatgtataataaattattgttgactgcagtcaccctgttgagctatcaaatactagatcttattcattctaactatacttttgtacccagtagccatcccacttcctcccctcccactacccttcccagcctctgataaccatcattccactctctatctctatgagctcaattgttttaagttttagctcccacaaatatgtgagaaaatgccaagtttgtctttctgtgcctggcttatttcacataatataatgtcctctagttccatccatgttattgcaaatgacaggatctctttcttttttatggcttaatagtactttattgtatgtatgtaccacattttcttcatccatttgtctgttgatagacaagagttgcttccaaatattgactattgtgaatagtgctgcaataaacgtgggaatgcagatctctttgatatactgattttctttctttagggtgtatacccagcagtgggattgctgggtcatatgatagctctatttttagtattttgtggaacctcaaatctattctacataatggttttactgacttacatatccaccaacagtgtatgaggatactcttttctccacatcctcaccagcattcattactgcctgttctttggatgaaagccattttaactgtggtgaaatgagatctcattgttgttttgatgtgcacttctctgatgatcagtgaggttgaggaccttgtcatatatctgtttgtcatttgtatgttttattttgagagatgtctacccagatcttttgcccattttttaatcagattgttagattttttttttcctacagagtgcttgagctctttatatgccctagttactagtccctggtcagatgggtagtttgcaaatagttgctctcattctgtgggttgtctcttcactttgttgatcgaatcacttgctgtgcagaaggtttttaacttgatgtgacctcatttgtccatttttagttgcctgtgctggtgcggtattactcaagaaatttttgcccagattaatgttctggagagtttccccaatgttttcttgaagtagtttcatggattgatgtcttagatttaagtctttaatatgttttgattttatttttgtatttgctgagagatagggctctagtttccttctgcatatggatatccagtttttctagcaccttttgttaaagagactattcattctctaatatacgttcttggcacctttgttgaaaataagttcactgtagatgtatggacttgtttctgggttctctgttctgttccattggtctatgtgtctgcttttatgtgaataccatgttgttttggttgcaaaagctctgtagtataatttgaaatcaggtaatgtgattcttccagttttgctctgttctttttcctcaagatagctttgcctatcctgggtctcttgtggttctatataaattttaggattattttttctatttatgtcaagaatgtcattgatattttgatataaattgcgttgaatctgtagatagcttcaggtagtgtggacattttaacaatatcaattcttgaaatccacgaacatggaatatccttctattatttggatgtcttcttcaatttcttatattaatttttttttagttttcattgtagagatatttcatttatttgactaagtttattgctaggtattttattttatttttacctattgacaatgggattgctttcttgatttcttttttagattgttcactgttggcatacagaaatgctactgatttttatgtgatgattttgtatcccgcaactttactgaatttgtttatcagttctaataggcttttggtgcagactttaggcttttccaaatataagatcatattatctgcaaacaagaataatttgacttctttcttttcaatttggatgcctttcatttctttctcttgtctgattgctctaactaggacttccagtactctgttgaataacagtggggaaagttaacatccttgttttgtttcagatcttatagccaaggccttcagtttttctgaatttagtatgatactagctatgggtctgtcatatatggcttttattatgttgaagtatgttccctagttttttgaaggtttttatattttaaggaagataaaaattgaactttatcaaatgcttttcatgcaacaattgaaatgatcaagtgctttttgtctttcattctgttgatacgatgtatcacactgattgacttgtgtatttagaaccatccttgcatcccgtggtaaatcccacttagtcatggtgaatgaactttttaatgtgttgttgaattcagtttgctagtattttgttggggatttttgcatcagtgtttatcagggatattggcctatagttttccttttttttatgtgtcttttgggttttgttatcagggtaatactggccttgtagaatgagtttggaatgattctctcctctattttttgaaatactttgaataggattgatgttacttctttaaatgtttggtaaaattctgcactgaagccattgggtcctgggctttttactgctggggagacttttcattacagcttcaatcttattacttgttattggtctgttcaggctttagatttttttcatgaatcaatcttcacaagttgtctgtttctcaaaatttatcaatttcttctaggttttccaatgtattgtcatccagttgctcataatgccctctaatgatgccttgaatttttgcagtaaccactgtaatgtttccttttttaatctctgattttatttgagctttctctttttttcttagtctagctaaatatttgtcaatgttgtttgttcatccacaaaaccaacttttcatttcactgatcttttgtattattttttccttttaattttatttatttctattctgatatttatcatttcatttcttccagttatttgagtttggtttgctcttgcttttccagttctttaagatgcattgttaggttatttatttgaacttttttgatataggtgcatattgctataaactttcaccataatattgcttttgctgtatcccataggttttagtatgttgtttagtatgtttccaatttggtacatttcaataaatttttaaattttcttctttatttattgacatagtcattccagagtatactgtttaatttccatgtggtttgtatagtttccaaaattcctcttgttattgatttctagttttattccattgtggtcagagaagaagcttgatatgaatgcaattgttaataatttttttaaaacttgttttgtgacctaagatatgatctgtcattgagaatgatccatatgctgaggaaagaatgtatattctgcagccattggataaaattgtctttaaatatctattaggtccatttaagacataatgcagattaaagccgatgtttcattgttcatttttctgtctggatgatctcttcagtgctgaaagtggtgtgttaaaatctctaaatattattgttttgggatctttctcttctttcaactctgataatatttgctttagatacctgggtgctccagtgttgggtgcatatatacttaaaattgttgtatcctcctgatgaattgacccctttatcattatataatgaccttctttttctctttgtgtagtgtttgtcttgaaatctattttgtcggatattagtattgctgctaatttttttggtttccatttgcatgaaatatctttttcattcctttattttcaggcagcgtgtttctttatatttaataggtgaaatatgtttcttgtaaataaaaattattattttaaaatatttttaaaataatactattttttaataagaacaattattattttttaaaaaatttcattagttttgggggcacaagtggattttggttaaatgggtgagttctttagtagtggattttgagattttagtgcagcagccacctgagaagtgtacattacccatatattatatatatactatatatgctttatatatatagtgtgtatatataatatatatacaactacatattgggtaatgtacacttctcaggtgactgctgcactaaaatctcaaaatccactactaaagaactcacccatttaaccaaaatccacttgtgcccccaaaactaatgaaattttttaaaaaataataattgttcttattaaaaaatagtattattttaaaaatattttaaaataataatttttatttacaagaaacataattcacctattaaatataaagaaacacgctgcctgaaagtaaaggaatgaaaaagatatttcatgcaaatggaaaccaaaaaaattagcagctatactaatatattatatatatactacataaagcatatatatagtatagtatatatataatacatttataaagcatatatatagtatgtagataatatatgtttatatactttaagttctgggatacatgtgcagaacgtgcaggtttcttacataggtatactcgtgccatggtggtttgctgcacccatcaacctgccatatacattaagtatttctcctaatgctatctttcccctagccctaccccactccctgacaggccctggtgtatgatgttcccctccctgtgtccatgtgttctcattgttcaactgccacttatgagtgagaacatgtggtgtttggttttctgttcttgtgttttagtttgctgaggatgatggtttccagcttcatccatgtccctgcaaaggacatgaactcatcctttttgatggctgcatagtattccatggtgtatatgtgccacgttttctttatccagtatatcattgatgggcattttggttggttccaagtctttgctattgtgaatagtgctgcaataaacatacgtgtgcatttgtctttatagaagaatgatttataatcttttgggtatatacccagtaatgggattgctgagtcaaatgatatttctggttctagatccttaatgaattgccacactgtcttccacaatggttgaactaatttatgctcccaccaacagtgtaaaagcgttcctatttcttcaaatcctcaccagcatctgttgtttcctgactttttaatcgccattctaactggcatgagatggtatctcattgtggttttgatttgcatttctctaatgaccagtgatgatgagctttttttcatgtttgttggcagcataaatgtcttcttttgagaagtgtctgttcatattcttcacccactttttgatggagttatttgttttcttcttgtaaatttgtttaagttccttgtcgattctggatattagctctttgtcagatgaatagattgcaaaaattttctcccattctgtaagttgcctgttccctctgctgatagtttcttctgctgtgcagaagctctttagtttaattagatcccatttgtcaattttggcttttgttgccattgcttctggtgttttagtcatgaagtctctacccatgcctatgtcctggatggtattgccttggttttcttctacagtttttatggttttaggtcttgcatttaagtctttaatccatcttgagttaattttgtataacgtgtaaggaagaggtccactttcagttttctgcatgaggctaacgagttttcccaacaccatttattaaatagggaatcctttccccattgtttgtttttgtcaagtttgtcaaagatcaggtggttgtagatgtgtggtgttatttctgaggcctctgctctgttccacgtgtctatatctctgttttggtaccagtaccatgctgttttgggtactgtaccacttgattggtgagagagggaatccttgtcttgcactggttttcaaagggaatgcttcagcttttgcctattcagtatgaccaatatgtagtcttttattcctcaccctctctcaacaccccacccccacggagtcctcaaagtccattatatcactctgtatgtttttgcgttctcatagcttagctcccacttataaatgagaaaatacagtatttggttttccattctttggttacttaattagtataatggcctccagctccatccaggtgtcttgtttttcatccattcagccagtctataacttttgcttggagagtttcgtccatttagattcagcgttatgattgataactaagggcttactcctgccatttggttgttttctggttattctgtggtcttctcttccttttttccttctttcctgtctcccttttagtgaaagtggttttctctggtggtgtattttattttcttcctttttatttttttttgtgtgtatttgttgcatgttattgatttgaggttaccatgaggcttgtacataatattttctaactcattatttcaaactgatgacaacactctatcgcataaaaaaacatggaaagagaaaactaataaaaactctacattttaacttcatctctctgcttgttgtcactttgtcgtttctatttacatcttattgtactgtttatgtcttgaaaagtagtttcagttattacttttgattggttcatctcatagtctttctactcaagatatgagtagttcacacaccacaattacagtgttacaatattctgtgtttttctgtgtactttcaattacccatgagttttgtattttcagataatttgttattgctcactaacatcctattctttcagattaaagagctccctttagcatttcttgtaggaaaagtctggtgttaatgaattccttcagctcttgttgatctgtgaaagtctttatttttccttcatgtttcaaggatattttcactggatagtctattctagggtaaaagttttttttttttttttcttcagcccttcaggtaagtcatgccactctctcctggcctataaggctaccactgaaaagtctgctgccagacatatatgagttccattctatgttacttgtttattttctcttgttacttttaggatcctttctttatctttgacctttgggagtttgattattaaatgccttgaggtggtcttttttggattaaatcttcttcgtgttcttgtacttggatattaatatctttctctaggtttgggaagttctctgttattatccctttgaataaactttctaccaagatctctctttctctctctgtctctctctctctctctctctccttcttaaggccaataacttttagatttgcccttttgaggctgttttctagatctcgtaggtgtgcttcattgtttgctattttttttttttttttgtctcttctgactacattttcaaatagcctgttttaaaactcactaattctttcttttgcctggtcaattatgctgttaagagactctgaggcattcttcagtgtgtcagttgcatttttcagcaccagaatgtctgcttatttttttttagattatttccatctctttgttaaatatatctgatagaattctgaattctttcttagtgttatctttaatttccttgaatttcctcaacacaactattttgaattatctgtctgaaaggtcacatatctctatttttccaggattgctatctggtgctttatttagttcattttgtgaggtcatgttttcctggatggtgttaatgctagtagatgtttttcagtgtctgagcattgaaaagttagatgtttattgtagtcttcacagtctgggcttgttcatacctgccctccttgggagactttccaagtattcgaagggatttggatgctgtgatcttagtctttggtcactgcagccatatctgctttatggagcatcccatgctcagtaatgctgtggctctttcagactcatagagttactgcctgcatgctcttgggtaagagccaggaaaattccctggattaccaagcagagactcttgttctcttctctcactttcccccaaacaaatagagtctctctctctctctctctttctctctctctctctccctctcattctctgccgacctgcctgaatctggggtagggatgacacaatcacatttgtagtcaacaccattgggactgtgctaggtcagacccaaagctggcacagcactgagtctcgcccaacgcccacagagaccactccctgggtaatgtctgtgtttgctcaaagcctaagggctatacaatcagtcagtggtgaagccagcctgtcttatgtccttcccttcagggtgatgagttcctcaagcaggtccagggatggtgtccaggagccaaggcctcgagctgtgactgagctggcacccaatccataagacaaagattttttccacactttccttccttgtcctcaagcaaaggagtctctccctgtggccaccaccacccccatgttcatggcaagtattgtctggctaccaccaatcttcactcaaggcccaggggttctttagttagcttatggtgaatgctaccaaggctgagtctctcccttcaaggaagtgggctcctctctggcccagggcaggtccggaaatactatccaagagccaaggcctggaatcagtttccccaagagtccatttggtgctctacacccactgtggcagaaccagtacccaagctgcaagacaaagtcctctttactcttccttctcctttacagagactctccctatagccaccacagctgggaatatgctgggtcactcttgaagcaagaacagctctgagtctcactcaaaactcctggcaagtactgcctggctatcacactgattattcagggcccaagggctctttagtcagcaggagatgaatcctgccagtactgattccttcccttcaaggcagccggtttctttctggcccagtgtgtatctagaaatatcatttgggagctagggcctggcatggtgacctcaggactctgcctggtgccctgttctactgtggctgatgtagtatccaaattgcaagaccaagtcctctttactctcccctctcctgtcttcaagcagaaggaatgagtccgccctggagttgggagctgcattgcctgggattggaggaggggtggcacaagcactctcttggtcaccccagctggtgtcttactaggtcgcatgttccccaagtccactggctctgaggctagcacaccaggatttgaccaagaattgcaattcttgtggcttacactgcctttcaagtttatttgagatcccagagcactttagcccacagtgacagggcttgccagaatttagtttctgactgctgagatggacaatttgcgtctgattagggctggtctaagtgctccttctgtgggcactggctgagttctgctccatgttgctttctgctgtgacagggcaacattgagtttcaatgcaagtcccacagtcactgcaatcttcctctcccaagcctgctctgaacaccatgtggttgctgctgggggctgggggagggatgttgtaggcaattcaagaatgtctttcctacccttttcggtgcttctttccttggtatgatattaaaaccagttactgtgattgctcacctgatttttggttcttatgaaggtgcttttttgtgtggatcactgttcaatttgtgcctgcaagcggggatgggggacaattgctggaggcttctctttggccatcttgctccacctctaccctagtattagcaatttcaaagcagttgggatggaggtagaaggaaagggcgcttggaatcagaaaatccatgtcttagctttgagccttagaaaattcatttgacccttgtaagcctcagttgcttcatctgtaaaagagaaataatataatggctgaaaagatcaaaggtgataatgcttttgaaaacactatagaaaatgacaaaatatcacatgagtattattttctagtttctaggagtctccttaccattgtacaggacaaccatgtctatttttaaataaattattatttgcctctgagcaaccctgcaaagagttgcctgtaggagaaacagctttacttgcaaatcactccactgttttctttgtgcacagcttattaatacataaggcacatgtcctccagcctgcagtaacattggaatcattacctctttggagtacctaccagagcttctcaaagtgaattttgtttatcaccacaaaaaatagtctgttgcagagataacctccaaattcaatgacaatatttccaatcacttttgcatgatgcagaaatagacaaatatataattttgcttatagagacaattattgtctcccaacaagtgatcagtagtcagaaaatggccaagaaataccatggggtgtgccttcccataacagcttatctttgtgttttagttgcaaggttactaaaagcctgtgcagggtttatggcaaaagtaaaacttgctccaggagcaagcccttgtttcattgtctaatgttcttaatccccagcagacaggatttggatctggcatttggtaacagggcagtttccaaagttgctgtacgcaacttgaggaagagaggtgatattatcggaatgaatttctttgttgtaagttataaatgtatgggcttttccaatcccatcacccttaaaactttatttgttttctgcagtgagggtgtctccgttgtctttaatatgcttgctttgagttcatggatgaacattcctgcctggctgacatgtggactctctgaaattgttataaggtctttttctttgtttttttcttgatgcccaagctgccaagggtagtactggcagtggtgggcagacaaggaggtgatagcaaactttgtcctctggcctcccttgacccattccattcattatctaagggactccaagccagcattccacagagtgccctcaccaaactcactaagactgaaggcgaaccaggattccaaacagccattatgaaaggaaagagagagagacttagggtttgcaaaataagataccctgttgattctttttattccatacagatactactattctttaggaaaacgttaaaatcacatgatcttccaggacctgggctgcttctttaagaagcatgttacagaaagctttattggccaacaacatattgaaagatagattaatcaatcattcattcaaataaggtatattcagaattgaggtatattgtagccagacagtgagactacaaaaaaagaatgcaccgtacccttatctcttgcacaatctaacgagggagataaccactctttcaatttatagtgacctataacatttcgtacactgctgaatatctttacatggtaataacacaatggaaagcttgcaaaatagacagaggctaggggaagaaggattgagtgtgaatatagcctcttataaatcgagaggaatggtctgtgtcttctgatcatacagagataataaatatggaaatgatttcaaactaacaaagcaaatgtgcagaaaatactgagaatatagtgggcaggatacctgagttttggttccatctctgttattgactcattgtgtaatctgagtcaggtctgttctgctctctggatctcaccctttcctatctgtaaaatgagattgttggattagatgatctccatagaggttctcacctattctgacattcaaaaggactcctaatttttcttatataataataatatatatgatctgtagagtgctttacactttatatgatatttttgcatctgttatctcatgtgagaaaagcactggactgctggactggcaatgaggacacctggattcttgtctctgttttgacactgattcatggtgtgatcttcaagcaaattctctgagtttcagtttctcaatctgtaaaataggggggtatgaagattggactaaatcagtaggtctctaaaatgttccacaaagccctggggtggggggctcctacagagtttcgctaaggcaaaccacaacgctaagcctgcatggaagaggagaaaaagagtggcctgacaagagaagttcccagtttcctatgccaaccccaggcagattacatttaattttatctgatttatatagagagtttctatgtaatgttttattcttaaaaatagtttactataaaaaactcaactggtttgatttttaaagattgcacatataagtgagatcatgcagtcagtatttgtctttctatgcctggcttatttcacttagcataatgtcttccagcatcatctatgttgctgcaaatgacagacttttcttttcattaaaggctatatagtattccatcgtgtatgtacaccacattttctcttttgtaactttcattttaggttcaggggttcatgtgcatgtttgatatataggtaaactgcatgtcagagaggtttcttgtacagattatttcatcacccaggtaataagcatagtatctaatcaatttttttctgatcctctcccttctcccaccctacaacctcaagtaggccctggtgtctattgttcccctctttgtgtccattacaccacattttctttatccacttatccatccatggacacttagtttgcttccatatgttggctattgtgaataatgctgaaaaaagtcaaactcatagaagcagagagtagaatggtggttaccagggactgggaggcagttgactgagctaggaaaagagagataataaaagggtacaatgtgtcagttatatagaaggaataagttatattgaactattgcacagcatggtgaccatagttaataataatgtattatatgtctcagtattgctaaaagagtaaatttaaatattctaaccacaaaaaattattagtaggcaaggtgatggatatgttaatttgcttgatttaatctttctagaatgcatacatatatcaaaacatcccactgtaccccataaatatatacaattattatttgtcaatttagaaatttaaaaacttgatttagatgagctctaaggccttaagtattaaagtattaagtattaaagtgatatgtaaccaagtatattgtttggtaacttcatttttgttattattttaacaaaccaatatattgtgaatatacttccaagtgaaaagaaaaaagacattgcagtcatcactaataactgcaaaacattcctttgcaagaatatggaataattcatttaatcattcccctaatgttagacattcaaatgtttccaactttttctatttaaataatgctacaataaacttctattttgtgcttattgtattattttcttacaacacatccctagaagtggaattcctagaagtttatacacatttccaatttttttccaaatatatggcaaaatttctctctaaagtatttttattcctaccagaaatacctcttcaccaacacgtagtatttaatctgtaccaatctggcttaagacaatgatatttaatttgtatttctgtgatttctagctaaattaaataatcttcatatgcttattggtcatttgtacttctaactgctttctcctgtctgttgcccatttttctattgtgctgtttatttttatatatcgaatatattgaccattggttttacatacttgatgctaataattattcttagtttatggtttgtctttgagttttataatggtgtttatttcacataagaaattataaatgttttctaatgaaatttatcaagtctgtcttcacttatgttttcttcattgtcaataacttaaaatgaccttttctacctttaaaaattttgaaattttcctctgtattgtctaatagtacttacatgatttcctcttttaaattgacatatttaatccatttggaatttattttgattttaactagtaatttaactttattttcttctccaaatgattcactagttgttctgacattatttagtgaataattcatcctttcttcactgaattggaatggcatattccatatactgtgtctggttttggcttttctgatctcttccactgatcaacctaagctggagccagtatcaaactgttgtaatcattatgcctttagatactttaaatgtacagcagggaatgtcttattactcttatttttcacaaatatcttggcattgtctcatgttttattccttcagataaattttgggattattttgtcaagattttgtttgagttgttttaaatttttagatttcattgggaaagaactgaaatccttgaaatattgcttcttcttagccaggaatatggtacaactttgcatttaattcagttctttccttaaataccaccatgaagttttttgttttgttcatataggtcctgcattaacaccatatatataaagtgtgagaaatactacattcttcaggattctctgtaggttaacaatgaagatgatgactcaaccctttctttgtttgcataatgtgatgccactaatagtgggtaacttctctgccttacctcctctgttccaaacaggatttttcagaatgaacaaattaaaagaatcataatcagacactaaccccaagccatactgcatggcagcaccaatgggactgacagaaaacaacagaaataggaagaaatcctacagagaaacaaacttgaaagctgtctcatggcctttgaatcatacttaagttttatgatggaaggatacgactatgaagaaagacacagagcaacatcagacagtcaagaatttcagagccagctggcatgcagtggacctcatgccagcccattttatgactatttaggtagtcaagggtttaagatttttctaataagacagttattatgcatttcaatgagtgatttctttgcagctctagagtgtggccttacctacttcaacatgagaagatttttgtattttgtcagtcatttcacaatgacttttagtgagcccttcattatagactgtggatacaactttgctgttggaaattaacagtgtcaaacaactgggtataatgtttgtaatatctgaggagggggagctgcctaggaagttgtattccctgtgttaatttttcagtctcttaggttatagaggaccttctagaaccaccttacagcaggattacatcccatttacacagttctctgtcacttgaatacagagaagggatccacaaggccatatgcttcctagacaaagagaaaagatttctgccacactcagaacgctttgtcttcagactataatcacccacaccatatttcctttggatccactttccagatttttgtgctggcactaacaccaacttgctgtggcttggggcatgtaatttcaatactttgtgcccattttcataagtgaagtgtcaggcatcacattggacattttaagattctttacagcccaatgattctgtgtttctaattaggcccaatgggttagagctaaaaggaaacagtgagtttcctggaaggaaaggacatataacacagtccagaggtaaaatgggctgtattcaagaaaagataggacaatactttgcagggatgctgcagagaggattcaagccttgtatggaggaatggatgtgatacaaccaaaaagtctttaaaaattctttccaactaatctgagatttgtaaccttatggactgtgatttgcagcaaaccaaggatgtgataaagactagtattgtttctagaatgcaaggatggttcaacatatgcaaatcaatagtattaacagaatgaaggacaaaaactatatgatcatctcaatagatgcagaaaaataatttgacaaaattcaacatcattttatgataaaatctttcaagaaattgggtattagaaggaatgtttctcaacacaataaaggccatatcagacaagcccacagctaacattatattcaatgaccaggaatgagataaggatgctcactctcaccacttctgtttaacatagtactggaagtcctagccaatttcatattaatgagcctcattttcttcatcatagaatgaagtatataataatccctgttatacttactttgcacagattattattattatttaattattattttgagacagggtctcactctgtcacccaggctggagtgcagtaccacaatcacagcttacttcagccacgacctcccaggcataaaggatcctagcccctcagcctcctgagtagctgggagtacaggtgcacaccaccacacctagctaatttttttttttcatttttttatagagacggagtctcactatgctgcccaggctggtctcaaactcctgtgctcaagcaatctttccaccttggccttccaaagtgctgggattacaggagtgagccactgcacctggccttgcagattattattaaactttgtaaactaatcaaatgagagtgattattgttactgttaagaactctgatagcctcatccatatatttggagaaattgaataaataataggaaagaaataatagcatcccaatgattttaccttggctctaccatcatttggggaagtgataattcagataggagaagtgacttggaagcagtcttgagagattgcctgttccatcccctatctttgtccttaaaccaaattgtacagataaataaggtcttatttttaggacttacagaaaaaagattcctttcatatccatctttgcaatcctcaaccacttctgtcactattatgtgtcatttcaaacattaaattcctcattctgctttgaaggaacacatgtgtcatgtgtacccatttgtatgttttggtgtgttttatgctttatgtgatcacccacatatgcacagataattccaaaatccagtgtgtgggtgttgtattccctgtgttaattattcagtcacactcaaacacctatgcactcacacatacatgaatacacacatgtacattagcatgtttatgcttatgttgcatgtgactggcaacatcagtgcctttctaaggcaatgttaactaccttgagttttgggagagctttagagaacaaagacaagagactaaatgattctagatgtaagagacaatgttgcaataagttactatcctaaaaagacagaatacagggacaagagactattattttggatagtttcttgcttaccagtaatacttaagtcctttacattaaaaaaaaaaaactctgtaaatatattgcagaagaaatccagacatccttcaagattcttagagctggaaaagattttaatgactttccagtccaatctatctcatgtaatcaatggggcccagagaggcaaaaggtcttgtccaaggtcatatagtgagttagtgataaggctgaacaaggattcagatgttggggcttccagcccactgctctttctctcatctgggatttgtgtatttttgttcattagagattttcctctgtaacctcaatatccaatgcagggccttgcacataatagattatcagtaaatgttaaattaatatgtcatggctttggttgtactgggcttttgcacttactcctgagtaaattgtaaagaatatctacgttttaggttgccttgttttagaccaagaggtacccagagaaaaggtgtgaactatgctaaggaaattatccgagttccaaattgaaaaaaaaaaaaaatcatgcttttccgctataacctctctcattcacagagtgattctctttcagaagggcaatctagaactattatgggagccatattccattggtggtgcaaccatttcttgacaaactagggtccaagaaagtattttcctggggaagatgagatttctcaaagaaggcacgcactttctaacctaagcttatttcagtaatcaatgtaacaagctggtcttgatgattgcagcagtaccaatactgtgggagtgtaccagttctagaacagctacaacattggaattgaacgcactagaattggatacaggacctgtttttgaggagctaacacccaaaggctgaacagcactcgtagcaccgtcctttctgtgcacatatggtagtcctcagtttgcaacagaaataaagctgttagcaaattatgtgttctatttatgcaaataaaatcttgtggtatgctagaaagagcactggcctggagaccttagttttctcatatgttaaaaacccctaacacaggcctggttcatagtaggcacccaataaatagtagttttcttcctttgggggcctccgattcagtgtgcttcttcaggtaagtcacttccctggaactcctccttggaatgagagttgtactgttgtgatttttaacagttccttcaagccaagcattttggaatcctttcataaagggagaaaggaaggaaagaagaaaggaaaattaaaggaaaaagaacaaataaaacgttaaaaaggaggaaaggaaaaaggatcctttactacaataaaactaatcttatgttcttgcaagtagcactttaagtaaaagaagttctttgctgacctggttactactgaacctactacataaaatagcctactataatagatgcatttatgtgcctaatcttcactttttaggcttagtaaagggagaggaaagctgatgtatagttaaatttatgtttttagttgtttttttttctactctcaaatatcaatcactctttagtttctctttctttttccgaccacaagcattcttcctctgcttaaagaagcttccctaaaatcccagtctatccagtaagccaaagcacagcaataaatttgaggaaaaaataccagggacttagagacagaaaggagtgaggggatgcagaagctgaagctggagcacggttgcaagcatgagaagttctgcgtgtttcagagcagccaaggatgtatttttgcctattcctgctggtgactctgtgtgtctatgcatccatctgctatatttacatgtttagtcagtcaatccacgtttgctgagagcctgctgtgtgccaggattgtgctagcgtaaaggagcaaagtattgagcaaaatatgtttgagcagctgtaattctgaggatctctaggtctgagcatgtgtatgtgtgtgcgcttctatgtatctgtgacaactccaggtgttcatgacagtgatctttgttactctgttggcttcatcgaacttccttttacttgctgtgattcactacatagagtgggctttatctctgatttttataacctgcaagactgggggtatgatcaccagcaatctaaaaacagttagaaatcccatggagttatcttttgtagaaattttcctctactaatattatgaaaaataagcatcttattagctcgagtgtaattctatgcatgattacaggtatcaataggaagaaacattgactgagttcaaatctcttctacgccatgctaaaggggtgacaagttccacaatggatcattttctcatgggcatttctgacttttggtaaaagtagagcaccttattttaaaaaccattgagtagtcctaatagtggagatatcatcaggatctgaattgttcatccctaaaaaaaacaccaatggaaatcaaacaatatagtgccaaattaaactgtttgaatatttaggttctgtatgatcaaattgtttggtgccatactctgtccacttttttcatgtggtaggatataatttcatatcttttctgttctagaaatacccgaagaaagagactctggaaactcattatcaggtctatcaactcttgtatttgttctcccagggaaacagaagtacctgtgcgccagcagaaatgattgcactattgataaattccgaaggaaaaattgtccatcttgtcgtcttcggaaatgttatgaagcagggatgactctgggaggtaagatacttttctttctcttcctcctccttcctctctcccccttctccctcattttctagtctctctttagaccagattttcttctttgatgcttccaaggggaccagccatgctctagacacaggctgaccctttcataggcaacgtggccatcagccagctggtgccttttttttaatccttatctataccaatccccattccggggctcagcattagagcaggcggtgtgaagcagggatcaggagccaacagaaggtgagtgaggatgcatctgactgggcagggcccccaggggacttaatgatactggcctgatgttgttcagtggtagctaggatgagagaactaagaaatccagaacagtcagaggtgcaggatgacccaggcataggcgcaggatgacccaggcacaggctgatcctgaacacctgggaatatcccttagctaactgctgcctatgttgtagggccagccacctcgaatgagaagctacttctctttggagcctgtgactaggctgccacacagagccaatttcctatcctatctctcccaaagatgagcaggtgttttaataatttccttttctttgcaaagctattgaccatttccaaaagcattttttttcagtagcacagtaacgtgatagatggaagatacagctctttcaagggcgttcctctatcataaggctctctgtcccacaaacctgtctaccatgagtgttgtcaccattccagaaaggcttgacatcagttgattgagacttatattttccctctccaaactcccccatctcttcatgtttacatctgcccaatgccagggtcctcgctgctgcctgctacttccaaaaagatgtgtctttcatgagaaaaacaagatcattaatccacttcgatttggaaatggaatttgaagaaaggcaagcctatttctgagtgcctgcaactgtagcctcatacccaattattcattattagcctggaaaacccaagtgcctagaatccaaccctctcccctctcctcttaagtctaatttagaccagttgtctatctctggctttctgtgaggtgttcaataccttgtctgcctatgtgcacatttatagacaacaactagttctcttatcctggagcagggccatgtgtggatcttcatatagataactatatcctccccatcctcacagggcagtagtattatttaaacagaacaaagtacctcacatgaattgacccaggctggatgagagacaatttcaaaagaatcatctcaagtagcgtccagtactcccaaacatcacaggtagatgttctgtgagtggctttccaagcatccacatcaaatgagactcagatatctgagaaaactcaaccttgttttggtttgcttggtgcaccccaaagaaatccaacaattgaggtctacagtggagaagaagtaggactggggtcagggagtacagaggcaaaggcaggaagggtgacaaagtgattgacaagaaaaaatgttctccatatgaatgttgcagccccatgttgagggttcttatacactcaactgtcaattatttagccttctgtgaattatgtatagtataaaagatagggactctcaagtagggaacctcttggcttgccatctggcaatatgaattgcaagtccactttgatgcaggtaaagtttaatggtaacaaaagtcctcataacatttggatgcaaatcttaacattaattccatgtctcagccaacattctccattattaagcagcctgtgatgtgattacagtgaaccacttttgaaaaggagcctgtgtataacagatagtttcactatactatataaccgtcagatgcaggcttgtaaattaatttgttggtgacaatgtttcagtacattttcaaattgattcattggtatagtactcaaatttgagtgggcttggtgaacacaatgaagacaagctgagaagtgctgtgactggccttcatttcagttgcaggcccatgatattttgagtgtcttccatgtacaaggcaccatgctaggcattagagcttgaggctggcaaacttcaggaagtgttcacaagataccaggattcttgatgttgtgtaaatggccttgcctttagagtcaggcagatctagtttaaaggctcagctcctttatttactgtgtgcccctctgagcctcaatttcctcatctctgatttagaaataccatcctcatagagttataatgagtatcagatgacatgatgaatgtgaacatccttgataaatagcaaaatgctagacaaatatgggggcttaatatgacattgaggtcactagtaatttagctggaaagtctgtaacacagcacttcccgatggcttttaccctaagtaacttggtatgccatataatatgtaacagcaccaacaggcagagaatcgccagaaaacactcttgattacctcaaacgaaaaagtaccaccaggatcctgttcagaagctaattttagtaattaagggaatcatatgctatgttcaaataccatgccagtaaaaacccaattgtttaccttcttaaatcactgcttgaagagcaaatctttccattttgctgaatgaacttatctccacgttccctgccctactgacacaaccccctcccaagtttattgttaacttacacattcaatgcacagcacacctttactcaaacaatggaaaagaaagaaagtgtcaattcaaagtggcccttgtctattccttaaggagtagacttccattttcatcagatttggatttagcatagacatattgattaccttgaagaagaattcatataattttatcttctgattcccatcactcaaatcaaaattacataatatattccaaaatggcaactaggaatgtggccttgggcaagtcccttctctcctctgatgcttggttttcccatcatagaactggaattgtggcttcaccgaggacctttctggtgctaacattttgtgattctatgtaaaaagccacacagaaaggattgtttttcagccctttcttagattgtctgttccctgctcccagaagtatagatagtgagacttgagtgctttgatacatcgtaattgtatctacctccattcacacctacttaagatatctgtctaaaagtagactagacagattattcagagagtggagggcagaagggctgtctctgtatcttaaagaagctggcactcttcagctgatggctgcttggtcttgaggcctcaagatctttaatctggctttctctatagtgtttcattcactgtttggtgatggaatctcttcagttcagagatacttaatagatatagctttttctttcctgcttccaggcctacctacctgtttcttgcttttttttctagcagctgttgttgtttctgaaagaatcttgagggtgtttggagtctcagaatggcttccttaaagactaccttcagactctcagctgctcatccacaacagagatcagcctttctttgtagatgattcattcctggctgcatttgaaaaccacatattgttaattgcttgacgaatttaaatcccttgactacttttcatttcagaaaacacttacaaaaaaagtccaaatgaggaccttccctccagtgaattagctgtggctttctcacagtccatagttaggataaatgtaaagccatttctcatttttctccgcactttccaagggtacactccttgtttccaagatggaatgagaaataaagaagtgcccttcctgccatcttctcccctgaccctttcctccttcccactttcctcctattcctccccaaacatgatttatttctgcgttttgcaactcttgagttctcagcatttagtaaatggtgttggtccctgttgattccttcctctcctggaccatggaaggtagtaggcctttcagaaatttcaggtagcagccaaaccccagaagaagagaaggaacacagagacctagaccatgtgagaacctgaggtgtgcagcatttacttcacagattcgtctagcatatttgagaggtgtctttcctactaggagactgaactctgcatctgagaataaaaacttaacatatctacaggttttgacaacctctgtgaattatctagttgagaggatggctcaaggagcctattgccatggtctgatgtcgttatggacgctatgaacatccttgcagtttccattgttgaagacagccctgatgccagctgtctcatcattccccatgttcaagagcatcccagcattgctacctcaggatcccatgtcctgaatgcaacagagtgatttcgctgctgaattactattcatggcatggctcttcacagcatttattcatccatgtatctatccattcatccttccagccagccaagaagttcacgctttcatcttttcatccatttactcacctatttattcatttagcaaatatttattgagtaccaactatgtgccagacactctgctaggcattttggggaagcagaactgaataagatactattcctttcctcaaaaatttgagcaagaggagaaaggaagtaatgaggaatattccttagccataaaggaaaaataagaaatcacttggaagaagttaggtgagatggaaggaaaaggacatctaaggtaaagcgtacagtttgaataaaggcacagagacatgaacaaaatgcattgagggtttgaggaacagcaattggtttaacatggccagagctggggaaatggtaagggcaagctgaaaccacattgaaagcaaacttggttattatactaggtagtttagacttcaagcagttgaaaatctttgagcatgggataggcatgatgacattgtgtttatttgcatgtttctttaaagaaaactggcagcagcacaaatgttttgttgatgagggtttaaattgtagaaagtgagacaattttaggaaggccagctagagagaaatttctagcatcaaattttgctaaacacctaggatttgtagttacctccatttgggttgttacctgcaagtactgaccacgtatatgaagaagtactggtttagaccaaggcaattggcttgtataagaggcctaccctcataccaaaagccagtttccttggtctaggccagtgtttactggtatgtgtcctgagaaaactagttccatgacatgttccatgaaaaatatgatttctattgtcaaataagtgagggaaacttgcatatcatggtcctgctcaggaagatttacaatccttattagcatatcacaggtcctggtgaatactgcggtaaagtaaccgaggagctttgtaactcaggattcccgaagttgattcaaccacaggacctcatttattcacataacacctgttatcctacaaaaccactgttctctggaatacactttcgaaaacatgggtatagacaaaaactctatcctataggcagagaatacctatacctctagctcaggtcatcattttgcagatgtgtgtgtcattaagaatcagtcaataatgcattaatgatcaaaagcagaccatccttaccacatggtgcataagattatgctattatgctattagctactaatgccactaaagttaattatgttgggtctgcaacgttgtcatacacaaaggataggatgcaaaactgtcctaggccaaagcatggttattgcccaagttatctaatgtctgcaggtacatattcctggcctaaggattgtgctaaagaagttatttctaagaaatatagtgacttccagcatcatgcagaatgaccatttaatattttgaatatctagacattctgctgtagaatttaatagtccttttatacactgtctgaccaacattttgacatttactcagaaccccatcacagtgctaccacataacctcattgctaaagtgggaggcctagaaatcacagatttgtagaaaccatccaatgattgaatcccctctacttcctgttcagcaggcagcagagtgtcataaagaattaacaacgtggaactcagttactgggatttcttccattctcctttgattctctagactagaattccaaagaccctcaggctggtgatgcaagtgggaagtctcatttctgagaagtgctgcttcctacccacaattctttgatagctgagtgctttagctgatctgcataactgaggtgtgcaccaaggagcagaattactctataaattttggcatcaacatgtgcaacttgtgactcagcactttgaaactctggggatttttttgtttggttggtttttgttttaagatgtcctgtggtatagtggaaatagtacaatagactcagatacagagaggccttgtttctagtcttggttctgtcacttactatcttgatgtccttgcacaaatcaccagacctctctgagcctcagtttctccaaccacactgtgggaataataaaatcttttttacggcattgttgtaagtatgtagagaaactggtacacagtaggcacacaatcaatgtcaccgtacccttcagcccttcttttgtggatgaaaaatggtctttgtgctcccagtcaccactggggtctgttctctctctctctgctgttacagtgtggcttttggttcttgtttctttgttctttggtctgtaaattacccttgaaacaacccttgaaatttccactccatgacctaaatcgtcatccctaaattggttacatacatatttggtgacactttggaggggaaaagctttatgtctctctaactgtagttcttaagggaatttgcatatggaaaaaacagagactgcgtctcttaattcctccaaaccaaattatctgggatagcacatatatgttgtactctgtctctgagcatttgctcttagagaactatggttagagcgaagtaaatttttctaatcataaaaattaatgataccgcatatctgatacttgaatgagtacctccttgtaaaatttatacttaaatccttgagtttttaaagtgtaatagcaatagaaagattttattgttgtttacttttactgtgagtgctccaaaatccctcagttgctcttgaaagagcaagatgatgccataggcaatattttccaaaggtagtaggcagaaaactgagtacacagcacacaataggccatatatacaaaagcaagtattttgcaaataataataattcaggaaaaaagcttcactttcgttggtaacctgtttgtttaaaaccattttattatttattatttaaaaagagtgtcacttgttacagattgtgggatgtgttccttaagatcacaaaaatgtaaaatattttctttttatactgaacacatgcatagacaacttacctgagcaagctgctttttggagacatttgcacatcttttgggatcacgttgttaagaagtagaactaagggaaaaacacgcagccacccagaaatcggtagagccttcagctcatctgttattaatatttctgtgacaacagatatctaggaagtaaacaggaaattgcatcgctatcctgcatcaccttttttggaatcaggttccattcttctcagtccagttcaaccttgtgatactttttagatctcaaccaaggcatagaaatatattttcccttgcttaataccccatggaaccaatgcccctgtggttgaagtaaaaattgattgttgagggacatttcagccctctagcagtcaacaattaaaaacatgtaagcaccgagcacctgcagaaaacttggactggcatttggatctaagaagaaaatctgcatcttgaccaagatgaaaagtcaccagcccaagcttgtgcagtgaagtgtcatgttggccacaatgaaactgaaagagactgatgactctcctcagggtggaaaatgaggcatggaagctttgattagtgagctgttaggcacacagacattaatttcaaagcattctcatctccagtctgagtaataatgcttatagtattatgcaattgtttggctgctgcaagaaattcagcagactccaacaagtagtctttcttggtctctgagtgactgtaacttaaattctacctcccttctcttctcctacatcttctcactccccaccccacccccacatacacacaattcttgtccactatgttcagagagatgcacgcacacatatatatgtatatatatagtatatttgtcaataaagcagaaaagaagaaaaaactccaagtaaacaattttccatttccccatctcacttctgtcttacaagtggataggaaaagaaaaacccccagtaaaaaatggcaaccgcccacctccccaactttacatgctgcttcctatgttagaggatctgtcttaggcatctgattatggagcctgctagatacaagcccgtatttagactgctacagtcaacaatgtctctctttcatactagaaaaattccgggttggcaattgcaagcatctcaaaatgaccagaccctgaagaaaggctgacttgcctcattcaaaatgagggctctagagggctctagtggatagtctggagaaacctggcgtctgaggcttaggagcttaggtttttgctcctcaacacagactttgacgttggggttgggggctactctcttgattgctgactccctccagcgggaccaatagtgttttcctacctcacagggatgttgtgaggacgggctgtagaagtaatagtggttaccattcatgtagttgtgagtatcatgattattgtttcctgtaatgtggcttggcattggcaaagtgctttttgattgttcttgatcacatatgatgggggccaggcactgactcaggcggatgcagtgaagctctggctcagtcgcttgcttttcgtggtgtgctgccaggaagaaactttgctgatgggactcaaggtgtcaccttggacaagaagcaactgtgtctgtctgaggttcctgtggccatctttatttgtgtattaggcaattcgtatttcccccttaggttctagccttctggatcccagccagtgacctagatcttagcctcaggccctgtcactgagctgaaggtagtagctgatccacagaagttcagtaaacaaggaccagatttctgcttctccaggagaagaagccagccaacccctctcttcaaacacactgagagactacagtccgactttccctcttacatctagccttactgtagccacactccttgattgctctctcacatcacatgcttctcttcatcagttgtaagcctctcattcttctcccaagccagactcaaatattgtattgatgtcaaagaagaatcacttagagtttggaatatcttgttctctctctgctccatagcttccatattgacaccagtttctttctagtggagaagtggagtctgtgaagccagggaaacacacatgtgagagtcagaaggactctccctgacttgcctggggcctgtctttcccaccttctccagtctgtctaaacacacacacacacacacacacacacacacacacgctctctctctctctccccccccaacacacacacactctctctctctctcacacacacacacatacacacacacttctttctctttcccctgactcagcaacattctggagaaaagccaaggaaggacttcaggaggggagtttcccccttctcagggcagaattttaatctccagaccaacaagaagttccctaatgtggattgaaaggctaatgaggtttatttttaactactttctatttgtttgaatgttgcatatttctactagtgaaattttcccttaataaagccattaatacacc

SEQ ID NO: 4662 - DNA, 185996 bp, human
cggagagaaccctctgttttcccccactctctctccacctcctcctgccttccccaccccgagtgcggagccagagatcaaaagatgaaaaggcagtcaggtcttcagtagccaaaaaacaaaacaaacaaaaacaaaaaagccgaaataaaagaaaaagataataactcagttcttatttgcacctacttcagtggacactgaatttggaaggtggaggattttgtttttttcttttaagatctgggcatcttttgaatctacccttcaagtattaagagacagactgtgagcctagcagggcagatcttgtccaccgtgtgtcttcttctgcacgagactttgaggctgtcagagcgctttttgcgtggttgctcccgcaagtttccttctctggagcttcccgcaggtgggcagctagctgcagcgactaccgcatcatcacagcctgttgaactcttctgagcaagagaaggggaggcggggtaagggaagtaggtggaagattcagccaagctcaaggatggaagtgcagttagggctgggaagggtctaccctcggccgccgtccaagacctaccgaggagctttccagaatctgttccagagcgtgcgcgaagtgatccagaacccgggccccaggcacccagaggccgcgagcgcagcacctcccggcgccagtttgctgctgctgcagcagcagcagcagcagcagcagcagcagcagcagcagcagcagcagcagcagcagcagcagcagcaagagactagccccaggcagcagcagcagcagcagggtgaggatggttctccccaagcccatcgtagaggccccacaggctacctggtcctggatgaggaacagcaaccttcacagccgcagtcggccctggagtgccaccccgagagaggttgcgtcccagagcctggagccgccgtggccgccagcaaggggctgccgcagcagctgccagcacctccggacgaggatgactcagctgccccatccacgttgtccctgctgggccccactttccccggcttaagcagctgctccgctgaccttaaagacatcctgagcgaggccagcaccatgcaactccttcagcaacagcagcaggaagcagtatccgaaggcagcagcagcgggagagcgagggaggcctcgggggctcccacttcctccaaggacaattacttagggggcacttcgaccatttctgacaacgccaaggagttgtgtaaggcagtgtcggtgtccatgggcctgggtgtggaggcgttggagcatctgagtccaggggaacagcttcggggggattgcatgtacgccccacttttgggagttccacccgctgtgcgtcccactccttgtgccccattggccgaatgcaaaggttctctgctagacgacagcgcaggcaagagcactgaagatactgctgagtattcccctttcaagggaggttacaccaaagggctagaaggcgagagcctaggctgctctggcagcgctgcagcagggagctccgggacacttgaactgccgtctaccctgtctctctacaagtccggagcactggacgaggcagctgcgtaccagagtcgcgactactacaactttccactggctctggccggaccgccgccccctccgccgcctccccatccccacgctcgcatcaagctggagaacccgctggactacggcagcgcctgggcggctgcggcggcgcagtgccgctatggggacctggcgagcctgcatggcgcgggtgcagcgggacccggttctgggtcaccctcagccgccgcttcctcatcctggcacactctcttcacagccgaagaaggccagttgtatggaccgtgtggtggtggtgggggtggtggcggcggcggcggcggcggcggcggcggcggcggcggcggcggcggcggcgaggcgggagctgtagccccctacggctacactcggccccctcaggggctggcgggccaggaaagcgacttcaccgcacctgatgtgtggtaccctggcggcatggtgagcagagtgccctatcccagtcccacttgtgtcaaaagcgaaatgggcccctggatggatagctactccggaccttacggggacatgcggtaagtttttccttccagaaatgtcgcctttcggcccagggcagagtcactctgtgttctggggtatctagcggctcctacctgcgcgaacactcagattgcccctgggagagctcagcagggtaaacctagagctctcccgtggactcccggcctgccagaggtttaacctgagctctcctaatttctgctgcgtgccctgggtgctgattcctgccctcccagattcttcaactcccccaaccgccccaaattctcactacctcctggtactcgaggtcccaaacagaaatcctattgcacgggccaccttcagagataaagctcccaagccctccactcttcctttcctcctgtcctcaaagtctgagaacctcaacaggaatttgggcaatttctcctcttcaggtctgttaggatttcactttcagcctgcgcagattagagtcaaaaagaccggcccaatagcttctcagcgggtatcctccagagaggtaaagtgaaattctcggttagggaaagaaagtggtctctgggtgctgaggtctgctgtgtgaaagggtgaacttctttctcctgaagcaactggggacttgctccagggctggaggtcagtagagataatccaaaccgtcatgtttagagtaggcagaggggcaactttcttggtaaagacttcacaggatttgcactcacagtttctcaacgttggttgactatgttgaaagtagttgcttgggtcggttttctcttgtaaagtgtttattttctctgtggattataacagatccacagccccctacttcaggtttgcatcagatctataaagaggagaatattcttttaatgtacaatttaattaggcttgactctgacttacaaaactgttggaaaacatttttttgtaaagcatttcctgctatttcagtgtgctccaaaatctccactggggagggtggagtgaggttttttattatattcctttatttttaggacatgtttgcattttagaatatgtgcagttagctctaacaaattgagtaagaactcttaatgacctatgagccgtaatcttaccccaaagttttaattagcatatgagaaaagtggcaggcaattgcatcgtgcttattaaaaattattcctcaccgcagttgttgagcttcttggagaccatgctgaagattttctcccccagcaaattaagatattagtttatctgctgagggaggacagactgaattggggaattaactcctcaggtaggccaggtgctgatgtccctgtggacttttgtcttattctttgtttctatggctgttttcttttacctgtgacttctccgaaatttctttgttagccttaacatctttgtttggggacttaaatccagcaatttgccttctttcactgatgctttccttcttacaaggtagatagcacagtgttagtaaagaaagaaagaggagggtaggatttcatattatttcgtgggctgttgaagaaacagcttcttaccaggctttacattccattaggtttttaatgtttgacttacaagattttcagagggttcatttgatattgtcaaagtcttttccagttaatttagactcttcatttttgtaatgggtttatgctatgggacaaaaaaagtattcttcattttataagaacaaatttacttggtagggttaattttttttctagggctgtcactagacggtggagcccctcttctactgtaaacttttcttgggggaaaatgtctaaggtgcattttgacctgccatgatactaaacccagacactggaaccttccatcttctgcatgcctcccccacaacttacttacttaacagggaaaaaactgatggttccacatatttgctaaaaaatgtgtgccttcaaagacaaaaccaaaatttttagggaataactatagagagcaaaagttactcccatcaagtagacaacgagcttggtgattttatttcaggtcttaatgaaaaaagcttctttatgaggaaggttatcatatcttggtgcctccttgacagtccgcttaaattaatgacataaactaatgagaatttagcagttcctgcagaaagtacaagtttattttttttttctggtttgtgattgctgcactgaatatgaggagtctagttaaagggacaactggtgttcctgtcttgtgagttgacgaagactttccatttctaggatatagaaaatccttaagccggtttattgaaaattaatcaatttaatcagaatgcaatcaattccaatacaaaagttagtattttctttctttttattgaaaattaatttaatcagaatacaatcaattccaatccaaaagttgatattttcttactttctctttttttccctcattttgtagggatacaatttggtgaaaggcaagagatttcttaagccaaagcaagagtgtcttccctctctgtgttgcatgcattatgtgccatgtttgagctaaaaatctcaaaattgggcaggcttccaatgacctgttgggtccctccctttaccattcatgtgtgtgtttatgtacataattttgtggaggggtttttttaaaccttagtaacatctgcactcactctgtgttcttatacatttacagtgtttctgctgagaggagggaagatgcaaaggtggtctcttttacttaatttagcatgtggtttgaacagaaggaaaaataaaaagtgatggggcttgtgtgcaaccctgatgatattttatggagctgtctgtcttctctctgagatcaaacaggactacaactttgttaattgaccactggctcccttggcaaaagtagggcttcttatattccagcaagcagcacaataatatgacaaaaatttattcttgggagttgggttctaagagagtgcatgccagaattagagtttggggtttagagaaattatccagatgccaaaagaacattttaatttttctcttggtaatttgttctggtctccatagtaggtagtattttagtagtgctttgatattgacaagtcttgctccctttctctattagatttttcaaaataaggcattttattaattcctctttccttctcctctctcctctcagttatcaagcatttttatgactatcttacaagcaacagtttgtcttgtaaagcagaattttcctttgaaaccaagacagattatttctgcccataggcttcaggaaccaatattttggcaagaagcatcttttctttgtggtcagcaaataggtggtgagttctgtctggatcccaacaatcaacacctgaggaccaaatagccacactgggtggcaccccattcggaagtatacacaggaagtagccctcttgcttgttcacagctcaagtcagccaaagattaacactggtgagagatattttcaaagaagtttgcaggcttccaattgcagggtcattttggggtgctttcttgcctgtactaattttatctcatcaagcttccattctttgagctgtaaactttgaaataatatactggatttgctggtacgtttaattttctttgttaagtgttttcattcccatagtaatttttcatctagtgtacatatatgcatttaaaacaaaaattctttggtctccttatgcgtatatgcactgcggcttgtacacgtacaagctacttggtgggattatgtgaactggagttagaaatgtggacaattttattatgattatttttaatggtgatatcaagatcaccagtttcattcggaaccttgcataagcagggagcagaatgcggactgggtgtggcaaagcaagggcttattttatagccaaacctgaaatcacaactctgaaaaataaaaaaaaaaaaaaccaaacaaaaaaatcaagttttgtgagcttggtcagagaaggaaaaggaaatctctccctaccccccacctccaccattttctctttgtctgcagcttcctcaagtgctgcctgtccccgattttcttttattccactcctttcatgtttttgacattgaaatacagactcttctttccacttctcagggtatttttcttattacacctgtggcatgctcctaaagaatttcttttttaaaaaaaatctgtagagtagtagattagattaaccccagtatctctcccttaagactagatgacatgaggggattgcaaaatgaatagctgggtttttttttttttttttttttttaccttgaggttaaagcctggttcaacagttgctgagagagttaactagattgcttgaggacttggcaatttcataaagtattttgtcttatgctgtctctgtctctgtcttgatctctgtctctctctgtctactgtaatgttggctactttctctcagagcctgagagacagctctgagacacttcccaggtctgttcggttcagacctcagtagctggatcacaagcagtacccaatatgcatatgagggtgcgtgctgcaagtgtccggctgggctaatctgcttaagcttcataaaaattaatcatttgaaaacaaagaaagatattaaagaaattattctatctccgacttcccctatcagcattccatcaagttctgggatgttaaattcagagaaagttaaccttatcttaaacacaaagttgacttttaaacaaaattgcttataaagttctgtacagttaccagcattggttgccctttgtcgtacggaagagaattatgaaatctcatatttacatagcattcttccaaaaaaagagacggtgttttccagtttattcactgcattcgtgtaagtgtgagtaggccaggaggggtgcttagtgattacccttttgctaggtaacaaagtagaaagttagattttctatgatatttgtttaccacgtaggggaacctctctagagcaatactcccaagctttttcttcttgaaatttcccacctgacagataatactttagattgttgctcttaaggacttctctcagtagctgctacatagagatgattgtccgtgaattattgcttgcacactcatgggtgatgctactccctctctctcatggcaattcttgctgccaacctgcaggccacaccaggattgagggcagctcatctcgataaatttatagcattaaagtgctgggtcatttgagaatgttgtcaatttaggttacttagtacctaagttttattctttaaataacagctttattgagacgtaatttacaatccatacaattcactcatctaaagtgtacagtttcatgctttttagaatattcagagttgtgcaaccattattgcaatcaattttagaacattttaatcacccccaaaggaaaccctatgcacctttgtgttcatccccctatattccctcagtccttagcaaccaataatctacttctatctatggatgtgcttattctaacattttgtatgaatgaaatcatgtaatatgtggtcttttgtgactagcttctttcacataaaatatgttttcaaggtcatccatgttgaagcacatatcagtacttcactattttttatagcctaataatgttccactatatggatataccacattctatctatccatttatcaggtgatgagcattacggttgtttccaccttttggctattatgaataatactgctgtgaacattcacgtgcaagtttattgtggacatattcagtccacatattttggacattttcagttcttttggatacatacataggattgaaatctctgagtcatatgatacctctgtgtttatccttttgaagaactgtcaaactgttttctaaagtgtctgcactgttttacaatcccatcagcaacctatgggggtccatttcttccacatccttgccaacacttgttattctctgtctttttcattatagctatattagtgggtgtgaagtggtacctcattgtggcttttatttccatttccctaataacaaataatgttcagtatccatgttcttattggccatttgtatatcttcttttttgagaaatatctatttggatcctttgctcagtttttagttgggttttttattattgagttttaagatttttaaaaaatatattctggatacatgtcctttaatagattgtgatttgtagatattttttcacattctgtgagttgtcttttttactttccttttttttctttttacgttcttaatggtatctagattgaagcacaaaaatgtttttaagtttgatgaagtccaattcatctatttattttctgttttggcttatgattttggcgtcgtatctaagaagtctttgcctaatccaagatcacaaagatttacatatgtttccttctaagagttttatagttttcgctatttacatttaggtctttcatcagttttgatgtaatgtttatatatgactgaggtaggggtccaacttcattcttttgcatgtagatattcagttctcacaatattgttgttgaatctttcctcacttaactgtcttggcaccctttgtgtaaaatcagttgaccgtaaatgtgagggtttaattgtggactctcaactatattcagttgatctatatgtttattcctatgccggtaccacgttatcttgattattgtaggtttttagtgagttttgaaattaggaattttgaactcttcaactttggtcttctttttcaagattgctttggctcttgtgggtcccttgaattttcaaatgaattgggataagcttgtcaatttctacgaagaagtcagctaggattctcacaggaactatattaaatctgtaaaccaatttggggagcattgtcatctcaacaacgttaagttattttcatccataaatatgcgatgtcttcccatttatttaggtcttccttttgtcaacaatttttattgttttcagattataagttttgcagttctttttaaaatttattcctaagtgatttattttttgatactataaattgaactgtcttattgattttattttcagattattcgctgccaatgtatggaaatataattgttttgtatattgatcttgtatcctgcaaccttgctgaaaatacctgagttttgaatgcttctgggacttatggggaagagggcttctgctgctgcactgaaagttaaagcttacttcatttcatcctgtatgaaggctgcatggggacattcttctcagttttactcagctataaattcgaactggtaatcccatcccctttcgggatgaataggagagtgtttttaaatgttcatctctttagagaacagcaggaaagaagcctagtaaggtttgggtagtttataatcccttttttagaatttggatttgggaactattagcaaggcagtgagtaataataataatttctatatagaaaactaacatgtagaggtgacaaatgaaatcactagctatattaggcttatgtttaggttatcgtaagcagctaaaatcataattttatgtttttatatgttgtcctttggacaaagtaaattccagtactccttctgatgtgcatttctagatggggaaaggattcatttactctcatataatttaagcttctttttagggatgtactccatagccatgaagcaaagataaaattcatctatacacagactgaactttgtcttcattaacactctaggctaagggtcatagctaatcagctacaactgtaatgtcctgataattgtgaattaactgcagggcacccagcaaaaggtttagttataatctaatagctgtctgtagagattagcctaataaagggattttttaaaaaagaatctggccgggcatggtggctcaatcctgtaatcccagcactttgggaggccgaggtgggtggatcacctgagatcgggagtccaagaccagcctggccaacatggtgaaaccccatgtctactaaaaatacaaaaattatccaggcgttttggtgagcacccacaatcccagctacttgtgaggctgaggcaggaggatcacttaagcctaagaggcagaggttgcagtgagccgagatcatgccactgcactccaggctccgtcaaaaaaaaaaaaaaaaaagaatctatcaatcaaccacttttcattaagcacctgctatgtgcccagcatgtgctaggaagagataaggtgaaaggggacacaattcagacagaatcttcttgaggtaactgcttacgaggagcttatagccactaaaaacaaaaacaaacaaaaaccaaacaaccaaaaaccaaacagaaatgcagtatcatcatgccatgatgcctgtatgagatcctggattgtacggtatggatttcttaaaatgtagatattttaaaaaaaaagaggaatgaatcaatagaggctgaagtggtcagcaatgttacctgtggctgcttttaatccttcgtggaagtaagtaggagcatgtctaaactcaagcaatagattaaagatcttgatgtatattttaaataacagaagttagtaccactggaaagaatgaactggaggaatgggttgaaatctatttctgcttattcaatagtgcaccccagtcaagttagttgccaatttcttcttcagtttctttggctatatcattgcacttggtgggtacatgtttatgatgtctttatctgaacaagtcagcaataatatgagtaataaattaaaattgaaggtgattaatggctctgaatttgacataagagttgttttcctgccttctaagtttccattgatcctgatgaattgcacaaaccaaacaattcggggagtaagggggcacatgatgatcttataagagctttgctgtattagacaacgtaacattctgaaatggcctaccacctaacatgggctctgttctctgcaggttgagtaggttccttgcttgtggaactgtagtcccgctatttggccgctagggggactgcaagtgccccgtggcaggatttccctgggaatggtgagcctccattgatggtttcaacacacagccaaggccctatcgcaggataacttgaaccagaactgcctagcaccagacaataaataagctactatggtacttactgtttcatttgggatgttgtttctcgaagtggcaagcattttttagtaatattttgactttttaatacctttctttgcatatggagcagaaaacagtgacactggatatattcaagtagcactgtccagtttatagagaagtttcatattccattattgcatttcattcttgtttctaccttttacaagtaactagagtttggagtattataatagtattcatactattacagtactattattcccattataaaaattgtgcaaagagtggttaagttacatgtttacaatcaaacagcttcaaagtgactgatctggaatttcagtcccattctttcttctccagatcatgtgttccctgcttttatctcacagctctttttaccttatagatgggaaacatgagagtcagagaggcaaaagaaccacaagtggtatcaatactagaaatttatgaatttcttaaggcttctaggtttgttacccatccaccagactgatggatttggttgtgtgagagttctgggtgccaataaccttgccattctactttacagactgcatatattcaataaatgcttattaagcatctactatatgccaaattctgtactaggcaccaatgatgtagtggtgaacagaacagacaaaaatctcttcgtggagcagacagtttaatgagaggagacatgtagtgtacatctgagcatgaaaagtgccatgcagaataacttcacagagtgtagggtatagagattgatggtgagagggaatattttatatttgctggccagggaaaaccttactggaaaagtaaattttgagtagtgacctgaaggaaattaggaaatgagctgctatttggacatctggagttagaatattccaggcccagggaaccacaggcgcaaagggcctgaggcaggagcacacttgctgtgatggaggacaaagaggcccatatggctggtttaaataagtgaaggatggtagacaatgagatcagagttaatgaggttgcatggtaggtcttccttaggactttgaattttactcctaagcaggttgtattggacggttttgagcagggtaacatgacctgacttacattttaacaggctccctcctcttcataacatctgtcactctgatatattatacgtttgtttgtttacttactgtatgtggggggaagagactgtgggagcaaggggggaagcagggaaacaagtacactgcagtgatctgggtgagaggtgaccgtgtctcagactaaggtggtattggtggagaaggtaggaagtggctgaattctggatgagttttgatggtatagccaacagcatttactgacagattggatattcactgtgaaaaaaatagagatgaggatgattgccaagtttttggtctgagtaactggaaaaatgagattgccatttactgaaatggtgaagactgtatgtagagcaggtgcatgggcagggtagaaatcaagagtttgatttttgacttataaagtttgaattatctgatgaacatcctgatggcttcttctcagttagttctcatgcagtgccttcagctttgctgttcttcaagaaaattaaaaaggaacttagagatcgcctaggctgtaggtaccctctcccctctttccttttactttatagaggtctatagaagggtagggacttatccaaggtgaaacagtgagctggcgacagaactagggcacaaacccagttctcttgaattctgaatcagtagattttctttttttagtgtgattctgaggactcatttgggcaagagtgagttttttgttattgttttttgtttgtttctttgcccaaacctaaaaccaggtaattaaactaaatagtgaataaaactgggaaactatacaaattggttgctctccccaatcacactgaaatattattatttttactgaaccacataccaaaatatttttcctgtaaaaacacagtaagtgaacttttaaaggcaattgagcttttaacaaagctagaatctacagaggacctggacagaaatggccttaaatcctaggaaattagagttcatggaacctgggagaccatcttgtccagctagctcattttatgggtgaggtgcctgaggcaccaagatggaaagggacctggctaagctcatacagcaagctagtgcctgagcctagtcagagcctgttttaagggttagtcgtatgttgttttcttgaaaaaagttacattggaaaagtgaaaattctttggtccatactgagaacaaagaattatacataatcatatataataataatgatagcacttcctgaatgtttgctgtgtaaactttggcaccttgcatgaattgattcatttaattctcatgtcaactttaggaagcaggcctagagaggttaaggaacatgtccaagggtcacacagctaggaagtagcagaacttgtgtgcactcccaggaagtctggcttctaaccacaaggttctaactactgtgcaataccaggagcttctcagattacccttcacctttaccaacccaaatgactggtgacgtaggtgacttcattatgctctgcccctattatagtccactgatcctcaccaaataggtgggtggcctagaggttaaagtagaggcagagtgatggaaaggggtggttagaagaagttgatgactcatgatagggattggaaaacaggactacaggaattattgaaaagggcctagagatcccaaggaggttgatctccgactgctacaaacctgggcaattcaatgcctgcttaaataggagagttaagataagaaaaataaaattgccaatttttacagtcagacattgttttatttattttacatgtattaattcatttaatcctcaaaatactccatgaggtagctacaattatcatttctatgttgtagatgaagaaacaggcacagagcaattaaataacatgcacaagattagagaacaagtaagtggaagtgccaatattagaatctaggtagttcagctccacaacttatgttattttccactatatttatggaatgaggtaattttcttataacagaaagtttttaaaatgcaaaaacattgtgcctgaacttcaaacactgaacaactcatatccttaatatgcaccagtttcttttaagcactcttagaaggaaggatacttaacctaatgtcacatggtgagtaagtagcagaaccggaacttgaatttgagactccggactgccagacctctttccactctatcacttgggctcccttctaacattgacttgtctccctccattcctcctccgtattgttctgcccttcaccttttaattacctgtctccatcaacaagattggacagagaattgggagagtgagcagagtccatttccttccagagactggacaaaaggaacaaaatgttaggaaaaaatgtcagcatgtgggatttgtgggatttacactaaataagaagggacacttcccaggactgacaagatgctacctccgtccctctaggccccaatgtgttgtgcaggatcccataggaagtcatgaatgtggttgtcagataacctttttgttactgtggaaatggaagcaggctactgcaaaaatctgtctctccaggttttcttttaaagaaggtagtcttgctaaatgataactatttcagcatttatttgaaaatgggcagtgcaggagagaaagaatttttccaagcttgtcacattgggccacctctctgaagcattgtccaacttctaattagatgaggagactgcataaaccaagagttgagagtaaagatggaaacacttgatgtttggtgtttgggtgcagaaaggattccagaacatgttttgggtctctttactctgtccatccctccttccctttcatctttgtttaaaaaccacagttagcaaatgtgtagtctgtttgcaattgttcatctgaaaaatttgtttgatcagccttttgaataaaaaagaccaaattagactgagatatttcagtcaccaactatctaataatagaccaaaaattttaaccatgctcatactttcatatggtatgtagtttgctttagacattttctgggcttcagtgaggtgctagattgactcaaaatatggcaggtcagatgtgggattgagcagggtggactcttctctacccttcccaattcagagttccccatcaaagatgatctcatagtgtttgaaaaaccaagctgaaggctttgggaattagggtgctgaagggatatgctgtttcccaaagccttctcagtcattccttctccccccagttcagattcttaacacctctttccaggattagtgcagtgatcccacgtcctttctctctagctctctctgctactctctaattcctattgtatttgtgccaccagatctttccaaagtttagctccaatcttgtctgtatactgctttaaatgtctattagtctttaagctccttaagggtgggagtcctgtcttattttttccctattcttcgtgcttaatgcaaaggaagccttgctgtatagttgtgtaatgcatgattacaatttcagcttctccccattggcttatgggttaaagtccaaattatttaaatctggtgttcaagtccttttatgatctgcttatttttccagcctgaattcctggagttcccttacaaaactcttaaaacccagccaaaaggatctagtcactgtcactttaaaccatcctcactctcttgttttttgaacatgttatttttcttataatccctttgaccttgaaggctatcccaatttcaatactatccattcttctatgacagccccctacaaaatgaatattctcaacctcccaacccaaggagaagtgatctatatgacacaatatggttgaaagaatgttggcttcacttctttatctgtaaaccaggggctagaaatctctagtttataagattttgtggagaggggatcatatgtgattatggatgttaggcacaagtcaagagtgcataagaccttttggatttatcccttttttctttctccatcaatatggtacttagtcccttaaatcagaagtacttgtgttaatgtctgataacgtccttctaaatatacctctaaacatctgtctctctttagggcaaaggttggatatatctgcaaagattctctttggatataagatatccacagcacataacttaacagtggtgtacacagtaggtattccataagtatttctttatgaaatgattcagagtcaatagtagtaagtaactgccaaaaacaactgatggattgtaagttccattaacataaatacagtcagccctccatatccatggattccatatccacagatttaagcaactgcagatggaaaatatattttagagacacagtaaaaataacaattcgacagtaaaaaaatacaaataaaattatgtaaaacaactatttacataacattgtattagctattacaagtaatctagatataaatgaaatatatgggggatgtatataggttaaatacaaatatgacaccattttatatgttttagttaaggaacatgaatatttttggattttggtattcatgggagtgggggaatggaaccatgccccttcaaataccaagggactattatatgggacacagaataaaggagttgattgtcttgctctgttaaattctggtcagacacatttgcaatgtattgttcagccccagtattcatggagcatctccttttgtaaagcatggaggagctgtgagagagacatggagcagtgaacataactattgtttcaacgtacctgaaggattatcatggaataaagaagttagatgtttttctgtagtaccccaaagggcaaaagcaatgaggacagattacagttcagtaaacgaaagaggtttttttttttttttttttttttttttgagatgggagtcttcactcttgtcgcccaggctggagtgcaatggcgcaatcttggctcactgcaacctcgcctcccgggttcaagtgattctcctgccttagcctctggagtagctgggattacaggtgtataccaccactcctgggtaattttatttattatttatttatttctttatttattttagtagagacggagatttcatcatgttggccaagctggtctcaaactcctgactgcaggtgatccgcctgcctcggcctcccaaattgttgagattacaggcgtgaatcaatgtgcccagcctgaaagatattttcttagaatagcttctttcacccttcatcagaagttgtcaacatggaccatatgagttttgtttggtctatatggtgtatatgtgtgtgtgtgtgtgtgtgtgtgtgtgtgtgtgtgtgtatgtgtgtgtgtttattgaattacttgctaacattttacttcaaaattcagatttccaccatagggaatgaagatctggcaatacaggactttcattcctacatggtaatgaccagctgtaggtgaaaagcagctgatcctctggatgggccatgcactttgcagtttgcccaggcagcactgatccgctttattcatttaagttacctgcttgactcttctagtcattcgagtatgtcatccccatcagatcagagacctaagcaaatcttgggtcccttgcttactccaagggctttcactcctcgtataggaggagctaaagaaatgtacaagcagcaccacaataggatcagacctggctttcaattctagcacggccacataacatagttggatgacctcaggacagtaacataacccctctgagcctctagatcttcattatctgtagagcactcttcttatagagttattataagaatgaaataaaacaactaggataaagggcatggcacttagtaggtgctgaaatattagttcccttcttctaattcaccacaccatatctgtctatctattggctgaatcacataaatagtaaattcacattcactgaagacattcaagaagagtctggaccctttgggaaccatgtatagggcaaaggtttgaactcatagtagatgatttttacagtcactttttaacaatttaaaagcctatagatgactccaaaatgcccatttggatgatatgaggcatactttgtgtagttaaggattttaaatacataacagagaggctgaagggccttcgggaaagaagctggggtaagagtcaaagtgtagtatgttgaccgatgttcaggaataggctttggcatctgacagattttgttttaaatactggctctgggtcttactagcttccagttctgggctgcttcacctctcttgagtttcagtttcttcatttctaaaatgaagatactaatgcttcctttgttgggtttttgtgaatataagtgagataataaatgtaaatatctagcccagggcctggtgcatagtacaagcttcataaattgtacctattattattagtagtagtagtagtccagacaaacagagcttgggaaaacgctagactctggctgacatacatgggcttttccccaggccactgctgcctggcttccccttccacaaagctttgagtctccaaaatgctttggctggaatgtaagcgtgaggtcattgcagataacaggggagcatgatttgcttcggtaatgcaagttattaagttacttccctcagcccagctgaaatctcttattggttgatgtgtgcttcaaagtgtgagacagagctagtctgaggagagagggagagtgagaagattcctcttcttggccagaggtcatggtcttccacaaggaacagaatgactcaatgcaaattatgggacctctttgagtttggggcccctacatttaaactagtaactccgttgcacatattggcacccttcccccaacaaaattactgggcaggaattttcttgaatccttccgtggcctggaatgatctcccttctcatccttgtgatccacacagctggcaaatggcaggcagcagaacaaaaacaagcctcttagcatatagggagagaaagagtcacagcagtactgaatttgcttgggaacctaatgttaacaaaggaccttcctctcaacaccccaaacagattaaaacatttttttaacagcaagttgtgtctcggagcagctctttgcttgggtatatttaaagatctgctgagtcatttaagagcaggctggcatatcctaagaggcaaggactataccccagtctatgggggagtaagttgagaggtgaaatctgtttggctttctcccatggaaacaaacaaggtgatccacttccatctcccacgactctggagagcatctactaagccttcttattctatcaactttgaactcctcagtgtataatagagtaagggtgagagggaaggagcagtcgtaccagtgtcattattggtatgttcaggagttcaatttcttcctgattcagtcttggcgggatgtatttgtttgggaatttatccattttttctagatttttctagtttgtgtgcatagaggtgttcataataccttctgatagttatttttatttctgtggtgtcagtggtaataacccctgctgtctgaaattgtaatggccctgctattggtagctgagagtagcatggaagtgtcaggttgatgggttcatttaattcttttcttttcagtttcagtcacatgcattgttaccatggcatatgacagttgctagaaagtgaaataattttttttctactttattctccactgcacttctaaatttattagtggagaaattagcagttaccaactgttcattataggtacacattggggtttccttagagccaattttccccctggttttcatcttgtaaatctgtaatcctaaaaattagcaaaacctagagcttctctttggtcctggcctgtttgaaccctgttccacagaccccaatcttctttcttgtttgaggcaactatccttctctttgcccaccgccattttccttcatctacttttcccttctctagcacctcagactgtcttcccacagtggcacagcctcccactccactttcactgtgccatctccttgccatcaaaaccatcctcacagacccttctgaaaccacttctaggaagggaaatcacaatggatccatgaaggatgctttctggatgactttaaaagattggtattaagatattttatcagtggtagcaacactgacttattcaggcagccatgccccggatctataagaaatcaggtaagctaaaagttgcttgagctggcaggagacctagttctcttttttcctttccctcttgcattttgtttatcgatggttttcaaaggacttagaggctggctttgttatagttagttggtaagagaaatggtggaggaccggaaaatgggagtggaacgaatgagcatgtttgagactaagttattacaattcctaggatgtataaattgcttgaaatctaccaagtactttcagacacattatcttttttactcttcaaaatcaacttggaggtaggcacaacagggatcaaatccttagttcacagatgagtaaactgagactggaggaaattaaaggagattccaaggtaactcagacaataagcaacagaaccaggatttggtgaattttttggggggtgggaggtacagagtctcactcaggctggagtgcagtggcaaggtctcgtctcactgcaacctctgcctcctgagttcaagtgattctcgtgcctcaacctcctgagtagctgggattacagacatgtgctacaatgcctggctaatttttgtatttttagtagagatgaggttttgtcatgttgcccaggccggtcctgaattcttggtctcaagtgatccacctccattggccttccaaagtgcagggattataagcatgagccactgctcccagccccagaccattaatttttgacagtaagtccaacttttttcaagttcacagctcagatttgctattgaatgaatgagtatatatgtcatttgggaacattctttccaacttttggttgaagatttgttttatcacttgtgaaaattttttttcattcttagcaatgtcagtttagttaaatgagcatttcatttgcgaattcactaattaattattttattcatcaatacatttcctgagtaccaactttctatcaaaccctgtgctggattctgaggctacaaagagaaataagataccatctcaggcctctaaaatctcacagactggggactgacatctcagtagtaaacatatgaacagcaacttgtgaaacgccattagcaaaatctcaagttatattcttcagtgactatggccatcctaaaaatggggtgtcttttatttggggtaaatgaagatgaagccttatgagaaattgcattttaatctaatcttgtcttgctaagaacagaagtggaatgtttcagcctctgtgtgtgtatttgtgtgtgtgaaggttgagtgtgtgatgatggatggggctgcgagattgttaagtaggatctatggggggccttaaatggtcctggtgagtcccaactttctggttatgtatttgagtagagtatgggggtgacaaagattgttgtttaagagttgattttagattttttccaagtaaatggtcagctgacttggagcatcatcattccacttgctttgaaaacctgccacttaaggctccttccagtcataggttaactctttctggtcaagtattactctttttgagcatttacctgtcagtgacaggtacaatgttagatgttgtctctctgttttcttgtttaatctttactttgatcctaggtagctcttattagttccactttataggtaagaaactgaatttcagagacttgaatgacttgttcaagatcacatagtatagtaacttggtagtttgggacttgaattttgattgttcagttttttgtttgtttgtttcctggcctccctgctgttttcactattccacaccacttcagctttatttttcatagaggccattaaatgtaccctccatcagccaaagcctcttgcctcccttcaacgtaactcttctctagcgtcctcttaataatcttctgaaaaggttttacagcctttctgggtactgggacccagagtcttaatccaggctcttaagtgccttatttaactgtaatatggaaaatcaaagtcacagctaattcaggaaaaatgagtttgggatgtgaatttcctaggcaacttgtcatctcttttttacttccttagcttcataaacttacccacaatgttccctgaggactaagagtaatggagggtgatgaggaaaggctttcctcccttcctttccgagagtcctttagccaaatgccacacctcctcctgtttccctagtctccgtgcagagatggaagtgggagatagacatgggttcctttcagccctgagttcatgccagggttttctttccctctagctggactgaggtaggaggagaggttgaagtccaccaataagaccatgagtgaagaagactaaagtacttgaaagagcagcagacctacgcttaaaatactagggtttgtgtccagactttgtgggttactatctgtataattttgggcaagtcaacagttctgagtcagagttcccttatcagcagattggaagataaattctaattatatagatgaaacattaagtctagaagtaatttgtaaattcagaaagggcttatagatttaaagtgtagccgttttgattaccacaaactaaatcctatacttcagggataaaatcttctcctgttttttctaaaagcctgtgcatgtgtggtgtaaggggtgggttttcccttgtaccagcaacttagcaattgtagtaacggggctgagggcagtggcatgcttcttcattgagcaagtgtgaaaagagggttatgcattcaggggtcagcagatggcaggcagagtagcccctccaaatctccctcccataccacaaagccctcttatttattcaaacttaacattagaagctcatttcaagtaggcacgtctgtgtctgggcgtctattttccttctttgtatatagcaggcatttgtcaacttggtgaaaagcattactcttctttccatttctgaggactaattgtgcttcttcgctagacacgagttcaaaacagtgggttgaaagagggcaagtttatgccaaagaatcagaaatagtcataatttagagagaattctagaggtcagttccctttcgtatggactgggcaactgaaacccagacagggaagggaattagaccaagttcacaagcacaaacactttactggcacattcagattggaaatcgagggcttctgctcccaggtcagaactaaatgccctttctagctagggtgttctttgatctcagtgattttgactctttctactgcactctggggacagtgggttctgcggtaccaactccaattaaagtgggaatatgtaccagcccctccccttggtttttatttttcagaggcctggcagtcagagggattctgatctctatatgcaatattttcacactactgtacttattgaaatcacatttgaatcttggcaattaacaaggcagtaattggcatcaggagggtatgttagtttgcttatctgcgccgtccctcctcttcccaacccactgtgtattgcagaatgttttatcagctctgatttgccaagttgctctcttctccagtaggtgctgcgagcagagagggattcctcggaggtcatctgttccatcttcttgcctatgcaaatgcctgcctgaagctgctggaggctggctttgtaccggactttgtacagggaaccagggaaacgaatgcagagtgctcctgacattgcctgtcactttttcccatgatactctggcttcacaggtgggaggttcttcaattgaaaacttagaactcagtttctagggtagtgagtgttgtaaggtttggactgtgacctaatattacgcagccatgacattatctattaggcatctagactagcttgcttgaatatcttagcatgttgactaatttggggcagaatatagtgtgggtgggggattttgtgtgtgggggggggttgggggttgagcaattcattattattaaaatgcaaaaagcacttaattcgctatgataagattgcctttttcatgcatactggcctacctgcaagacccctagagacagtaagcagcatacatggtgtcttccagttttcagcctttgtgcaaggaacaactgtgggtttctgcacatgtgttgtggtttgatgtttgtatgtgattgtgtaccagggtatgtgtgtctgttattgtgagttcatttctgagcagttgtgacacacagagatccagaaacagtgtcttaccctgtgtgctttgctagtgggaacgtgtcttttcttttgtgctcgtatctctgtgtaatcgagtgtcttgctaagtcaatgtgcctctgtctctttttaccagttctgtctttgtgtctctgtgccttcatgtattttttcccctgagtttgcacgtctctgtctatgtggatatctctcactccaggccactgtatcactgtgtctgtattacagctgtttatttctgtcggtgtgtggatttctatgtctgttttcatcttaatttgtgtgtctaagcaagactgttttggggtgactatttcagtttatgtcatagccattctttgtgtgactgcttctaggtatgtctttttctatgcccctattgtccccatctccatgtgtctctgtgtgtatatgttctaatgtatctgcctacttatcttagtttgtatttctctgggtgtatatccctctcttgcagttctgggcctttgcagtttttggcttatgtttttgtatatatccactagaattggcttcttatcttttttgtgcatgttttagtttgtatgagtgagcatatccaactctgtctttgagaagcagaactgtctgtgtttgcagtcagttgtgttggctgtccctgtgtttgtccctgtgtgtgcatttcattgtatgtgtacgcatccatgtatctttctgcttctctgtgaccagatatttctgtgtagctgtctatgtatattggcttctgtctgtgtctgtgttgttggctctacgtctgtgcatatgcacccaccgggttcataaaaagctcacctgctctccaaggaatctaccagattattttgtgaaataactcacgtttcgtttttttacttgccagctgctatggtacttaaaagtgtgttggtacgtaggtgtgcataatttattcatgtaggatgtcaaaagagtcagttaaaaattatgcacagtgtgtctttattaacaggacacttgtgtgtagagaatccttgagaaatgagtggttagatgataaatcttttcatattaatttcatgatgtcagtgaagtaaatttgcaagatatgggctgcataagaactatgttctttttaaaactcagcatattgatggtggagaaagcatttatttgtactgcaaagtcttatttctgataagacatcacaaataagaattattgtgatgagacttatcacaaataagaattattgtgataattcttatttgtgataagaattactgggttagaaggtgttacttttctggttttgtttgggtttttgttttgaagtgttactacagatggtgtcttagggacaaagagctctgaggttgacttagaacacatggagtacagataaaaaggagaatgaaaagtaacagagagatgggcatattccttgtttgaatggagtcatccaggggctcaggatggagtgcacaggaaatggagaggtgaaggtcatagagagaagtttagcaggaccagatctttccttgtcctgggctgctgtgaccatataaggaaggcagtaaggggaggggtagggatgaggaagagaccagctctcctctttctttctgatggaaggttaccacctctatttaaaacttctgttcttttggtttctctttctttctttgattatattattttctggacttgttctgccaaagcaagaaggaaattccacatgtggctcactcatttattatacttgtttctttgcacgatattaaagacagcttgttaagtgtcactgcaaacatcatacacactgatccactgatatgggcagggggttctttatgccagttctgctctcttcccagtgtatctgtggtgcttaatgggcgcaaccatgatttttctgatgtcagtctgtgatgtcagttgtccagtgtgtatgcaggctgcttaagagtacatacagttccttcacaattatggtagtccctgagaaggaagtggtcattaataaaagactaggttcagtagaaacatgtaagttgtctaggtgttggaaattaatacagtactgtgctaagggaacatatatctagaagttaactgaattatgctcaataaaaagagtacaaatgtttcataaatattttgacctaatcctcctgtaagattaggagagggatatttccgatattcaaataatttttttaattggcaaacaccttagacatactatttacataaaattgacatgacaaaattaagtcattgtgtctgttttatgataaaacaggctcttttgatttagttagaattattgaatgtaaaataatgaaaattaaaaaaaaaacaaggaggaggaatctatcctattttataattcagaccgttgaattgagtttttcttttgttgtattgatttaaatgcagagaagtctatgatgctggattccagtcagaagataaacatttgtatgtgggctctacattgcagccaaccttgataatttcaaacctcgattttctcatctgtataatggtaataataaagcctgtctcagtagctaccaaatgattgcatatgacaaacttctcacttatttaagggaaaaaataagaaaaagaaggacaatagggtggatttttcatatagtaaaatttattcagttagggtaatattctgagattgtcttctgaagcaaaccctgcaaaccctggccattctgttttgtttaggaaagaattcatcagttctgattctgccttttctggggagggaggctgagtattggattgaagaggagtcactacttttctgagatgatatatccgtggtaaaaattattaatgctttgcacatgcaacatagagtgttcaattttgttagtcaacaaatatttaagtggcagctgttatgacctcaggggtgtagtgacttccttattgtcctttaattattaaaaaagaaatctatatcagaatatcaggtaaactcttattacatcaaatattataataaagatactttttatattctctaaacaaagtagagatctcagatgttggttcatttatcaatataatattagatttgaaaattccagtatacaaaaggaaaaggacagcttcttaaagtttatagtgattttctatgaactatcaattccgtttttttctgttttactggtatgatggaaactaaatttcgagttgtaagtagtagataattagactgcagggtaagccttgagattacttcttttcaggtaggaaactctactgtgtatttggctagttcaacctatcatgggtagtcaaaaatagttacatatacaagtcagcattttttaaattgttcagttgtgcttaagattggtcctttccaggaacaatccagctttatcaaaaaattattgcgtacatgtaaagtgttctgacattttaatgctcacaatagccgaatgacgtgggtaagaatcttcgtcttcattttatagatgaagaaatgaagacacagagacataaattaactgggccagggtcctaccactagaatgtgatagatgataatttgagctcagcacatagttatttccctataatatttgttttatgattgtatagatgtctgctgaccaaccttaatctctgctccctaagattaaccattctacaaagcagaaactggaggtcattcaaatgaaagctctacacttttagagggccattaacaatgctcaagttaaagaaaagcaatcaaagacaactaaaatactggtaccttcaaacagtacttatgaattatttaaccttagataatttggctttgagttagaaagatagagtaagatggaggaaccaattcttccctgggttgatatttatttatcttgctcttttgaagtctaggccaatcatcctatttattctgaatggcccgttaacgtttatccatttagggacagcaggtttggcacaaatggattggttttctgaggtcttatgtagagggctgcactgactgacttctgaaagtcccccctaacccttcaaatctcagggtcatctggtctcaagccttcaattatgaatacatttctattgcctttttgagtaacagcacaacactgcaagctgacccactgggtggatggaatggggctcttgccctaccaccctttggcaaacaatttgagggtggcattgtcactacctcattgtatatagggtctcttgaggcccagaatggcaaaataattttcccagtgtcacacagcgagttattgtcagagtaaatatcaattttgaatttgtagaccacgtggttttacctcatcatttctgtttgttatgaaagttttacaaataattagaagtagaaataatgattaaaataaagcataactactaaaaaatagtttattgcagcaccacctaaattcatctcaccactctaccagtagcatacatttcacaattgggttaacattgctctggatcttatagctgttgaagaagacaaaattctttccattctccagcttatattttccccatttgtaaaacataatggaagtgtacggaaaataggagttgataatttttaaggcccttgccagcacattagtacataggattcttgcaagtggtggtttacttcacttcaactatagaaggcctatgcgacaccacccatagagggtagtttgaaagaaaatgctagtgactacgtgtgtttccttcctgacatattttatagaaggtgatgagttccagcattttttcagacttggatctggctttcattccccttctcctcccaccctctaaaacaacagaggcagcaaccatttacacactttccagaagtaagtaagtaagactgtattccagaaacaccctatatcaaaatggaaatatactcaagtgccccaatgacccattgggctagtttgaacgtgtgcagtctctgtgctccccgttttagcttaagcctactccctaacctgtcatatgtcacccagccatggagcctagggcaatgactgccatcatatctgactttatggcctctcagctttcaatgactagctttgtagcagaagtttagcctctcatccccataactttggaagtagtgttgagataaagaaacgttgaattgaaggttgtgttttctagatttctttcaattgctccttaggctttagaagataaattctcctaaaagagaggtgctacaattaatccaagcaaagggaaagatgtcagtaaaactgccccttttcatagaggtgtggcaactgctgggaaggaagaaattagcctgaggccatgtgattactaataaactcaaagcggcatttttttacttctcaatatgaggttgaaactataagcttaaattgctgactttctggcagcaccaaacagtaaggaaaccacaaagataaacccaaataatagagccaattttctttttttccgggggggatgacttctaactagtgatatgaggaaggataagaaaatgtttctttgtaggacatatgatctttgctaagtgcactgaatgtatgtagaggagacaagtctgctgagggtatgagaattgggccaagatttaacacattttcaaagctccatgaagaagcctactgagcagtgggagtggagcaggttggggatagtgaagtatttgtaattcatttttaaaaaggagagggagagagaaaaggaaaaactgggccacccatcctttgaaaagaaaccttgaaagaggtccaaatatccttagaaatccttgacttcttaaaagtgatgtttgttttttccccctgacaattatagaggtcagagagtttttcttttctattacaaaacattgagagtgtgtagaaataattgtaggtagcttagccttggctgtagtcagaacttttgtactgtgactttaggatctgtatggaatcgtatgatatgcggatacaccaaaaactctatgggttatcaaaatgggatagcattaaaagaaatagtgcttttgtttagaagaagaaatgaaatgcttgtgtccagatgcttaaaggaaggcagtgcagactttcagaaactagactttaagagctgtactcagatactgagaagggctgatggctgaaggaggaacaatttaaaagaataaccgtctctcctctccctgtatattggacataaaagaatatcccattcttttcagaaatgtaatacaacagtttagcttgctagtaacttcacatgctatttcctttacctcttatatttgaggtgtctatttggagtgggctgtgtttctagctattctgtttatctggtttgtttttgttggtgtaggaaactggtataaattttatttgggtaaatatcacctcaattttcaactaaagctttatttaagtttcacatgaaaaagacaaatgaggcaaaggaagagaaaaatgcattgtcagaatcagaattatgagaaaaaaagtcaaacaaacatatttgaaatgtccagaaaacctgtgagtttttatgtatactatacaggaaagatattctgtcatctggttgccaaactatggagggtgggagacttcgaatttttgtcaaaaagtattctttcattagaaagatacatgggtgtgcttccatgtcagcaacatgactgcagaccaggaagtcctcacggagagctggaatatgggtattttggactctctggttagatgcagcttttacttcacatcctcagtggtactactgtaaattttcattttcctgtggaataccctatttggttccattgtatatagttgacaactagaattcgttcgctgttgcttgagcccaactataacttcttggcactatacctatcttctgatgtgcctgtggaagagctaccataatgaatgtgtacatggacaaaaaaaaagagagagagagagagaattaaatcatgagtttgtgccttgggagctacagtttaaacatttgctgtttttctcacttaatgaaaaatttatttgaaaataacagcacagaaaggaagaaagacaggctggcaagcatcctcctcctaatacacttatccacgtttggataccttggtctcagcctcagaggtcatatttttagtaaaatggccaccagaaataaaggattttattttccagactttggtgtttggagctggtgtgctgagagctagcagagaaagccctactcaggtagatgtaccagagcaggatggttgctggtggatatggtggaataccttttatgtggttatctcctccttgtaactcttggctgcataacccttattttcttttctatttttattctctctcttggaaaaaaaattggtggtaaattttcatgtgagccatattgtctttttaaatagttttattaatataaaatgtacgtaccataaagcatacccatttaaactgtaaatgtcaatgggtttctctctctctctctctttttttttttttttttggatgctcagagttgtgcaacaattatcaaaatcaattttggaacaatttcattgccccaaaaggaaaccctctgcccattagcagttactccccatttcccccaccccctgacccttcaaccctaggcaagcacaaatgtactttctgtctctatagatttagccattctggacatttcatgtaaacagaatcatgcaatatgtcaccctttgtatctggcttctttcacttagcatgatgtttccaaggttcatctgcattgtagcatctgccaatacttcattccttatttatggctgaataatattccattgtattaatgtatcatatttgttttttccaatcatcagttgatggacatttgggttgttttcatcctttttttagctattttaaataatgctgctatgaacgttcgtgtacaagtttttgtatgaacatctgtttttatttctccttggtatacacctaggagtggaattgctgggtaatatggtagcttaacatttaatcttttgaggaactgccagatttttccaaagcagcagaatcattttacattttgaccagaagtatatgagagttttagtttctccacatcctcaacaacactcattattgtcattgtccttttcagcttttttgataatagtaatctcaatgggtgtgaattgggaccccatcatgcttttgatttgcatttccttgaagagtaaggatattgatcatcttttcatgtgcttattggccgtttgtatattttttgatcctttgctcatttccaaattgggttatttgtctttgcattattgagttgtaagatcttacaatatattttggatgtttgtcattttagggatgatacttcacagttatatgatgttttctagcaagcatttgcgttgttctactggtgttacatatcttagctgcattagccactttgctgggtatgaatgccagcagaatctaagtgaccttggcttcactactgagaatgcaacccaagaacagaaatttgtcagaaatttagcactgaagccccccacttcccaaacttatctgggacaaggagaatctacatttaaagctctatactttgtgttgtgttttttttactttagcttggttggatttaggatcttttctttttgttttgccttatgcatacctaagcagaggcaagggaggaaagggatatgaacctggtagaaaagtaagtaagctttattcagattggcatatccatcttaatatggttcaattggctgaagaagtatctcaactaaaactctggaatactttgaagtaccagcaatatgtaccaaatgtactttttatttatgtttggtctctatgtacttgtgtgtgaaacaatgagcacaaataataccctccttgtttttaagcaatttatattggtgatttaaaaataaaataaactcaagtgggaaatcatgaaaccccatgtaaaaacaataagagcatgttttaaaatcccacagactttagtttcaaatagtggttttgctatttcttagctgtgtgtcactgtgcaagttactttgtttctctgagtctttattggtgatatatgtaaaaacccaccttctcaaattattgtgaggacaaaatgaagtaattaacataaagttcctggtgtataataagtgttcatattttgtatttgagcacagggcaactgggtttttgaaactgcacattactgttgcagtcaaatctggcatgaaattagtgcatagacagaatgggctgggaaaatgaaaggactttgaacatttatattctgctttatttaggcataagtgcttaataattattgatagtttcttctggttatctgacattttgaagatactattacctagcagaaatttcttgtaataataatctcttacacttatatactgttttgtgcctttagaagtacttaatgctctttatttcactatctgttcataaacattctctgaagcaagcatacagtcagtatgaattccatttttcagatgagacagctgaggctgaaagacatagagttacttgtctcaattcacaaagtaaagtgccagagtttgaaccagagcccaggtcttctctctcaacgtagctctttttctccttcattatatcaggcatagtagcaacgtattcttttactagctttttatcttgaatatccttttagcgacttgcctttggtgttagtgtgcctataacattgtcgttgaatatcttaatacatttagtggtcttggcaagcagttttgtcttcagaaggacactgaaatctgtggaaaggactgcagaagattgggtgggcagacacctatcactttcggggctggtagactttctattgaagcaatttgcaaggctactttgtattgtctaaaagcactacttcagaaaagggttgtgatgtcaaaataggcactttgagtgaagaaagggctgtaagcatgggtggaaaatgtggtagatgattgtcttgagttattttctttaatgtcaaacaggcagtccttggaatgctacttcaaaaagtgttgtataatgttgaagatacagttacagatttccaacacgaaactcataaatatgcaattccctgtcctcctaggcacatgaaggaaaatttatgagcttcaggtttctatgcagctattaaagcatatttaatctgctttgagctcaagctcactctcgttggctctcttcgtttcttcctcttacatgagcaaactgcctttctttttgtttaaaaatagtaagtaggtttgttttcctccaggtgtcatgaatgcaaacattgtaatttctcatctgttcagcctttttgcacaacaaaatggcagcacccaggaggttgaaagggttaaattgttccttctctgagtagtaccataagttgttagtctgctactctttctcccagttggcacatgaccctaacatccaatcgctagtggtgtggccattttttggtcttattttggcctttcctcagccaccactcatcagttctcatgcgtatttgtcagatcctgctccccaactccacagttcttagttcatcttaagcatatggctgtctgtcttttctctaaagatcctcaagggaaaaaaaaaaaagcatctccagggggaatttactgcctcatagccctgacagagatttctgaccaaaccctaacgaaaaaatttcttccctccatttgtcttttattgtttttacaggggagatatgtaacataataacaattatattgcacataataattacttctacaaataataatctgttgtcaaaaatatacacagctttggatttccttattatggcccttcattaagttgtggtttaagaatagctatgattattacttttgtgataattataatccataatatggaaacttataaaattacctttaaagtgttactattattctggccacaggatggaaagttgttcgctagttactcatttataacctgaatgtactttttactgaatctaaaggtatcatctttgcttggcaattcccatgacttgtctttctgactcttcagatctcagcttaaaagctctcccttcaaagaagccttccctgaccactctggttttttcttctttttttacctctactccttttcccattacttgctgtcatagcattctgtttgtttcctttgaagtgcctattccaatttgtcattatgaatgagtttttttgttctgttgcttattatccattttccccactagattgtcaactctgtgagggcagagaccatgatactctgttcactcctatatacattcccagcactatcagactttttggcacatagaagatactcagtaaatatttgttgaatgaataagtcataaagaagagtttatattttaactcttagttgaataatctaagccaagaattatcaacctgggttggacgtgagaatcattaatgaatctttaaaacaatgacaaggcaatctatttattaattatctccaggtctaaactttagcacgtatatacattttaaaagcccataagtgattcttacgtatagccagtgctatctgtctcttctcctgtcctttcccctcctctccttactcctctctcatagttttaggattagcatggccccacaacaaatctttaattcacatggcaatttctaggatttatcatggaaaatgagccaaattgccttcaagaagtttttacgtacctcttatatagaatgtgatgttttatatgtacctcttatagaatgtgagcttttaagaggcatatcttattgcaagaaatttcaatgttgaaaaaaatattgaatatttataaagtcaaaaatgcaaacttttatatgattttcaaacctatgaagttatatcatgttcaggccttctttccagcatgtggctctcagccctggtactgtccttaaccataaacctcatctttgccctctatagggagaggtttatggttataattactcattttaaatagtgtatattagtaatgtacactatttgtatatttgttgactgcctcctatatgccaaccactatgctagaaattttgtaatattcttcacgatattcaagatattaacatatccgcattttataaatgaggaaactgctctcaaagaggttagtttacacagccagtaagccgctaagcctagattggatggaaggtatgtgagaaaaaagcagcatccataaggttttcattctcctaccctgtacgacagaggtaatagaaattattagttaaagaaataatagaattttacaagactctaggaagggagaatgtgaaggatacagttctcagttactggaatgagtgccagagtaccagtacatggcttgccttggggtttggactacctatcttaactcctttgctcctcccaatcttgatctcatttgtttgaaagatcatctgcccaacataaaaatgcatttctaattctgtaatttaagtcagtggcaagatcagattcagttaaagtttactttcctgacagctttttagtatcatatctattttgcaaaactctagtgataaatgtatgcacatttacacatacagcatctcttctgattctgactaagatattactgggttgtgtagaagtgatgggctctttagaagaaaggtttgatatactactaatctaaggactgaattttctcatctttgtctttgccccttttgactgatgaccagagcaggagcacataacattcttttgtgctaacagtatctctgcatcacattgatcaggagaattggcatctccagagccctgggatggtaacttctctgttgattttcaggaaagattaggtgatattttctccatgggaagaggatgtttgatgtgtgttggctttagcaaaaggaagcttgtggagtcaactgtaagtagacagaattgcctttgacttaatctgtttcagtcgttgttcatactcaggtcctccagaggacctttaagcatttttattgactttgtggtctattacacgaaactaaagatactgattctcagtcatgagtctgctccaaaattgcctagggaatcaaaaataattgtaccagttcctattcctggacattatgattcatttggtctggtatgaaggccaggaatctgtatttttaaaattcactcaagcaattttcatatatagctataattgaaaatctgtggctgaacttctccactcccgtatccatcgcaatacttccccaaggtggcatttaagatgggcctagagggttatataagatttcaatattaaaacatggattaaaagtgaagacttttcacatggagataatttggaagaaaaacttgcaaaaatgtgagagcattgagaacttttctttcccaaggaaagaagtggcagcttcatttttggtcattgcaaacagcagtgccatacatgaaaggaaagtggtggtgctcatcaactttgaataactttgtacagaacccttgagactcctctctgcttataaagaaaaagtgtcaactgtaaagttgatttatttatgaaccataggctactatgaaatctctgttcccagctagaggcctgggagagtaagataactacttgtttattccacggagccacttattagctttttctatagcacatacctcaaatgaagcatttcaataaaagaaccacattctattcacatgcttcattttattctgatttatgtaaaaattcccaaactcctcaagcagtgtttctttgtaaggcaataatcttcagttctgttgcaaaggtcaggagtgatagaatgaaaatggtactagatacaacagctctttggtatttgcatggccattacattgccatggggctgcaagacttgtgagtgcttgatattttgcttgttgatgaatgagtctgtgtttgtgctaatggagtgatttgagaggtagttctccactgtcagtcaagaggttggttttgaaagctgattgccaatggtcattctgctaaccactctggttctcctttagatagagacttattcagattcaagtcttcatgtactttgtggcataaacattgtacacaccagatgtattcaacaaccataaaaaaaaacaattaggactcaagtagtatgtcagagtgtagtcactgatgatatataattctccactaccaagaagatggaagcacactgttgagtagctacatcctacatatgttggccagaatttaggaatacacatgtgatctatacattttgaggtattgtctgacccctagaaaatcctggtgaagtttttctggtgtcagtttggtcttaatgtttaggaaatgcccacagactactcctgctttctgcttattcacatagtaaacgcaaagcacaggactagtttgtcatctggatcaaggagaaatgagttagcagatataaaataaatcagaaaggaggtagttctcaaatatttactccatgaatagttgctggatgttcattaactctatagcatttgttactacttattggggatcctggaaagaaaatatattgtctatatccactgttcactgaggccctctccctacccagaaactccctgtctccatcactcactctccacattcattgacccaggggaacagttcatggatgagtgaacttgagctctatcttaaaggatggagttcgatttcaaggcaagaggtataagagaaagttcagagacaacactggctatggtctttgtgaagaaaagtgaattgaataggctcctgtggagatcttaagtaagtacttctggagataaggttgaggaaaagtaggtttgaatcttcatccagaggtagcccctaaatgtgttgagtttattgaaagagtacttgacttggattcagacagatctgcatttgactcctgttttgccatttataagaatttgagtaattattgtttctaaataagagtttattgagccaagcactcagtaaatgtttgaatgggaaaattaactgccctgtttttctattgtcagatggtcctcttcgttggataacttggtaactgttgataaccttttctcaggaatcagaaggtagaaaggttgggaaaatataagaaacaaaaaggcatattcctatttttattttcatattgtcttccaactctcccaggcttctttgtttgcaaggctgacttttataatactttttgggtagagcaggtccttctttggtttggggttaaaccgtgagtaaccttattttctaggtctcagccaactttgaagggcatgaactcacagtagcctcactaggatcacttcagcagtgagaatttatctttcttgtataaaagtgtaagagttgatggcggccaggcgcagtggctcacgactgtaatcccagcactttaggaggttgagatgggtggatcacctgaggtcaggagttcaagaccagcctgaccaacatggtgaaaccccatgtctactaaaaatacaaaaattagttgggtgtggtggcacatgcctgtaatcccagctactcaggaggctgagacagaagaattgcttgaacctggaaagcagaggttggagattgcagtgagccgagattgcaccactgcactccagcctgggtgacagagtgagactgtcaaaaaaaaaaaaaaaaaagagttgatagcaaaataactatctgtagcataaacctcagtattctttatcattcagtatcaacattattactgaaaacaataagcaatatggactgagtttctgtggggtggaaatgtgaagtggatcatagcatgatataacttgtcatttggcttcctttataaacattatcaactacctcagctctatcaatcacttggcagtccgtagtgaacattataactcaaatgactagtcaggtctgttcattgcccatgtaaaggcatatacctgaagtgagaagtctgaggtaacttagcaataagcttgcagtacagtgtttagtgaagccgaggaattcaaggatttgagtcatgccagattgctccataaccatagcctatctttgtcacaagtaagaaggtttaaaaatcaccataccattattggtcacaacgtttggagatagggaagagtttgtggatggatcatggcagtgcatggacagtgattagcccataacacaaccagtgaacactgttgtacccaaagcacataaatcaccacatatactattaatatatttatggatgacaacagacactataattttatgtcagtgctttctgctgtgaaaaacaaagaaagttaagggtaccttttttatatttgcatcatatctccagaccttttcctttatctccttcttgcaagttcttctttctttcagctgactatctgctgttcctgctatggctcccagtggcttttcaagagggtacttgttttttaagagaagacccttgaaggacagagagagcctgaatcattcaaaataatgaattactcaggatgaaatttcaataatttgcaagtgtgtggagatagatattttgaggaagcataattttctatgtacccctcaaatcgtggctggagatgacagcctcttccacctccatataagaccatttcatttccttctacttttttctccctccttcccccaaacacacaaacatacacatatcctgtgcttcagtcacacagaacttcttactatttcatttcaattctctatggctttgcatgttctgctccttctgcctagaatgctcctttccttttttcacctggaaacatcccaattcaaatgtcacctcccttatttataccaactttgtctgtaactcctttatcacacttcttcctgtgattagtcaattcacttgtctgctgttacacctctatgagagatgaaaattccttctccatctctggaactcatgcccttcgcatatagtaggcaatctgtaaatgtttgaaggttgagtgaattaatgaatgaccttcaacctttcaggcttccaattttctctctgaaaaggacagccaaatgaaaactcataattttagaagatgaggttagacggttggtaggtgcatgcagagaccagttattatttaggtattatggaagtttatagttcttgtatgttgagttcagtgtaagagtggccccaaacatagttaatgaccactccagacccagttgttatagagttggccccagctgtattgcttctatttaagactaggataagaaatgacactttcctactttttaccttattgaaagggtagaggctcactgttatcaatctcagttcacttgttgattgcactggcttgccaagtgagaatattagcacctctgcacatttctatagctctgccacttatgagatctttccttcccattgtcatatttaataatcaggatagccctataaaatatgcattctcatttcccagatgaggatactaaggctcaagtaggagaacttacttgtttagtaagatcatacagctaggaagtgggagaggcaagagttgaacccagatcttcctagctcctagtccattgttctgtctactgggtcacactggaccagccaggaggcaggaaaatcagctggggaatgtggtgccaacgtgtgatgtttgcctaaatgtgtgcatccttgctggaagccagccatgattcatgctgcataagtattcattaatgttcatttcatttatttggctatccatatgctttccagggcgaaggcaagctaggacaagggcagacaagcagccttaaagtttgggtgctttccttcgaagttgagctgcctgtttgaaaatcacactttttggtgatagaagatggttccagtacagattttatttattactgcatctacatggatagacattttccaaagcatagctgaaaatatgtgtaagtcccagaatattttctgatttagacacagactttgagcatgataaccacatttagcatgttaggaaattctgtcagaatgcttctggaaaggctacctttccagaatgaaatgaaaaaagaaaaggatggactttgaaactggctagatttgggttatacttactcatagtgtgaccctggcaaatgatttaacttctccgaatttcacttttcttattctttgaagtgaaattttaaaatgccatcttgcctgatttttgtgagaatgaaaatgagatcccacaccaggaatttagaagctactcagtaaatattgcttctctcctttccccttccccagtcctgtcccccgagacattcagtagttattcacaggcatgcattctgaagtctgcctactgctccatgttgaaatgcactgctcttgcaaggactgattatctatttttctgtcttccaaggccccctgtgttccactccaccctcccaattctgggggcttccaaagtgggcaggtacagaatgttctgtggagcatcggaggctgttactcaatatcttggccagcactctcaactgctctttgcacacactccatatgaaggcaaactccagatcttggagcccatgtgtgtgtcatgcattgtactgcttcttgtacccaaatccatctcaagggtgagtagaccaggctcagacttgtcctgggagcagatttctcaagctgcccatgtccccacactgtttgattaaaaggaggtgcttcaaactctttggctttatatagactagaatcagaatgattggtggtgcctctgttctcaaggtatcccaaagcactttgtaaggaaatatgacaagcgctgaggccatgcaggccagtacaacagccgccacccagcacttcacaattagtcatgcccagcctgggatcatcaagcctgtttttattggaagagcaagagagagagggaatgctagctggcaatttccccaggtaccctttatgaaagtgcccttggctcttccaatttcatctgaataaccagctcaggcaaattttcctctatcaaaaagcagaatgtgatagtgacaagctgatgcccggctgatgccccaggacattgactaaatagacttggcctcacaattggtttttattctctatctcctttcttcccttttgttctttttctgtgtttctttccccattgccatctgcagagtgttctcagtcagaagtcagctgtggggtggacagtttgtcattttaagatcatccctattctgtctacctttcttatccctcatatcattgcttttagagcaaggacaattctggaagtgaaactacaataacactctgggctcctttccctctagtagtactcaacacacttgtaattacatgttcaaatttgtctttcttatttctacttaggttcatgaaggcaagggacatgcctgtgttgcttactttctcttggcaggcacatacagcaagtcttcaaaaaatgcttgttaactacaaattaagtgtttaagaagtccactgttaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaagaagtccactgttagtatcttttcccctgcctagtttgtaagcaactggcctcttctatttgtaagttacctgttttcatttccatatgccccaaagcaaactttagctcacggccttacagagtgtgtatgttagtatgttaaaatgaaatcaactttcctctcccaggccttctaattgacatgaatttgggagtagacttgcattggcctttgtcctgacagccaacagagtcctcttctgttgtattcactgttgccttccatgaggatcccatggagaaagtttgtcattgatatacattttgagggcagactcaacttgagtaaacctgattgagctttccccatctgcctcccagagatcactgcctgtgctttgttaaaaagagaattataggagtcctctcaaggcagagaggcctaaaattagacatggcagccatgcctttggtgtgcatggaggttggatacaggcagccagtttcccctctgttttctcccttgcttacacagccaaggagtggagccaagcctcaaggggaggagctgtatactcgagcatgccctgtggttcctggccctgactgagggactattttatatatcccaatagagaagcgtggaagacatctaggttgccactgtcatttgaaattggaatttttaaaagagaaacctgaagacttgaagaaagctttcttttgcctccccttacagttgatttttgagcttcttaaagctacctagtccaaagtacccacactcttattcttttgtctttcctactggttttatttttttttcatcttcccaggtgtttgatgatcactaagagcttcaacattgctcaccctgaccaggtatgaagccaagagtttggtttagggcataaaagaatgtcggaactcaaggactaggttgaggtggggaagggggatgaaggcttctttttttcttgggttaagcagaaataacttagatctcagagtgaaagccttgaattatcacatatatcactggaaaagactagttctttgctatgataacaattgttcatcatctctcccctgaggatttggggtcaaggcctggctacaccttttaatgatttcagtcatgtgacttaacctctttaaacttggattttcttcatctttacaatggaaatgatgacaataatcactacctcacagatattgataataatgatatctcactaggaagagaattaagtaatatgagggataaaaaggcatttgtaaatggtaaaatgagattatgattttgaaagctattattattttcctttcactgtctattatctcaactcttctattttcttgccttttgtacagcatggataatttagatgtgactctggacagagggatggatcagatgacttcttaagttatcttccagtttaggagttcgtaaactatactttctcctttccagactatcctagtaagaaaattctcttttaagacagagtagaactctggaattcatcagttttgatgtttcttaaagtgtaatctaagatagtgctcctgtattaagttctgatgtctgaccattgttcaaataaagagtaaaatgcaaatgacaggaaattggctgcgttctgaatcctatttttatttgggataacaataagcctgtatggtcactgtgacctttgatttgctgtttctgcaacctcacacttgtctcaggattcttcttccacttctgcactttatattgggtttcttccaggcatcatattaaactttaagccaggtatgtgtatatgcatgggctgtgggcctgaaaaaaattagcccgagagagaaaaaaatttaagtagtgggctagaagtaagcatgctactagaaacagaatttgggaacacagctctgggcctagaaaagcgacctgtcaacttgttacagttaacatcaataactataggatgggtttggtggaaaattatgctgaccaacagggtgggagagaatagggtcagaatatatatcgctgtaaggttgagaaaaaaagaagtgaaaaaaaaagaaatgcatagagagaaaaaggagtttagaggtaacatgttaaagtgtgagaaataaactggagagcttgacttctcttgaatatatttttaaataaagtactcctttcaactccaaatgcagcaggcttggttcccttctcctacctccattgcggatgaaagcttaatctttaagatgggcttgggtgggtagagtacgccccttggtgagcactgtgctctctgcaaccccaataaggcccaacagggctctccaaggaggcaaaattctgatgatacatttctgtttagtggaaaatgggtagggaaaattatgtcttagaatcaattaaccaaacataaaatcctccaaggggcttggtaggatgcctagggaagagccacgagataaaaactccaggctggaagggcattgttgcagcactgtcattctccagtttctcttggagttgtcaccaccctctcctttgttctcactgctgacatcatttgtaaaataatttcttcccttaaataaacaagacatacaatcctctaaatgactaaagaacagttacctagaagaaaccttagtggaaagtattttcttcatctaacggatgattgtctttacagaggtggagtaaaggatgtgcgagggagcataatcaagctaagagatgcatgctgacttaaaaggcatgatatatgtgaaactaagataatgtgttcaagagtgatgctttgttgatgcagaaccactgaattccttactattatgtttgcctgactatcggcctcttaataaagaacttgtggtttgagtgttcattgaaattagccatattaggtttatgtggggatgtgaggatctatgtctaccaattgcagcctctgctgcaaattggaggcagaaatctgggctgaacaataggtaagagtgtcaactctacagatctctcacatgctaagcaagcacaatatagggcaatccaggtttacacaaaggattaatttgggaacaattatcctcattttcacttcctaaaaagattttgaataagatgtcttttaagtaagaagctccctgaatgcatttaaaatatgatttgattatgtacatttcagatttttctacctttctaggagtatctctgttgtataaaaacacaaaattctggaacttttgaaaggaagatgtgcctctcttcatacatttgtcattcttgaacgattgtaaaatgaagtgactgcatatcacgtcatgtgccctattgatttcttttcttgttttaggaatattcccagaaaaaaaaaaaacttttttttttttaaaatctactaagcatgctaggtaagactgaagatgaatctatttaagttatgtcaatatctatttataaagatttttgtgatattcttttcactgtagaacttcaagcatatcctaaaaggaacggttagatacctctacaaactgtggcaatgacttactgagtaattgctggcaactgatttttggtgcttcttgttttgatagtatagcagtgcgagtaggtttcagaagagcaaaactaagacaatccagggaaatgccatttgagaatttctaactttaaaaaaacaagtaaaatagtgccaagaatattatctaactaaccccaaagtctacaatgtaactcttttattttgataatgctgttctaaccctatctacttcagtcctttcccacccagctggtttaggaatcaaattcccaatgtttcatcactgttaacattactgttttactcttcactttagttcttaaatggcatagtgtcttaaattccctcagcctctttcacatttgatttctttggaaactttttaccttttcattgaagcccatatgatcttttccgaaacagacccttatctttacctccttctttggagtctttctcctacttgaatttctgaacttcttaaaatggccgctttgggttggtgtcagtaattcagtaataagttttcttttctttttttttttttctttttttttgagacagagtcttgctctgtcaccaggctgcaggctgtagtgcagtggagtgatcttggctcactgcaacctccacctcccgggttcaagcgattcccttgcctcagactcccaagtagcaagtagcagcaccatgcccagctaatgtttgtatttttagtagagtcggggtttcgccatgttggccaggatggtctcgatctcttgacctcatgatctgcccgccttgccctcccaaagtgctgggattacaggcgtgtgccagtatgcccagccagtaataagttttcttaagtgctttcttaatattctgatatttttaaaaaagatctggactattttgtcatacaggcaacagaatgttaaaccatttcataaaacaatgacaaatatacatgaatttttcatcagttataaatgcatttcctttataacattgaacatgtttttgcaactgaaataagtacggttttcatttttagaaggcacatgataaagttaaggcagtggttaattaattttttcagattaatttttcagaaaagtgactgtttctgtctattgtcttaaccccaggcatcaaaggattttaatcagaaagaaccgaggaataatttggttattttagtgcctttttttgagacaaagtcttattctgtctcccaggctggagtacagtagtgcgctcatggcttactacagcctcgatctcctggttcaagtgatcctccaacttcactttcccagctaactgggaccacaagtgggcaccacactctctgcaatttattttaatttttcatagaaatggggtctcactatgttgccctggctggtctcagaatcctaggttcaagcaatccttccacctcagcctcctaaagtgctgtgatttcaggcataagccactacactcaccctattttagagctttgtcaagctttggaaagaaaaccatttataatataatagataaattatggatatttgaggcagtttttatcatagtatacatggtaaaccacagcccccctttataatatttgtatttaataaaaatgaaaatattacttttatcttaaacatgttttaacaaagcaagcatatgtagattagcactaattaaaacaaaaacctttgtaatgatagctgttttttatatgattacaaaaaatttactatacaaatttttatcctaatcagtgtgaaaaactgcaaatattagcttatagggctagtcttcagagtcctcttcctacctactactgctaataagccaatgaaaaactctctgatgtgtgtggtggctcaggcctgtaatcccagcactttgggaggccaaggtgggtggatcacttgcactcaggagtttaagaccagcctgggcaacatggtgaaaccctgtctctactaaaaatacaaaaaattagctaggcgttgtggtacgcacctgtagtcccagctactcaggaggctgaggtgggaggatcacttgagcccaggaggttgaggttgcagtgagccaagatcacaggactgcactccagcctgagctacaaagtgaaaccttgtcaaaaagaaagaaagaagagagagagagagagacaggctcctccgctttttcagttcctaaataattttccaatctagaatgcaaaagattctgaaggaagacagttaccatttcagatcggcagaagttgtggctttaatctagactcgaatatgttttacatcaaagggttgcctcaacagtgctcaaacctgcctctctgaaaacatgctgagcacgaaggttacttgaagtcttagcttgagtacttaagagagtgctatggagggattgttgatgagagctgtgtcacagctaatttttctttagtaattaaaggtttataaaaatcttacactgtatattgacaaatttagcaacaaaatgagcttgagaaaaaaatcaaggcctgccatggcatctttgcttttttttcttaaaaaaaaaactttttagaaagattatgcgactgtattatctgtaactactgcaatggtgtaaatcctgatggtataatttgctttttaaagctatctttacttcagtataacttagattaaatttattttaaatttaaatgatatttttctctttgtttattattttataatgtttcccatagaattcacaaaattcattagaaagatttttttttacttccttaggtcattaagattctgatttgtcaatggatttcacataaaccctgtctttccaaaaatatacaaaaaaaaaaaaaatagccaggcgtgatggtgcgtgcctatagtcccagctactcagaaggccgagttgggaggattgcttgaacccaggaagttatggctgcagtgagctatggtcacaccactgcactccagcctgggcaacaaagtgagaccccatctccaataaataaataaacaaataagtaaataattttcaccttgaaaagcttataaatgtatgaaatcacaatgagggtcgctgatatagtttggatgtgtgtccctgcccaaatttggttttgaattgtaatccccagtgttggagatggggcctggagggaggtgattggatcatgagggcagttttttcatgaatggctcagcaccatccccttggtgctgttgtggtgatagtaagttctcatgagatctggttgtatagcacctccccccttgctctcttgttcctgctttcaccatgtgacatgcctgctcccccttcaccttctgccataattttaagttgcctgaggcctcaccagaagccgaacagatgccggcaccatgctttctgcacagcttgcaaagccatgagccaattaaacctcttttttttttttttataaattacccagtctcaagtattctttatagcaaggcaagaatggacttacacagtctcttttgtatcagggagagggtcttcttggtgactccacttcttttctttgtttatgtatccttccagatgatgtatttatttcctttgtttttcaattgatatttactcttaaattaaactaattatttaaaaaagcattttaaagtctcattttagattattttgactatctgatttttaaaatggtttaaaaaatctatcttggcctccatatgcaatcaaataagaaacacattttaagcatattatttaccttgtggattctgccttcctcagtgtgttcagtctgtgtatattcatttctcccacactgtaagaagctagtcagatgtataattggattatcatgctacataatcttagcacactcattttaagcatacatagactagtgagcaccactcattacatgtcatttctctagagaaactagttgggccatggctgcaggactctcacttgaaaagacatgtgtggtgatgttttctcaggcagttaagcaataaagtgtaccctgatttgcactgaaaataaagattcctttaaagggagcagttctagttatctctctctttaggtaccatatgctgaacgtttttctatgcactaaaacagcaactaggttttatactctgccttacagcctacttcacacccatttcacagggagaggaacagagaggtaagtgatttgccccaaattacataactaggaagttatttgctcagtgtggaaacttgttcagaaggtcatttcattgaaatgtaggaagagtttctggcacttctcttgagcaggagtcaaaaacctttttttgcactagcccagatagtaaacattttaggctttgtgggccatatgatctctgtcaaaactcctctacttcgttgttgtagtgcaaaagcagctatacacaatcctgaaatgaatgggtgtggccgtgttccagtacaaccttacagaaaaggcaataggctggatttggctctgagactgtagtttgctgacctcagctcttgaactgagctctttaactgacctcagctcttgaactatggtacaagatcccatggtcctgtttggtacctccatttgccctccttttcactctctgggagcatagctaagttcaaaattgaattaggtacttgtagtaagagcatacttataatcctgggatcttcatgttgccagatattaacctcttgaagtttttcaccacaacctgggcacttttctgatttgctcacttctagccccacctttgggccccttcataagcaaacatgcaggttttccagagagctgtatgctactgaatgcagaaaatttggctcatactggcctatggactatctgctcactgccctgataactattttccaagggagtgggtgccctacctttcctacatgaagttttttgctagtcttgccctaaaaattctaggtatcccttgcttttaggataaatatgtttcactgggaccagctggaaaacgaaaaatagaattatccaactaccactttaaaattggacaaagacttttgttgttgttgttggagggggtggtaaacatcattttagcagaccaaatatacttttggtgaaaggcagcctgttgcaaagacacaacacttggacaagattttgaagccctggttgcctttactactgacttaactacagtatttgcggacttgagcaagttgcttcccttctgtgagcctcaggttattcatctttgaaatgagtataatacctgtgattataattacttatctggattctgcagagaattgaaggagataatgggtgtaaaagtactttagcgcccagcactgctccttatgaaaatgaggaaataattgagatgagtgagccattgaggcaacagtacaaaaagtgctgaaaactcactgcttaaataagcacctcttactgcttttgtggcactttgtagcaatgtttttttttttttttttgagacggagtcttgctgtcttgcccaggctggagttcagtggcacgatctcggctcactgcaacctccgcctcacaggttcaagcattctctgacttcagcctcctgaatagctggattagaggtgcgtgccaccacgcccagctaatttttgtatttttagtagagacggggtttcaccatgttgatcaggttggtctcgaactcctgacctcatgatctgcccgccttggcctcccaaaatgctaggattacagatgtgagccaccgcaccccacctcagcaatgtgtttttattctgactagaaaagtaatgtttggttttgtttggctctttgcttaatatacccataataagggtacctatttgcctttggaccattagttcaaatattattttattaatatggaattactgggctccagaagccatagtcttcttagctgctccctatccccactctcacctcaatttttttttttcacttttgtttttcttctcagggaaaggtttgaggcaaagaatgtcttcttatgatccaaaaccaagcatggtggtgatttattcaccaagagattcctaagtacctgtgtgatggacatggtagaatctttgtcctgagggagctatctagatccattccttctgatatgcagccagtagccacttgtggtaatggagcaatagaaacaacactagttcaagtggaaacgtgagatgagaagtaggaggtggagagaactaaccagaagagggtacccaaataaaccagaaatatgtatgtgttagagaaggggcctattgagcgggtggcagtggcatgtgtggcattacttgctcctgtattctctgctttttacttagttgtggctttggtggtatagtctcaaatctaagttacgtaggtaatattgttatgtatcatgttttggcaatgtagactaaatacttgctcataagagtacaggacaatgaggatagtttggttttgtttactgcatggaaaatgcaggatgtttagtaaatagattcatggcgtagtgagttcactactaaaatcagactctgagaatgggtttgatttaaatggctagtttagaagactgaatttaggccacttgattgagaaaggccattttgggtaattataaaccaccaacattgtgttttgaatgttaaagcttatatttgtcttccagttaccagaatgtaagcttcttgaggagggagagaggagttttcttaatctctgaacctgcacctttcttctgtgcctagcccagtgcctggcaccaaacaggtgctcaatcaatgttgattctatgctaccaacaaaaatgagtccatgatgtttactattcaacaaatgaatacaattttagagtaaatttttactgcttacactacatgtagattttctttttagagatttcgcaatgctgatttatttcaaaataagcttgaagctaagcgacaaagctgaatgatgatttgttttttatttatttttaaatccaaacttacaattttacatgtcattgccagaaaaatcattaaataaattatgatatgcgcatatggaatactttgcaaccattaaatcaaccattaaatactatgcaaccattaaatcaaccattaaatatgttggtatatgcaaatgtgcatataccaacatattatatagttgagtaagaaaagctagtttcaaatgagtatgttaatatcatctgactcttgcaaaaggaaaaccatacatttgaatgtacatatatgcatatgtttatatgtgcatagaaaaagctatgaggggatatacctcaagttgctaaaagtggctccacctggagagggacatggaaaggagttggctaaaaactgaggtttgttatggtatacacccctgcacagtttgattttttaaaaacaatgattataaattacttttattatttataaaaatattatttaaaattttggtactaaaaacagagctccatcaacaggtcaatggataaagaaaatgtggtacatatatacaaccgagtactattcgtcataaaaaaatgagaccctgtcatttttgcaacaaaatggatggaactggaaattattatattaagtgaaataaggcaggcacagaaaggcaaacattgcatgttctcatttaatctgtggaatctaaaaatcaaaacaattgaactaatggatatagaaagtagaaggatggtaaccaaaggctagaaaggatagttggtggggcaggggagggtgaggtgagcatgtttaatgggcacaaaaaaatagaaacaatgaataagacctattatgtgatagcacaataaggtgactatagttaataataatttaattgtacattttaaaataactaaagaggtataataggattgattgtaacacaaagaataaatgcttgagggatgtatacctcattctctataatgtgattagtacacattgcatgcttctatcaaaaattttcatataccccataaatatatacatccattgtgtactcacaaaattaaaaaaaactgtgcattaaagaaaaacaaaaataaaaaccatagttcaagttataaacaaaataaaggtaatttggaggaaaactgtcttcagttatattggatatttgggggacatttttgtatgttagttagcaaagatcacttgaaaaagaagattcttccttctatgattcaagggagcctagcaaaaaataaatgaaatgaaataaaataatacaaagagaaaagattattccataaattctgcttacttatttctggcaaacttgttgacagcacatgtgaccttttggtaaaaagacatttttatatttttagttaagtttcaaatataaattgtttgtgtttttaaaataaattaaatggatgatttcagccagatcattatgaaaacacatgagatattgggttatgcaatgactaacagtgtgtaccttttcttgatatttattcataaactggggaataaaagtacattttggcccatttactccttaaataattttatgtctcccaaggagagttgtaagttgcttgatagtaaatgctatgtattttgtaccttagtgtatatattatgggatttcagcgttagaagagctcttaaatgccgtgttcatagtccaacctgtcttctgatgcttgaaatccccttgcagtaggaaatgcaaagtagagagcagacactcaataatgtagttagtgaattatttagaaagaggcattttgagcccataatgtatgataggtacttctacatttattattttattctttgcagacctgcagaaaactgtaagaaaaaagtttatttcagattcatgtgtttatttgattaatctcttcataggtttcatttttcagctcctgtcagaaaatacagattcttataaggttcaccttttacccataagaataatagtataaaggggataatgtgaaatacaatcacttcacagactgtttcaattaaataagagctcgtagataattcagtccaccacaccccattttacagatgttgaaattgaagcccccaccaaaaggaaaagacttgttcaaagtcacacagcaagtcagtggtgaacctaattaggccccctgccttccattttagtgagattcctgtgctgatagtcatacccatatcaaatcctctttggcagttatagcttgcccacagtaatgtgtcctgaaaaatatgacaattaattaagttggagacagaaccataacctctttataaaaattttctggaaagtttacatgacagtaagtaatatataattagaaaggataattcttatttcatatttatctttttgtttcagaataataaactaagctatctctactcagtccattttaatacaaaaatatttttacccggactgagtttttatgctttttaggaactttgtatctgcctcacttagttaaaatcctagctgcactaatcacttactgtggtgggcagaattctagaatgaccctgaataccttgtccttgtatgattccttcctctttaagtaaggataaaaactgtgaatatgatatcactcccttgattaggctttgttatatggcacagttaactttaagaaaggaccaatcacacaagccatttgaaagcagagggtttgggtattttttaactggtggcagaaagccacgcagagatttgaacattgaggggaatttgaatttgatgtgccagtactaacttgaagatagaggaggctgcatggaaagtggcctttaggagtgatccctggctgacagccagtaagaaaatgagggcctcagacctacagccataaagaattctgtcagtgaacttgaacttggaagtggattcttcctctagaacttccatataagagtccagcctgattgacaccttgattttggacttgtgagaccctgagcagagaatccagttgacttctgacctaaaaaaaaagtcagataataaatgagtattgttttaaactgctaattttgtgataatttgttatgcagcaataaaaaactaatatatttaccatgcaaggcaaggcatttatcctctcatgattcagtttctttttacctgacataatggaattaatttatactgctgtgaagttgtagttgagaaacatgacttctaaagtaatagaggacatgtattattaattttagtagtattaatagtaatgatactgattctcccaggcctatacaaatcctttgatacacaaatgaatagtaaaggaacataaattgtctctaggtagactttcccacaatgcaattttaggatacagaggtcatatgcctgttattctactgtggcagagaaaatatggagcctggaaaactgttcatttgcatcacatacatcttgggagctcactctgaacctggtaccataataagctctgtagacagtataaagaggaaaggaatcagacatggtgtctgacctcaagtgtctcataacgtagtagaagaggtaaaatatgggtcacactaactctactgcaaagtaggaagtgcttgtcgccttgagattgacaaaatttggtaagagttcagaggagattgtctgtgaactgggccttgaagaatagttaggatttgaataggagaaggtgaagaaggaaggcattccagctagggagaagagcacaaacaaaagcatagataaccttgaacatcatcatatgggataattcaatagttcagtataatggaagtataagatgcataaaaataagtgtagtaggaaacaagtttaaaagtatagattggggttagtcatacaaggccttgaatttcaggctaaggagtttagacattaacatttgtttttgaacaaaggggtgaactgatcacatctgtgatttagaaagaaaattctagcaatagtgtagataagggttgatggtaaagtttggaaggtggtgaggcagaggctggagacagggagcacatttaggatagaaagatgataaagagatgatttagaagagttgttttggaaaaggagaagacagaaaatgttttagaggtgtcatagagataaaattggcatggcatggtgcaaggaggtaaagcccaatagctttgtaaggtgctgagatagattgaaatcacagagttaggaagttttagagtcaggattagtaccaagacagcttggctctagatctcatacttaacacttacagtataattctgagagggtgggtaacagcaatagtcagaggaaagaacccttttatacatgatggtacaggaacaacactggcttccaaccccacagctgctctttaacagaaggtcagaagctggggagaaatatgtgtgtgtgtgtgtgtgtgtgtgtgtgtgtgtgtgtgtgtgtgtgtatgtgccatttctgggactaaggatgggaagtagattagttgaggccactgcagtggggtctgcaagttgctagcactcacccgttccaagaggccttaaaggtgttgatctgttccctgggcatcaccacattccacaaattaatgttcctctgagagaatagggtgattcaatttcactgtgcccgaaggttacttttggggttcatgtttgttctaagtctatgctaatgatctgccaactgtctgtttgtcactttctctaacccttagcatgtataaactgatctgttgggaaatgtgtagcatttataggatggtaggatttgtaacatgcgatcacaggactgtttatatagagtccctgggaaggggagagaagagtatttctgttacaaatgtggattctttggcccctcctcaaacttactgaggttcaagaattgacatttataataagcacatatccattttcaataaacatgaaagtttcataccctcttttaatgtttgaaatcctcaaataaattagtcattggtgccagagtatcaaataattatggtacagaatgtatttctctgaatgacaccttctcccagagattctgatatatattcctctgcactcaccctgtttgataattaccagtatatggaccatttacctgaagaataagagtagggtttcctactgttgttgaaaatttgcttgactcttaacaacttgtgtgtgactgtaacaagatcacacagggtaaacaatattagcttattcaaccactggctgaagaaatttaggaaagtgaacacatttttctttacatttctctttgttctgtgagccttttatgctggaatagttttcactgcaggctgttattgtctgcctccagaggagggagttgacctagcagtggtaactggagagtgttttttgaaacctctttccaaggttagttgccaatggcatctttggaacagtgtccttcacttttgtccctcagggaccagtgtgagaatgggaactttatgatctggagctggttaagtgaagtccaaaaataattaagaaagtgtttccttccctgggaatgagttcagtaggaatctcaatgtattgtagagcactaaggactcagcctcaggcatttgcaaaggattcttccagttgcctgtgttacagaggacacagttggcatttccttttggtgttgaggggagatgtgtacatggttgtgagatgactcaccctttttgcttagatagttccactttcattgtggacagactctttggagggccagtttggcatgcacgtgtgtgttcattccatcctggagcattctttatgagaaagccatttgttgagtggtttgccattttgttttacagccactctgtgggctatgaaatggtcatccggccgctttatttgtccctaaaaaaagcagtttttccctttcttatcttcatggctgccaagcagcagaaagagtaactcagggaagccatgtgatagccttttatctgtctgttcagaaactgatgatgtattggatttgataattcatcaaatctgaggtttactggtttgtatttgcctcaaaatgggcatataatattttgtcaggtaacataatagacagatcattggcattgctttattgaagtgaattaattcaataagcctgtaagtgcctgacatgtgccaggcactgtgctaggcattctgttaacagatgagacaaatctctgtcttttaggtgttttcagtcgaacaggggagacaaatatatgagcaaattgctattttttttaaatttcatagtgtacatgagtataaggtgctgaatatgtgattgattctgagggaaaagagagataagggaaagttctcagagaaagtcaagctgagggaagaaaagcaccccagacagagggactagcatagagctatgctagtacattgagtttaagggaatggcacatacttcactgttgcttcagcagacagcaggcctgttaggttacaaagggccttggatgacatgctgaggggttttaaaattttatttaaattttaattgacaaaatataattgtatatttctgtgaggtacaatgtgacgttatgatatatgtatgcaatgtagaatgattaaatcaagctaatttgtatatctaccacctcacatacttattttttggttagaacatttaaaatttattctcttaacaactttgaaatagacaacacattattatcaactgtagtcaccatgttgtgcagatctcaaaaacttctaacaaaaactttttaccctttgaagatattgaactgttttatgaacacaatcttagaaggatttaaaaaataatttgctattcaccaagtacttcttacgtacactgtgcatgaaatgattattactttttctaatattagttttcttgattgaggcttggcaattattagtttgtatgcctttagaaggatcataagcagaggtttatcccagtaggatttgcattttagaatgatgactttgggagtaaaatacagagaagtgaaaccagagatagtgggatcattctggagtctgttgcctacactgaacagtagttgagcgaaaaaggatgggcagaatgtgttggttctgggtattgcaaattcatggcacttgagtgaaaaagtttaagccttctattggctctttgtgaatatcttcaacatgcatgactacaaatagaacacatggttttgttgttattgttgttgtgtttttgtttttttttttatttgagatggagttttgctcttcttgcccagactggagtgcaatggcacgaatttggctcaccacaacctccgcctcccaggttcaagcgattctcctgcctcagcctcctgagtagctgggattagaatcatgcgccaccacacccggctaattttgtatttttagtagaaacagggtttctccatgttggtcaggctgtcttgaactcccgacctcagatgatcctcccacctcggcctcccaaagtactgagattacgggcatgagccaccgcgcccggcccacacggtatttttgaaagaacagtgagcttggattagaacactagtgtccaggccctgctgctactacataagtaattatgaatccatagccatcttgttgctcttcttctctgagccttggtttctttagctataaaatgggaagttgaaactttctagctacttctttgagttatgagtaacaagttaggtaatacacttaaaagagaatgtgctatacaaatactggttcttaagacagctgttgttaatgtactgagtattatgcttacctcacagggttattgtgagcatcaaatgggataatggatttgtaagcattttgtttaaagtgtgattcaaatgttaagaattagtaaaaatagtaaaagaacaattcattctccatccagatgttctgtccccactgtgacttatgtgctcattcagagttgtacagaaaaacctccacttaattttcacaagctggagttccacatgtaacagaatcatatgggaccaaaaaattctctgtattggcttcttccctgccgtattttggctctgggaccaacaagacacccattttgcatgagctgcctgccaccaactttgcgctcacatctagttctgttgcccatgtgcaagctgaatttgggcccgggcccccagatctaacatgaaactcaagtttccttctgttcaaactgtccaggcataatagtcttaaagtccgatgcccagcagagccgtagatttttcactggccaaaaatcaacatgaaaccagatgtatctgtaaatctagtttcataacactttgtagtcaatggaaatacagtagcaggcagaccagaccagagtttactatttgcagtggaattaataaccacatggaaactttgcctttggtatctgcgagatggaagataaaggtgcgaattcaaagcagttcccaccttaccctctaaattccaacataaagaggccttgaatgtccttctatcttattgtatatttcattaacagaagtatgttcctagctacttagtcattctatctctattctcctttgttttaacttcagtggtgccagcttaagatgctctggctttcagctttcatggagcacgtcatgtttttaaacttatctttagggacagaaatgttaggaagatcctagttcctcatctctttgctcctgacaaggaaatttagaattgcctaaagaaaggatgtattggccaacctaataataaatcagtattagtgaatctaaagcatatttgaaaaatttgtaacatgagttgaaattcagacctgcaatgaagtgtttttaaaagatttaaaatcgaaataatataaaagaatgttaaaaacaagtaaaacatatcactagttaatcactctaccaaaattcatttttatgtttgcatatttaaccatttttattttctatatttgtccatgaacatgtgtttttatatattgtttatattaaacatggttttaatcatggcttatttcttttatgttttacttcttttcctttgacataaaatattgtattttttaaattttaattgcttcttggcatacccttccaatattggtggctatatagattgaagttaaaactaattacaatcagagaaaattaacaattcatcccttcaatctcattagtcacaagttaaatactcaatagccacatctatctagttgctactgttttgaatagtacagatataagacattttcatcaacacagaaaattcacttggaaagcattgccctggagtaaatgtgccagactgtactatatcatttttctcttgttggacatctaagttatttcttattttttaaatattttatataacttgacggtgaatatacctatgtacatagctatttgctttggctgaattatttcttagaatcaatttcaaaagtggagttattaggtcaaagagcatgagaagattttttggaacctgcagtgtattgccatagtcctctcaaaaaagtttatgtcaacttaaagtacttctagcagcatatgattgtactaatttcgctgcaatctcaacaacactggacattataagtttttattctaccctattttccattaaaagatagcttatgcttgattgactttgcattttattttattattaataatgatgtggtttccttttttctagattttatttttatttaaggcatcctttgattttaacctgattttttttctctaaaaattattctaagaaaagacaaaggtgatacgaaatatatcctgagtttttatttttttcttgcatgggatttgtatatttgcacctttgcccatttatactatgatttcttagtgtcttccctggcaattttaatgaagacttcatgtatatcaatttttccacaaatataatctttctaaaaatatgttttttccacaatataattcagacgtattctccgaaatgttggaaaaacttaagtaggcatcaaagcatttgaagatttgtttaaaggttgtttttataccagttttaaattgtaatttaagggtcataaaataggtgaaaattaaatcatttttcagtaagggggcaagaccacttaactcttggaaaatacaggaaacgtagatttctagaggccaagaaggaggtagggattattttgtaactgcccccaaccttctaacctgtaatgaaacaaacactgaaggcccttaaacatttttaggcttaattggctgtccttgtacttagggcacatctaaaaatcctgaggcaaccactcaagagaacatgcttttgttaattcaaagggagctgtcctacgagtgtccagaatcctctgtagtcttgggcctggtgcttgagagacccaaaggaaaggtcaatggaattacagcttagtgttagagctttcatgcatcacactaattaattaatgtcataaaggtctctctcctgttatgggaaaaagcagcaaataggaacttctggtagggtgcttaaagttggtttgatattttttattagcatttttaactaatacaagtaatacatgcttatggtagaatgataaaactgaaaaaaaaggtatgaaaatttagaagttctcctactcatgacctcaccccttctttcactcccagtttcactcctcagagggtaaccacagtgactagcttcttgtgtttggttcctgagattttctatgtatatatattgttagatatatgcatggtatgttttcaaaattcctgttacactataattactgttctacaacttaattttttcacttaattaatagaccttatatatgcttttccatatcggtatatatagatctatataagttttcttaaaggttgcacaactttcaattgtatggctgtcttgtaatttactttttgtttcccttactaatggatatttcatgtttccctaactcttttgatattaagagtagtgctgcaattaacatccttgagaggcagtatatatggtgtttaagatgaatggttctggagccagactactttggattgaatattggtgccaccaattccttgctgtatgaccttaggcaagttgcttaatttctttgcctcagtgtccttgtgtgaaaaaatggaggcaataatggtcactatccagtagggcttttatgaggatttagtaagttaataatgcactttaagaacttagttatttttagattaagtagtgaaggactatataattgttagtataattgtatacctttattatcatacttttgcatgtatagcaataagacaaattcttagatgtttaaccattggacataaggaatgtacgcattttaagtactggtagatattaccttttccctgccaaaaattgcaaatattggatattaactttttaaatcttagtaaatctgataagtataaataacagtttatcatcattttaagttgcctatcttaattttgtgtgaaaatgattatcttttcacatgtttttttggccatttatgtttctttccatgtgaactaactgttcctggccattgcctatttgttgttgctgttactatatggcttttcatctgtttcttattggtttatggagctctttgtatatacaggaatttagcctctatttatatgtgtgacaaatactttttccaatttatctttaaaatttgtttatgttttcctattcatcagtctaaaattatgtagttaaattcatcattgttttttcttatgactttagagtttggagatcatgcttcaaaggtctttctaggtggggatgatttaaatcatgtactggaagtatttttgccaaaaagactcacgaattatggatgttagagctaaaagggaccttagagatttcctagttcaaccaccttttcttcatacctttttaatttttctctgcagatgaaaagaagtttagtcctaaagaaagaaaagagtctaaaggttctccagtaagctaatggcaaaaatgtagactggaacttctagctcctgatgtgtatttcagtgatcattcaatttaaccagatggtttcacaaaaagagctttctactaaaaaataaaatacatacttaagcaactcagagaattttttttttatttttcagattaattttcacttagagattcatcagcatatgtactatacatgtacaaatcacctgtgtgttttggatatttagttaaacaaatgtgcaaatattttaaccaaaggagcatattcatttgtgttttattttcttaatggttttcgttatgaatgtgaaatgtgtatttaccttaacagaaattaagtatatttttggtctgacatatatgagaactgaaaagcattggcttggctgctaactgcattctcatctttctttctctgctttggcaaagtctgggattaaatctaataccttttaaactgtttgggacttcagccagagtgacctgtcttgaattcagaactgcgcagatcattccccattctaaggccctctcatgcctcctcattgcctgtaggatgagatccaagtaccttagcatagcttatgcactgtagtcacttgacctctagcacctatgcagtcttccagtcttatttacacattcctttgcacatgctgtttccccgtgtggggcaacttttttcttgcctgtctgcctgcctaagccaacttaaataaacatcatttctgtaacttctgtgaagccttttccaatctctccactccaagacgaaggtgtttctataggcatgacttctggaatggcagatcaaggatctggtggaccctctactcagtgaaacaaccgtttaactagtaaaaatgatcaatcaaccatttaaaatcttcagaaaatatcctaagggcacatagcaaaaagagaaacatttattcaagaaaagctattaagcctcagtaaaaacagcaagagtctatggcatttgagtcatgacctgttcctaatccttcccttatctccattcttcaggcaagtgcaaccaagaagatggaggcttcctctctctcaaaatcttactccatagttataatttcacccacaatggggcagaccacaagcatctcttttttttcccccagccctatattacagaatcactgttctaggaaggcatagcttagaggattggagattccttccacacccactttctacgtatgagggctttgccccagggatggtaagtcaagaatacagggatcctgcttgtgcctgcctcagctcatatataaggtaaagcttccacactaggaaaggcaaattaagaggactagggaatataccgttatccccagggtccacttgtagaacaggggtgtcattctgggagaagcaggtcactgccccacttgtggaacaggggagtcactcgtcactgtccctggttcaaattctattgcagtgacagaggttctgtcccagggaaaggcaggttgttaggatggagaactccacagttctccctgaggtgactgactttatttggaacagagcatgaagaagttcatgcctaagggcactgtcaaaaataatggagatcttggtggtgagcaattaagagtggattggtagctccatgatactagtaacaacaagcaaaacagcagaccagcatggaggataccagagaaccagacaaaggaatcactaagaagagcccttgtggaattgcactcactgctgggtgtgtggaaagttatgcatgtgtgctttactgtaccctctcaaaagcaacctaaacaggatgtggggtaggctctaaagcattcctcaagccacacatggatccatcagtaaaatgtggagggcttaaggataaaaaggcttaagtacaatctctggccctacattttctaaatgttatgccaccctgaccaaggggcaactcctacaaagccaggcaaaataataaaatcatatttgtctctagtggaatggataactatgcctaaaactgtgccctttgaaaagcaactagagagataatttctgaagtgtttgtccctacctgaatgtgtggcaaaattctaaactccctgaagtgtgaaagtggtttccaagccacatgcacatccagtagtggtaaagggtgaaaatctaactggctaagagggcttcatagcaacattaaccaaaaagtggtttatgtagtctttgcctgcttcataattccctaggcattctatgctattctgtactcagaaggcttaaagtcaggttagggaaaggaggcctatgaggttactgtgcagaggcagtgctgggaaataaatgaagttaaataaatttaggccatcgtggtttaaagaatggattgtggagataagaaggataaaggaaacccagagtcaagaaaaataaaacttttcattggtgccatgccaacccatatccgagcctgaggcaaaaggaaaaatgtgctccctgatatacacttatacaaaatatcaactaattttatttgttggactgaatagaaaaagtcaacaaaaattaaaaataaaaaaatcatgactatatttttaataagtggtttatgtaaacccagagttgaccaatgggatgccagtctcaaccataaaaacaaacaaaacattgtgagtaacaacaccagaagtctcaaagtgtcagggaaaccaatttcacagaagcagttcagccaagtcactaaacaaacaaacgactaagcaaaaaacaagaatgagtctcagaaagggtcaagtcagtatccagagttgttacaatatagtatctaaaatattgttttgaactaaaaattttgaggcatgcaaagaatgaggaaagtatgactcatacatggtattatatgaaaaaatcaacaaaaaactatccatgaggaaacaaagatgttgaaattcactagggaaagactttaaaaaccagctatttaaatatattcaaagaactgaaggaactatgtctaaaatactaaaataaagtataataacaatttcttgtcaagtagagaatgccaataaagagatagaagttataaaaaaagaaaaaaatggaaaatctggagttgaaaattataataactgaaatgaaaaattcactagaaaaggtcacaagaagatataacttggcagaagaaacaatcagcaaattagaacatagatcaatatagattattcattttgaagggtagaaagaaaaaaagaatgaagaaaactgaagattcccaaagaaatgtaggacatcttaaagacacatcattaggagaagaaaagaagggaaagaaaagagcagaaagaatattttttaaaaaatggataaaatcttccaaaatttaatgaaaaacatcaacctacacatcaaagaaaatttttttaaaacttcaagcaggaaaatgtaacgatattgatacttagatacatcatagtcaaaatattggagtcaaatataaagagaaaattttgaaattagcaagagaaaaatgaaatggaaccacaataagattaacagctgattctcatcagaaataacagagagcagaaggcagtgcaatcccatattctaaacgttgaaagaataaaaaaactgtcagtcaagaatcatatattcaacaaaactatctttaaaggtaaaaatgaaatgaagacattcctaggtaaacaaaggctgagagaatttttcattagctgacatgccttgcaagaaatactaaaagcttcctagacagtagctttaatctgcatgaaaaaaaattccaataaagggaaatttgtaaataataaaaatacatcattatatattcttttccacttaacttatttaaaatcaatttcttaaagcactatctgtaaaattgtattgttatttgacaataaaatgtaaaagaggggagtgggaattaagctaaattggagtaaggaaatggtatcacatggtaaattgaatttacagaaagaaatgaaaaaattaagtggcaaatatgaagagtaacattaaaaacttctataaattaattgtggcctcctttcttcccttagcttctgtaaaagacataagactattaaaaatgacaataattataaacacattgttttattagtaataaacatagacaaattatctacaacaattattattatacaaggagagggaatggagctgtagaggagtaaagtttttataacctactggaactaagtcagtataaatatgatgtcgattctgttaatttgagatatatgttagaagccccaaagtaatcactgagaaaatgatgcaaaaatacagttttaaaaagttaaaaacatagtttagcttatgtgtgcctagtactccattattatttttttattatattttaagttctggggtacatgtgcagaatgtgcaggtttgttacataggcatacatgtgccatggtggtttgctgcacccatcaatccgtcatatacattaggtatttctcctaatactatccctccccctgtcccctaaccccctcaacaggccctggtgtgtgatgttcccctccctgtgtccatgtgttctcattgttcaactcccacttatgagtgagaacatgcggtgtttcgttttctgttcttgtgttagtttgctgagaatgatggtttccagcttcatccatgtccttgcagaggacatgaactcatcctttttatggctgcatagtagtccatcgtgtatatgtgccacattttctttctgcttgttcccaggagaaagtggctgaagattccagagagaagctgaatgcagtttaattctttttgccataaacacgacaacccattttcctgcaagctgtgttagtttgctctcttcttggttcattcattcatttattcatagcttccataaatatttaacaaacactaattaggggccaagccatgtgctaggcacaggggataaaactgtgaacaaaacaagccccagctactcttaaggaactgatagacaaatggaccagcaaacacgctggtcctgttttgaaggcaaagcgcctggtgctcctgatctcatgagcacagagcatttagcctaagtctcatcctcctaaggcctcagaaataaggccttattttaataagtgcaagtcagtcatttgaagactaaatcatagaatcctagaaaactagtaccgggagcaaggcaaaagaatgggatgagcatgaaacatatattcagaagttgtggtgtgtaggtatataagccaagctcttttcttcacttgcttgctaagtcacttagcttttctgcctttttgtttgctctgtctggaaatggagttaatgaaatatatctacatgatagggatattgagacgattaaataagatgctgctgtcacccagtatgcccttaccctgctgtacttagaagtatatgaaattcattttctaaatttttgtatgagtgtttcatgcatgcccaccaccatggaagctaccttaagacagtgagggactttgtttaacttgtttgtactacatcctcagtctaatggtgtctggcttatggtaggcaccaaatataattttattgacagaaaggatgataatgaatgtgaaggcatttttaagtttatgaagtgttgtgcatattgttgttaattttaagctgttacgttaaagaacccctaatccaactctcttgagttttatagatatcatagaagatatatcttcccttgacatagaagcttcccttgaaggttcccttgactcatgtatttgcctcacagtgattgtgcagatcccacaagataaatttatgtgaatgtgctttatgtgcttgaagtgctccacaaatatgggttttataagatgagaaaatagagtcagggagaaaggtgactgatccaaggtcatgcaaagagttagtgtcagaatttataatggaatttcaggctcccaactcccactccagtatactaaggcagattccagagaagaaacagtggagagcaggcactgatgagggacaaagaaaagcaggctccgtctggctgcaacttgtctcttcatggcaaaaagaaactaggaaagtgctatgccagagacgacatgataactttgcagaatggaaagagcttgtttaccacattgaatactttatctgtgtttatctaacgacagttccaccagctctttaccacttgacttttgcctaattcaaaaatataccaactatgaaacattttccttctcagtttttattctagattacattttgttcaactttatcttaatgtgtagtgtagaaagagtaaggtaagagtatagcaagtggttattttccatttctactgaggacagagaaataatctaagggatttgtattagagatgaagaagtgcatggccaggacatgagagatactgtgatagaatggatattgtgaagtctttggtagtttttgaggggaaaaaagagaaggttttctttgtctgatatagtttagcaacgtcttaatttaggattcaaaagttgttcagggtccatcttggccttcaaattaagatgccctttgagagataacattgttgttttcaaactctgttctgtgacttaagaatgagaggagaaggaagaaaagaggagaaaatttgagggaaaagtgcccaagcagcgtcaaggctagacactggaaatttatcaatgaaagccacatggtggatgggaatcagatatgtgcatcaattatttgtgttccaatccatatagaagtaccgtataatgcaccaagctaataggtgctttgaaagaagaccatacaagtggagatgtgttcctattctatctagggatagagtcaggaagggcttcattgaataagtggtagcctcttgggctgagacctgagttatgagatgatgtggcaaaggagacagatggctgggggcaaggtggggtcattgaaattggaggcagtagcaatataagcaaagctacaggggcatgaaaaagcaaggttagattagtgaattgcaacagggtggtactgctggaaggtcacatggaaaagattgtgaaggtattgagataagaagctagaaataagctttgaatgccatcctagtactttgaatttgcatgctgtaagccaagtggttttcacttggtcatttaataaaattacagattctcaggtctcacctgtaacttcagattcagaagagtctgctaactgaaggtggaatcagtgttccatattgctaattagctcctcagaggattctaatatatcagtgagttatgaccactgctgtaagccataggtagttattgaaagctgctatggagaggagccacagaagcagatgttttagataggattcctctggggtcctgtgtaatttatggactggagaggatcagacaggaagcagaaagacttgaataagacagttgcagttattttggaggcaaagattctctctctctctctctgtgtgtgtgtgtgtgtgtgtaattgtaggaactatttaggcagtaaaattaacagatattagtcactgattgactgagtggatggcagtgataggtggggtgcgttgagggaagtgtattacattaagtccaggatgactcatggttttctaagttgagtcattggggattgccatccaatgtgagaaactatatagtcttatcatagttgatcttggaggtagacttgaattaaaatcttgaagccatcaattgctgtatgtgggtcttgggcagaacacttaaggtttctggacctcagttatttcttctgtaaaatgaggaaaataatgcatacctcatgcatttgttgtaaagactaaatgaggttaaagtatgtagagtgtagtttagtaactgggacgtatagtggtccagtaaacatcagctgttattattgtgctatatgttgtgatgtgtactggagtgagatggggtaggggattttttagtctctgccaatgactcctctccccatgatcaaaatcagaaaatcagtctcttatgtgttgaggagtgagacacttctcccaagtgtttaaggctaataccttgccttgttttgccttgggccagacctcactacacatctgtttaagagatcagggtaagctctgttcttggtgagtatctcaatggggctgtttttctagttcttgtagtttctttgggccaacatgaaatgtctaaccttggcttcttggttgtggattctcgtcaacatttcactgctacccaagttgtgtctgcttacatgatgctatcttccttcttttgggtttctgaagccctcagacacttggctgaacatttttcacatttcttaagctatatcatctgtgttttccctgccacagacaaagtcacaaaaggactttaagataggttttggttttttttttccccagggtttttatacattttgggtaagggcaagtggtaaatgctgcttttctgccttaaccagtagtgtctgacagaggaggtagcatgatgattgcagagctcactggactgaaagtcagatgctttacccgcctagactctagtaccaaggggaagatggagtgagatggggtaaatggggagaaattaccatttattttgagtgtgccaggccttttctcatgtattgtctaatgcatttgtcacaattctctttgggtttgaaatgtgattttcttcattttatagataaggaaacttatgggaagggaggttaggttcatcttgtgcccaactttacatggctagtgatcaataatagtgagattcaaactcagatttctctgccccaaagcctttgctttttcctcttttgacactgtaactaatgagaagatgtatttaactctgagtctcatttgcctcaactgtaaaatggagctctgtaactcttgctctgtatgacagtaaatctcctcagaccagacttatgataggggataaggatatttgtatctttgggcccctaatgtattgaaagtgcttctaagtgcctggcacatagaagggcactcaataaatatttaccacattttccagaaagagggtagctccataatgggtgagatacattttggtggctactgtagtgtttaatgcttttaccatctgttaaaatgattttggagtatagctagataactgatgatggttgttatatagattttttcataggttgcctgttccaaattctatgccgtggaagaagttaaatatccagaatttgacaggaaatattattctacaacagatccctggcgtaagaatgataacacctgtgttctagtctcagacttgcctctgaataactgtttctcctggtcaattctctgtctctatctaggcttgaaatttcccccaaatgatgaaggagttggactagtttagtggggttcagcctcgagtggccattaaaattatttggggatctttgaaaaaaattagatgcccagatttttgtcgttgttgttgttgtttttgtttgtttgttttttaattatactttaagttctgggatacatgtgcagaacatgcaggtttgttacataggtatacacgtgccatggtggtttgctgcacccatcaacccgtcatctacattaggtatttctcctaatgctatccctccctagtcccctaaccccagacaggccctggtgtgtgatgttcccctccctgtgtctatgtgctctcattgttcagctcccccttatgagtgagaacgtgcagtgtttggttttctgttcctgtgttagtttgctgagaatgatggtttccagtttcatccatgttctttcaaaggacatgaacccatccttttttatggtggcctgatattccatggtgtattgaactgctcactccagttcaattaaatcagaatacagaatgttgagaggagcatcagtattttaagaaggccccctagtgaagttcaatgtgcagccaagggtgagaaacactggactagatgattgataagggccatccaactttgatagtcaacaagagacaatgctatagagtatggtggacagagcatgggctttagagttagccaggtatgcattcagaccctggctctgttacttactagttgtgtgatcttgaagaaatcaaaatggagatacactatgtacctggcagtaatagttgtggggattaagcaccttcaccagagcttaggacataataagcccccagtaaatagcttctttaatatcagaagttcagatggaagatgtgagaaaaatattggttcagtaagatttaacaggtaaattaaaatcaagtatttgaaaacattttcctgtttctttagcaatggattccagaaacataatgtggaaatagctctcagtccttagatttgatgacattgcagaaagaaatctggctagtcgtcccatggctgattggctatgatggctagaaagccattggaaaaaaaaaattggctcacagaagacagcagatgtggcttgggaaatgcaaggacatgactgtaataaggatttgtctatccagccccatttatgagagtgattccaggagaaaaggacagatttgtattgtcagtgggatacgctgttaaaaaacacttttgctactaccactccagctgtcttggcatgtttgttggtgatgtaagctacagaaaatggaaatcaccaatagggctatagcaacctgatgcatagtgacaagtaattgttctattcatggttatgtgttgtacagagcacttgctgcatgtcaggtttgagacttgagtatgcattagggccatggacacccccatcttatctttaagtagatttcaaagtaaatatttgatgaatatgtaaaatatttagtttggtcagtcatagggctgagaacatggtggcagttacctcctagtatctgcaagcaaaaaaagttttttcttcctatagcaattgccatctcagccacttttgcagcatttctttttgctacactttgcattaaccatttgtgcacttgtcttagcctcaaacaggccatgaaagctccttgaggataggggctatgtctttttcatctttatatatgcatcatttagcagagctgtccctttataatgtactaattactgaatgaagggatgcatagatgaataaatgaatgaaaagtaggagtgacctgtcttctctctttcttcacgatggggactagtgtgtgtatataaggggataatttttgtgtcacataaaatataaccttacttagaaggcaagacttccagaatggtggaatgagaaccacccccccgcccccataaatccgccctttcatgaaagcagtgaaaacgctagcaaacgttgtgaaaattaacttttccagaactctggaaaggaaacagaggcttccaacaatctgagaagaatgtattcaagaaaaacttcggtaagctctctgatcacagtggaaataataaacaattagtaatagaaggatagttgggaaattcaccatttgtgggatataaacagtggatcaaagaagaaatcataagggaaatgagaaaatactttgagattaatgaaaatgaaaatacattgttccaaaacttacaggatacagccaagctaaagcagtacttaaagggaaatttgtaactgcgaaggcctatatcaacaaagacaaatgatctcaaatcaagaacctaaccttccaccttagactaggaaaggaacagcaaactacaaagaaagcaggaagaaagactaataaagactaaaagggaaataaatgaaataatagagtagaaaaacactagaatcaatgaaattaaacattgattctttgaagagatcaacaaaactgaaaaaaactttagtcagattgaataagaaaaaaagagagaaaattcaaattatcaaaatgagcaatgaaaatggggccatcactacctaccttaaaaagaattttcaaaggattaaaagaaaatgccattgcattagttcattctcacacaactataaaaaagctacctgagatggggtagtttatgaagaaaagcgctttaattgactcacagttccacagtctgtacagcaggcatggatcatgaggccttaggaaatttacatcaggtgaaaggctaaggggcatggaagacatgtcttcacacggcagcaggagagagagcaaagagggaagtgccacacacttttaaaccatcagctctcatgacaactcactcactatcatgagaacagcaaggggaaaatctgccctcatgatccaattacttcctaccaggtcccttccccaacactggaaattacaattcaacgtgcgatttggatggtgtgacacagagcaaaaccatatcaaccatactgtatgccaaaaaattagatgacctagatgaaatggacaaatactcagaaaaacacaaactatctaaagtgaccagtgaagaaacagaaaatctgagtagtcctgtaacaagtcctgtaacaaaactggattagtaattaagaaacttcccacaaagaaaagcccaggttcagtcttcactggtgaatactatcaaatatttaaggaagatttaatccttcacaaattatttcaaaacttggaagaggctggaaccctttccaactaattctgcaaagtcagcattaccctgatgccaaaaccaaagatatgacacaaaaataaaactgcaggctaatatcacatttgaatatagataactttctaaaaatctcaacaaaatgctagcaaacagaattcagcaacaaataaaaagggttataaagggtgaccaagtaggatttatctctggaatgtaaattaacattcaaaaacctaagaataggaggaaactttcttaactttgtaatggacatctctgaaaaacacacagctaacatcatactaaatagggaaagattgaaatttttccttgtaagatcaggaacaagacaaggatgactgttctcaccatttcaatttaccattgtattgtagattcaagtcaaggcaattaggcaaaaaaaaaaaaaaaaaaaaaaaaaaaaaagaaagaggtaaaaggcacccatattggaaaggaagaggtgaaaatatctatattcacagatgacatgatcttatacaaagaaaaccttaaggaatccatgataaactattaaaacgagtaaacgagttcagcaaggtttcagaatacaagattaatgtgcaaaaatcaattgtatttctgtacactagcaatgagcaatctgaaaatgagattaagaaaacagttcactcacaatataatcaaaataccagaatacttaaaaataaatttaacaaaagaagcgtaagacttgtatgctgcaaaccacaaaacactgtggaaagtaattaaaaatctaaataaatagaaaaacatcccttgttcatgtactagaggactcaatattgtcaagatggaaatactccccaaagattgaaggaaatccctatcaaaatactggctgttttcttagcagaaaatgaaaatctgaccctaaaattaatatttaaatacatggaacctaggataaccaaaataatattgagaaagaaaaacaaagtcggcgtacccatgcttcctgattccaaaccttattacaaagcagtggtaatcaagagtgtatggtattggcataaggacaaacagatcaataaatggaatactattgagaatccaaaagttaactcttacatttaagaccaattgactttcaaaagtgttgctaagacatttcaatgaggaaagaatagtcttttcaataaattgtactggaaaaattggatatccacatgaaaataaaagattttggaccacttcaaacctgcaaaaaaaataaaatgatctcatggtgtatcatggatctaaatgctatagagctaagatgataaatctcagaagaaaatatcaaagtaaatctttatgaccttgaagtaggcaatggttttttggctataacaccaaaagcacaagcaataagagaaaaaaaatttttttaaaaaaacccttgattattttattaaaattttgttgtgggtacaaagtaggtgtgtatatttatggggtatatgagatattttgatacaggcatacaatgttcaatgatcatattaggataaatgaagtatccagtacctcaagcatttatcatttgtgttacaaacaatccaattatactcttttagttatttttaaatgtacagtacattattattgtagtcattcccttgtgctatcaaatactatatgttattcattctatctaactatattattgtacccattaaccatccccactcccctgcctcccagctacacttcgtagcatctggtaaccatgatttcctcttatctccatgagttcagtagtttcagctcatggagatagacagaactaattttattagctcccacaaattagctcccatgtcagaacatgtaaagtttgtctttctgtgccaggtttatttcacataacataacgaactctagttccaaccatgttggtgcaaatgacaggctctctcttttttttttttttttttttttttgagatggagtctggctgtctcccaggctggactgcagtggtgcaatctcagctcactgcaagctccgcctcccaggttcatgccattctcctgcctcagcctcctgagtagctgggactacaggcacccgccaccatgcccgactaattttatatatatatatatatatatatatttattattattatactttaagttttagggtacatgtgcacaatgtgcaggttagttacatatgtatacatgtgccatgcaggtgcgctgcacccactaactcatcatctagcattaggtatatctcccaatgctatccctcccccctcccccaccccacaacattccccagagtgtgatgttccccttcctctgtccatgtgttctcattgttcaattcccacctatgagtgagaacatgcggtgtttggttttttgttcttgcgatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaataatgccgcaatgaacatacgtgtgcatgtgtctttatagcagcatgatttatagtcctttgggtatatacccagtaatgggatggctggttcaaatggtatttctagttctagatccctgaggaatcaccacactgacttccacaagggttgaactagtttacagtcccaccaacagtgtcaaagtgttcctatttctccacatcctctccagcacctgttgtttcctgactttttaatgattgccattctaactggcgtgagatgatatctcattgtggttttgatttgcatttctctgatggccagtgatggtgagcattttttcatgtgttttttgggtgcataaatgtcttctttttagaagtgtctgttcatatccttcgcccactttttgatggggtcgtttgtttttttcttgtaaatttgtttgagttcattgtagattctggatattagccctttgtcagatgagtacgttgcgaaaattttctctcattttgtaggttgcctgttcaatctgatggtagtttcttttgctgtgcagaagctctttagttgaattagatcccatttgtcaattttgacttttggtgttttagacatgcttttggtgttttagacatgaagtccttgcccatgcctatgtcctgaatggtaatgcctaggttttcttctagggtttttatggttttaggtctaacgtttaagtctttaatccatctcgaattgatttttgtataaggtgtaaggaagggatccagtttcagctttctacatatggctagccagtttttccagcaccatttattaaatagggaatccttgccccattgcttatttttgtcaggtttgtcaaagatcagatagttgtagatatgcggcattatttctgagggctctgttctgtttcattgatctatatctctcttttggtaccagtaccatgctgttttgattactgtagccttgtagtatagttagaagtcagggagtgtgatgcctccagctttgttcttttggcttaggattgacttggggatgtgggctcttttttggttccatatgaactttaaagtagttttttccaattctgtgaagaaagtcatcagtagcttgatggggatggcattgaatctataaattaccttgggcagtatggccattttcacgatattgattcttcctacccatgagcatggaatgttcttccatttgtttgtatcctcttttatttccttgagcagtggtttgtagttctccttgaagaggtccttcacatcccttgaaagttggattcctaggtattttattctctttgaagcaattgtgaatgggagttcactcatgatttggctctctgtttgtctgttattggtgtataagaatgctgtgatttttgtacattgattttgtatcctgagactttgctgaagttgcttatcagcttaaggagattttgggctgagacaacggggttttctagatatacaatcatgtcatctgcaaacagggacaatttgacttcctcttttcctaattgaataccctttatttccttcttctgcctaattgccctggccagaacttccaacactatgttgaataggagtggtgagagagggcatccctgtcttgtgccagttttcaaagagaatgcttccagtttttgaccattcagtatgttattggctgtgggtttgtcatagatagctcttattattttaaaatacggcccatcaatacctaatttattgagagtttttagcatgaagcgttattgaattttgtcaaaggccttttctgcatctattgagataatcatgtggtttttgtctttggttctgtttatatgctggattacatttattgatttgcgtatattgaaccagccttgcatcccaaggatgaagcccacttgatcatggtggataagctttttgatgtgctgctggattccgtttgccagtattttattgaggatttttgcatcaatgttcatcaagcatattggtctaaaattctcttttttggttgtgtctctgcccgtctttggtatcaggatgatgctggcctcataaaatgagttagggaggattccctctttttctattgattggaatagtttcagaaggaatggtaccagttcctccttgtacctctgatagaattcggctgtgaatccatctggtcctggactctttttggttggtaagctattgattattgccacaatttcagatcctgttattggtctattcagagattcaacttcttcctggtttagtcttgggagggtgtatgtgtcaaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcagtctatcaattttgttgatcctttcaaaaaaccacctcctggattcattaattttttgaagggttttttgtgtctctatttcctttagttctgctctgattttagttatttcttgccttctgctagcttttgaatgtgtttgctcttgcttttctagttcttttaattgtgatgttagggtgtcaattttggatctttcctgctttctcttgcgggcatttagtgctataaatttccctctacacactgctttgaatgtgtcccagagattctggtatgttgtgtctttgttctctttggtttcaaagaacatctttatttctgccttcatttcgttatgtacccagtagtcattcaggagcaggttgttcagtttccatgtagttgagcggttttgagtgagattcttaatactgagttctagtttgattgcacggtggtctgagagatagtttgttataatttctgttcttttacatttgctgaggagagctttacttccaactatgtggtcaattttggaataggtgtggtgtggtgctgaaaaaaatgtatattctgttgatttggggtagagagttctgtagatgtctattaggtctgcttggtgcagagctgagttcaattcctgggtatccttgttaactttctgtctcgttgatctgtctaatgttgacagtggggtgttaaagtctcccattattaatgtgtgagagtctaagtctctttgtaggtcactaaggacttgctttatgaatctgggtgctcctgtattgggtgcatatatatttaggatacttagctcttcttgttgaattgatccctttaccattatgtaatggccttctttgtctcttttgatctttgttggtttaaagtctgttttatcagagactagaattgtaacccctgccttttttttgttttccatttgcttggtagatcttcctccatccttttattttgagcctatgtgtgtctctgcatatgagatgggtttcctgaatacagcacactgatgggtcttgactctttatccaatttgccagtctgtgtcttttaattggagcatttagtccatttacatttaaagttaatattgttatgtgtgaattttatcctgtcattatgattttagctggttattttgctcgttagttgatgcagtttcttcctagtctcgatggtctttacattttggcatgattttgcagcggctggtaccggtcgttcctttccatgtttagtgcttccttcaggacctcttttagggcaggcctggtggtgacaaaatctctcggcatttgcttgtctgtaaaggattttatttctccttcacttatgaagcttagtttggctggatatgaaattctgggttgaaaattcttttctttatgaatgttgaatattggcccctactctcttctggcttgtaaagtttctgccgagagatctgctgttagtctgatgggcttccctttgagggtaacctgacctttctctctggctgcccttaacattttttccttcatttcaacttttttgaatctgacaattatgtgtcttggagttgctcttctcaaggagtatctttgtggcattctctgtatttcctgaatctgaatgttggcctgccttgctagactggggaggttctcctggataatatcctgcagagtgttttccaacttggttccattctccccgtcactttcaggtacaccaatcagacatagatttggtcttttcccatagtcccatatttcttggaggctttgctcgtttctttttattcttttttctctaaagttcccttctcacttcatttcattcatttcatcttccatcgctgataccctttcttccagttgatcgcattggctcctgaggtttctgcattcttcacgtagttctcgagccttagttttcagctccatcagctcctttaagcacttctctgtattggttattctagttatacattcttctaaatttttttcaaagttttcaacttctttgcctttggtttgaatgtcctcccatagcttggagtaatttgattgtctgaagccttcttctctcatctcatcaaagtcattctctgtccagctttgttccgttgctggtgaggaactgcgttcctttggaggaggagaggcgctctgctttttagtgtttccagtttttctgctctgtttttccccatctttgtggttttatctacttttggtgtttgatgatggtgatgtacagatgggtttttggtgtggatgtcctttctgttttttagttttccttctaagagacaggaccctcagctgcaggtctgttggagtacccggccgtgtgaggtgtcagtctgcccctgctggggggtgcctcccagttaggctgctcaggggtcaggggtcagggacccacttgaggaggcagtctgcccattctcagatctccagctgcgtgctgggagaaccactgctctcttcaaagctgtccaacagggacatttaagtctgcagaggttactgctgtctttttgtttgtctatgccctgcccccagaggtgaagcctatagaggcaggcaggcctccttgagctgtggtgggctccacccagttcgagcttcccagctgctttgtttacctaagcaagcctgggcaatggcaggtgcccctcccccagcctcgctgccaccttgcagtttgatctcagactgctgtgctagcaataagcaagactccatgggcgtaggaccctctgagccatgtgcgggatataatctcctggtgcgccgttttttaagcccgtcagaaaaacgcagtatttgggtgggagtgacccaattttccaggtgccgtctgtcacccctttctttgactaggaatgggaactccctgaccccttgcgcttcccgagtgaggcaatgcctcgccctgcttcggctcacacacggtgcgctgcacccactgacctgcgcccactgtctggcactccctagtgagatgagcccgctacctcagatggaaatgcagaaatcacccgtcttctgcttcgctcatgctgggagctgtagacctgagctgttcctattcggccatcttggctccagaaaaaaaaattgttaaattggacttcatcaaatttgaaatttttgtgctgcaaatgataccatcaagaaagtgaaaatctcacccacagaatgagagaaagtatttgcaaatcatatatctgataagggtattgaatttagaatatataaagaactcttgcaactcaatataaaaagacaacccaattttaaaatgggcaaagtatttgaatagaaatttcttgatagaagatatacaaatttaaaaatgctcaacatcattagtcattagggaaatgcagatcaaaaccaaattgagataccggtttacacctattaagatggctatagaataaaagaacaaataacaagtattggctttaatgtggaggagccagaacccttatatattgctggtaaaatgtaaagtcatgcagccctttgaaatacagtctgcaagtctttaaaaaattactatttgttatttggtttttcttcacttttaatttaggttcagaggtacatatgcaggtttgctatatagctaaattgtgtgtcacaggagtttagtgtacacattatttcatcacccaggtaataagcatggtacccaataggtagtttttctatcctcaccctcctcctaccctccaccatcaagtaggccctggtgcctcttgttcttttctttgtgttcatatgtactcaatatttagcttccacttatcagtgagaacatgtggtatttggttttctgttcctgctttagtttgcttaggatactggcctccagattcatccacgttgctgcaaaggacatgatctcattctttttgcatagtatactatggtgtacatgtatcaaaaatgttactgtttgacctagtaattctattccaaggtaaatactcaagagaaatgaaaacatgtccacacaaatacttgtacacaaatgttcattgcagcattatttataatagccaaagagtggacgacaaatgtcttccaaatgtgggctccaaatgtccaccaactgataaatggaaaaacaaaatgtggtatatccatgccatggtttatctgtcaataataagaaatgaagtactcatacatgctccaacatggatgaaccttgaaaacattatgctaggtgaaaaaagcaactcacaaaagactacactgtatgattttatttgtattaaatgtccataaaagaaaaatatttagagatagaaaggaaattagtttttccagggtctgggaggagacagtatgaggagtggctgctaatgggtacaggatttctttttggagtgatataattgctctaaaattagtttgcagtaatagatgtgagtatgctaaaatgggtgaattttatagtatgtgaaatataactcagtaagcccattaaaaacaacctaattaaattaaaaccaagctataacagaaatattatatggctttggcagtttagaatagtgggaaaatatggagtaagggtggggaaatagtcccaagtataattctggttttgtcactactagtgtatggacttggacaagtcatttgctttctctaagtatcagtttgcatatatgcaaaatagaggtaatgatacctacctcagtggtaccttttcaaaaccttgttcttcctcatctctcctctaccactttctcataatattattacagtaataaccatttattaagcactgtgtccgcagtggtgtggggctgctttacctccacaacttcactgaatcctcactgcagtcttgtgggatctttatttctttgcccattttacatgtaaataaattgaagtcaaatgagttgttcaaggtccttctgttagcaagtggcagagatggacatgaaaactagatcttctacctatgtgtctttccacttcaactaaagaatttattaaagagaattgaaaagctatgaactaaatttcggtaatacttttaatagtaaacattgctgccctcgtgaatgaacacacactaaatttcaaatctcacggtggcagggaataaagatgctacctatcttaagccattacttcaccaacttctccaccaaaatattccttgtaaccacaaataagtaagcacaatagatctataaggagagaataattgtgaactctgattttatcttaaaaagtcatgtagggatgtcatgttccacaatgtgattaataaaatatattttgttactaaacacaaggaaaaatattatgttccataaagatgtttggtggttgcctcgacctcttttagtttgaaaagtaggtatgtatgagaaagatatgtgtttacatgtttacccttgccttctctctgtctcttcccctctctctccctccctccccaacccctatgccctacacccccgcaacccccacatgtatttacctttctctaaaagctctgcatagccaagaaaagtgctcttttttatttttaggatattagatatttcattttcttatggtaagacaaaagattaaggcaaccaagacttacaatgtgcctaccatgtggcaggcacagaggcaagggcttttacatgttatttaatgtaattgtaattctcacaaaagccgtctagagttgaaaatatttccaactctaaatgaggcaaatggagcacagagagccttaattatttcacccaaagttcagtggtagaggcaggattccaacccaggtctggtgggctccaaatccttgttgggttgccattcctcttgctaacaaataaaactggtctgtgacttttgcatttcaccccgcttccacagtcactggtgggacttacttaagttaatcagattcttcaaagtatccccaagtcctcctttgaaaagaaagttgggggacaggaggaggagcagaggagaggagataaaaaggaaaggagtcagggagagagagagagagagagaaacctggtgatctcagctgggtgccaaggtttcctaagcccaagttccccatggttgagcctgtattgtcaggccaacagcttctagtaatccacttttatttaattaatagtgaaactgttgaagaattgcaagtggtgttctggttcagaaaccttccgttctatggggcactgcttttgcttcagattcataaaaccaaatgctctgcctcaagataataagtgaacgtgtaaccctcgggaggtaagaaaaaacacaatgtcacgtgcaaattctgcacttgttctcaaagcaaacctctcctgtgtttgcaattaggatgttatctaggagcatattcaaaacttttgaggtttttattttagtttttctttcattatgtgctgttttagtaatatcaaagaatacatgtaatatataatttatatgtcataacaataaaattaatgttgatgagcccagattaaagaatcaacaacattaacatcatgattgcatcaaccctattagaatggaagctctgtgaaggcatggatttttgtccattttgttcactgctatatccccaggacctagaggagtgtcagccacataataggagcttagtcaatattttaaaaataagagcataaatctacttatatcctctttcctcttaccatcactcccagcctcccctcagaggtaaccactatcctatatttgggctttattattcccttgcattttgataagttttcacatgtatattcccaaataatatattgcttgcttttgcttctttttaaactttatataatggaatcatattgtatgtatcctattgtgaattatgtcttttacacaacattagtatttgagattcaactatgtgtagctcgattccattccttttcattgctgattgtagtttattggatatgtgtgccataaattatttttctcctgtcagttaatgtttatcatttatgctttaataaacaaaactgctatgactgttcctgcatgtgcctcctagtacatatgtgaccaactttctctaggatataagcctgagagagggactgcagttggaatttacatttccaaagcccaaagtttagctcatgagtcagagctgcaatgtgccctttgtccacactaggtcaggatcagtgggagtgctacccaaaatattttgctagctggggagtcagggagaagcagagactgacctagtgaggccaggaggcactatctcaggtctctagtcaaaatgggttgcaattagtaaaagtccagattctgaatccccttcactatttatcttcctcttcctcctttacagttatttttgttcaaggtgcactttattaaactcatgcctaacaaacaaaactctaatgaatattttgtctttcattgattgtaaattcaattaattagattgcttgaaaaaattttaactgtattttcactttagtatggatgaaaatttcgatttctttaaaaaacattttttaataataacacaacataaagtctaccctcataacaaaatttaagggcacaacaccatattgttttttttttattttattattattatactttaagttttagggtacatgtgcacaacgtgcaggtttgttgcatatgtatacatgtgccatgttggtgtgctgcacccattaactcgtcatttagcattaggtatatctcctaatgctatccctcccccctccccccaccccacaacagtccccagtgtgtgatgttccccttcctgtgtccatgtgttctcaatgttcagttcccacctatgagtgagaacatgtggtgtttggttttttgtccttgccatagtttgctgaggatgatggtttccagcttcatccatgtccctacaaaggacatgaactcatccttttttatggctgcatagtattccacggtgtatatgtgccacattttcttaatccagtctatcattgttggacatttgggttggttccaagtctttgctattgtgaatagtgccgcaataaacatacgtgtgcatgacaacaccatattgttaactgtaggcacaatgttgtacagcagacgtctagaactttttcttcaggcttaactgaaactttatagccattgaacagcaacactccatttccgtttcttaaaggtcctttacaaaatgagctttctgcgtgtttccattttgtttatctgataacttttttttctttttttattatactttaagttctggggtacatgtgcagaatgtacaggtttgttacataggtacacacatgccagggtgtttggctgcacctatcaacctgtcatctacattagatatttctcctaatgctattccctcccttgcccctcacccctcactggccccagtgtgtgatgttccctagcctgtgtccaagtgttctcattgttcaactcccacttttgagtgagaacatgcagtgtttgattttcttttcttgtgttagtttgctgagaatgatggtttccagcttcatccatgtccctgcaaaggacatgaactcttccttttatatggctgcacaatattccatggtgtatatgtgccacaatttctttatccaatctatcattgatgggcatttcagttgttccaagtctttgctattgtgaatagtgccacagtagacataagtgtgcatgtgtctttatggtagaatgatttataatcctttgtttatatacccagtaatagaaatgcttggtcaaatggtatttctagttctagatccttgaggaattgccacactgtcttccacaatggttgaactaatttacactcccaccaacaatgtaaaagcgttcctatttcttcacatcctctccagcacctgttgtttcctgactttttaatgatcacgattctaactggcgtgagatggtatttcattgtggttttgatttgcatttctctaatgaccagtgatgatgagctttttttcatgtttgttgaccgcataaatgtcttcttttgagaagtgcctgttcatttccttcacccactttttgatggggttgtttgtctttttcttgtaaatttgtttaagttcattgcacattctggatattaattaacctttcgtcagatggatagactgcagaaattttctcccattctgtaggttgcttgttcactctgatgatcgtttcttttgctgtgcagaagctcttgagtttaattagatcacatttgtcaatcttggctcttgttgccattgcttttggtgttttagtcatgtagtctttgcccatgcctatgtcctgaatggtattgcctaggttttcttctagggttttcatggttttaggtcttacgtgactcatcttgatttaatttttgtgtaaggtgtaaggaaggggtccagtttcagttttctgcatatggctagctagttttcccaacaccatttattaaatagggaatcctttccccattgcttgtctttgtcaggtttgtcaaagattagatggttgtagatgtgtggtattatttctgagacctctgttctgttccattggtctatatatctgttttggtaccagtaccgtgctattttggttactgtagccttgtagtatagtttgaagtcaggtagcatgatgcctccagctttgtgcttttggcttagaattgccttggctatgcaggctctttattggttccatatgaaatttaaagtagtttttttataattctgcgaagaaagtcattggcagcttgatggggttagtattgaatctgtaaaacactttgggcagtttggccattttcatgataatgattcttcctatccatgagcatggaatggttttccatttatttttgtcttctcttatttccttgagcagtggtttgtaattctccttgaagaggtccttcacatcccttgtaagttggattcctacatattttattctgtttgtagcaattgtgaatgggagttcactcatgatttggctctctgtttgtctgttattggtgtataggaatgcttgtgattttcgcacactgattttgtatcctgagactttgctgaagttgcttgtcagcttaaggtgattttgggctgagagaatggggttttctgaatatacattcatgtcatctgcaaacagagacaatttgacttcctgttttcctatttgaatatcctttattgctttctctttcctgattgccctggccagaacttccaatactatgttgaataggggtggtgagagacggcatccttgtcttgttctggttttcaaagggagtgcttccagtttttgaccattcagtatgatattgggtgtgggtttgtcataaatagctcttattattttgagatatattccatcaatacctagtttattgagagtttgagcatgaagcagtgttgtattttgtcgaaggccttttctgcatctattgagataatcatatggttttgtcattggttctgttgatgtgatggattatgtttattgatttgtgtatgttgaaccagccttgcatcccaggggtgaagcggacttgatcgtggtggataagctttttgatgtgctgctggattgggtttgccagtatttttttattgaggatttttgcactgatgttcatcagggttattggcctgacgttttctttttttgttgtgtctctgccaggttttggtatcaggatgatgctggcccataaaatgagttagggaggattccttctttttctgttgtttggaatagtttcggaaggaatggtaccagctcctctttgtacatctggtagaattcatctgtgaatccttctggttctggactttttttggttggtaggctattaattacttcctcaatttcagaacttgttatagttctattcaggtatttgacttcctgctttaggcttgggagggtatatgcgttcaggaatttatctatttcttctagattttctattttatttgccccagaggtgtttatagtattctctgatggtaatttgtatttctgtgggatccgtggtgatatcccctttatcattttttattgcatctgtgattcttctctcttttcttctttagtagtctggctagtggtctatctacaaaatagactgtttatctgatatttattttgtaattatctaataataaccatcattatcatcatcagcattatcattatcatctcctttacccatacatacatttgtgtctttcaaataataatcccatctttgaagtgcatcctcatctttagcagtctgcactctgctttcttatatcatttattatcttattttataattatttatttccagtccttcttctctaacagatagtagtttcttagggccaaggaaatatctcgatcaccactatatccccagcacctaaccctgtgcctggtccatagggccagatgctaagagttgagttgaaccattgtacctaatcttaaccttcattagcacaacatggtttgtcagtggttaagaatctacactttggagtcagactcacccaggatggaatcctggcattgccacttattattaatagatgcgtgatcttgaacaagtttacttaattgttctgagcatcagtttcctcttctgcaatatagggatgatacacagctacctggtaggttgttgggaaaattaaatgggatgatatgtatgaaatggcctggcatatagagtgcctaaatacatgttcttctgattctatttggacagtttgtgttagtaacagaagtcaaaaaggtggagaaaggagaaaggtacttgtgaaaattttctatttcttctccatgtttcattcaggactgaggaagggggcacagtttttacccaaggaaatgacatttttagccaaaagaaatgatcttagcatttagctgaattatatattggaagtaagctccttccatgtggaacttatggccttgctagccttggtttgttggaagtgctcttgctggctttctagttagggtagggaaaggaaggcttgtggggaatgaagataggccatgatatcaagccactgggtttgcaaatcagtagaattttttattgctttctgttgtacttgggacttgaataaaggctgatatttgtgtcttgctggtaaagtgcttgtaaagtgagtgaaagttttctttgctcttgtcctgacatagctgttcacttggggttgaggggaggataacctttcatgttttttttttttcttcattctgatgactgtgctgaacattcaaaccaaaaggccattggtggaaagtaaaggtgagtggtgagaagacaatagggtaatggaaactgtgttggacttgtaatcaaattgtcctgcacttcccctctccaagtcttaacgtttttcatctgtacagtggatattaaaatgagaaaataagcttgtcttcacagagttttcgttaggtgttgacacaacaaacaggctcccattagggctcattttccttcattccttagtaaggaagaagtgcttataaaatatagcagttgtgctcttgtgaatgatagcatgggcagttgtcatctccctgaagcagatgtaacccagaatgtcacttgagttttgtttaatgcttaggcataagacataggaatgacaaaagctgacctttgggtagtgagaacaatgttccattttgttcaaacttgaattttttactataggagactgagaattaaccttccatgaaggttttaggattggctttctggcccttctccttcatatccacctgaaagagcttgggcgcagaagttcttgcagaaaggcagttagacaaggtgacttctgaagctccagtggccaagtattttgatggtagcctaaaagatgtccagaatcattgtacatcattttttcaacagaagcttcaggcatagggattatgcttggtactttatgttgtggaatggaatctggcggatgtccatgtgatctatagaaacacctaaggaaagtgaagaaatgagggaaaaaaaagaacaagacttttatgataatactaatcacgatccttgtgtatttattccaatggcattttatccattatctgatttatattaccactcacagcagcagctcaataggatgggagatattatctctattttatagatgagatttgaggctcacgaagctaaagcaaggaacatcaaatcactttgatatttggtctggttttgttataggtctccctttggatgaggtaaagttacaaacctgggttcatatcatttaattagtctgaaaatgttgcctggacaccaccttcagttagatatcttaacctcaggcttcctgccttcattgctcccgcatatagacatagactatgagattggctaatcccagagaacttccctaatcccttggcaagatccaaaaaggctcagtcacaccctacaaccatcatctttaggagaagtctcagaaaattcagcttcacactaactaacttgagcaatgaataatagtcatttatgcctgcaggttaatgctgaagacctgagacttcacttgcctatttctgccattcagtgacatgtgttgcattggttttttgtgtctttccagtttggagactgccagggaccatgttttgcccattgactattactttccaccccagaagacctgcctgatctgtggagatgaagcttctgggtgtcactatggagctctcacatgtggaagctgcaaggtcttcttcaaaagagccgctgaaggtaaagggtcttgcacatgcacttctctttccctttctcctttaccttccagagagagacactaacctttcagggcccaggattttatcatctcagaaatagagtcattggcaaggccctatcaaataacttaggagcctaaggaagcaaatttttgtacttgctagttccctggtttcagcagccttgtttgtacaggcaatttaggcagtgaaggtggtcccagctggggcttggggctcagtgggtcctagaaatgaaagaaaaattaatgatttgaaaagatttaatttcctcccttcttgttttctactctgctggctagtaaaggaaaaatttgtccttattagagaggttagaagtggagaaaccccaactgagtccccagcctgttccttgggatgaatatgagactgttccttagcaaaggcttcctggcctcggccccagaaagggagtgttctcactcttcagcagactatcagtctctgcacctgctccctcctgttgtggcctccttgggacctgtctttgcattaatagttcctaggtaggtaagaactcagagtgaagaaacacatttattctcctctccagagacctgatctcaaagcctgtccattagtccctaaccttaatctaaggtagcatcttatatctggctaaattggctcaagccctagctccttagttttatttagcttagaacaactcatgtctgctcaacctctagaggcgctcagcccacattctgcagtagaaactcccattttcaggcctcttatatacggtaatgtctccttcctctaaccacccagggcttaagcttcctgcttatccacttcaccctgtattgagggctttcttctcaaagagacattgatgaggagcccctagagagagatgctgtgctctgggaccagaccccttgttaaacaccagtattcacctctgccccaactttccccaaagaggtacttcctgccaaggcctttctctttcctctcactggctggaagtgttgagttccacttcagaaccagaacagagaacctttccttctataagagctataaaccttgagaacagtcttaaaacataggtatgtaggccacaccattcaccacgaatgtactgatactcatcagaatatggaagaagcaccagagagtttgaagcatctagagaaaaggtagaaagagaatgccctttaactgacctcctcagtgatagccaatcacaatgatgagtgttgattcatcattttggctaggtggcagaaatatctataaaacagaagctgccatgttgttttcttccagtcctcagggcctacaagaaggcagctatcatttggtattactgaaaacatgccccatgttcagctcatacccccaaattacccattgctactgtttatgctgggctaatatgaagcccagggccctaatgtctaggtctaggcagtaaggcctagagcagtgcctaaagagcctgagagcagtgccttcctttcttcagagtactcatgaaaggatggctgtcagaaaaggaaatgaggatgggttccagagacttcagaccaccccaacttccccagtgagaccctggcacctccccataccctctcacctagcgggccctgtctatagagcagagaatgaaacagagcactcatctagaggtagtgtgtcagcaagcccaggcactgcaccacagtaatagcagccatatcagatgggaaaggagttcaagtgaacaaacaagcaaattcaatagtcagatagattagattatacttgatgcttcctctgagttttacaaatatgggtcactaaattgttattttcagaaaacaggggaaatgctcaatcacattgtgaaagggaagattttgctgtcatatcatacatcccacatgggagctttctgcagaagttagagctgaaggagggaggcaggcagaagggcaactggcagggctgcctgggaggagctctgcaatgaggtggatcctgtgccatttgagaacagggaagaaaagaaatgaggttttggggagggaatcacccaactcacagaacacacagaaatccagcaaggtttcaaaacgctctacaccttagagtctgttaagttagggaaactctgtgagctcatagggccaaatgcacttgcctgcttgaaatatgaaaaatcagcaatggattccttgaaaaacaatgaaaagggaaccttctgagccccttggttattttgacatatggaccatagatttcagtcctgagccctttgaaggtaggagaaggtggtttagaaaacacacacacacacgcacacaaacacacaccagaatgaagcaaaaaaaaaattactggtgttttctttctcctcccatctgtgaagctgttggattgattttactgccatcattatccctgtttgaaggcagggggctgtcttattacccaaagaggacatttattgatttggttttctttttccatttttacaatgcatctttatcgcccatatggcctttctggaggtggttttcagtctggcttgttgaaacatcaaattatacctgtcttagagaaaatagaaacaaaaatctttctcttccttacttgcttgttgtagtcagttaactcggactgagtattcagagtcttgattatcacttaattcatagtttcataaatctctggaatgggcataggtacaggacttaaaagcctggcatctcagacagaaatatgtttttagctttggtggtttataacagatgggacttttaggctgtcattggtgcagggctcagcacagagtcagttgtaatctggacaggttttgttgttgaggaagagtgggaagagggagtcctacattttctccttgtcagtaatgttggagaattggggtgagggtgaggctgggcagggagggtctgcatagaaaaaagggtgcggtgagaaaaaataatgctactaagccatgagggtaaaatgaccaaattctggttgagagaaacttggtcaaagtgtgtatggggagagaaagttggtcaaagtctgtgtctgagtgcttggtgggatgaactctgggttagaaacaggcatggagggaaatagttggtttatggagtgggtaggatgagtggggtggtgaaagggaaggcattttggatgctaagagaccaggaagtcaaagcaaggcaatacacataaacagaggtaagggctcagagaggttttagttgtgtagacttggataagaaattttcccttttggacctcagttttccttgtttgtaaaacaacggacttgaactagatattttaaaatgtgcttccagcttagacattttgtgaccgttctacaaattacaaacataatcatcatcatttcagcaaactcacatgtatttatacctgcataagtttttggtcttgctttcctagaaggtgactaatcccagatcctaatcaattaaagaagcaatcttcagatggggatagagccagctgagagagtgtactatggatggagtgagttaaaactcaggactcagattttctccttgtgatcattgctgggtaacttcctttcttttctattttctcatctggaaaatcaggatatgaatccccatctctacctcattatgtttcaaagagggttaattaatccatcatgtgcattatgtgctcaagaatttactatttttcagacattttctagtaaaacattgaagattatatgtccatttgttttgtacacatggagtgctgtttggtacacatcataaaattgaaactgtagtttacattctgaactcaaagaattacaccatcctcactgatgtttacaataggtcccaatttagtttctttagcaaattttatgtaagtatggctttgattctctctctcactccaggtttttgttagggaagaaatgcaagtgaaccctcattgaactctttctgtcctttaaatccattctttcccacctcaactcatgtggaattgaatgttgcctctagtttggagtctagcagagagtttttggtgcatatcagtgtccccttcactccctgacttttcaagtaacatttcccagaggcaaattaactctgctaagaggatctgcttgcagcttcaacagagccttcatcaggtatctttggccaaggagttgactgatcctgactttgcgagtcctagagatcttttcacaaagctcctctcatgtttctgcctctgattttcttaaatgtcacagacagactttagatttaggggttggttaactttttttgtaaagggccatgtagtaaatattttaggctttgtagatcatatggtctctgtgtcaactactcaactctgcctttgtaggatgaaagcagccatagacaatactggaactaatgggagtagctgtgttccaataaaactttatgggcactgaaatttgaatttcacttaattttcacatgtcgtttaatattatttttcttttttaccatttaaaaatttagaaatcattcttagctctttgggcctcacaaaaacagatggtagagtggatttggtttatgggctgcagtttgttgacctgtgctttagctaatcacttctgtacttataaatctgcataggttttatgtttttccatctcttggtatcttagtaggccagtcaaagtttgaacaacttgttagcacagaatacctggcctagtggcttcttggtcctgagcttatttactaaacaagagaaaaaataaataagtctagaaatgctagaagaggatacttttttgttttaatgatctagtagatcactcctccttgcaatacccagaggagaaactgaaaatatttcaaacattttctagacttctgtgttgtaaatttgtggataactatgaactatatatgaatgaacttttctggatgacacatatattccagatggtaaaaaggaagggctttggggactctctggtaccaagtgtcatggaaaaactgtgtgtctcatagaaagtagatcccaggaggccagcagagttgtggatctgccatatattacctcatgattctgtcttcgcacactcaccggcttaattctgggcctccccataacacgactagaccacaggcttgcagaagaaataatttagctctgtaactcattgaagttggtgcccacccaagtctctgtcagtgcccaattcgggagccatgccaagaatttgccattgctgcttcatggtggccttgtgcctgcttatttatagcctgtgcattttatgaaacagggattaataagaagttgccatagcacttgcaccattatgtaaatatctgtaatgcttacataacttttgtcacttgcaagaccttttgagtccattgccttctgctaccatgccttaccaatttcctagtcccttattattatttttcaattcattatatttaacttctgtgatacacgttcagaatatgcaggtttcttatataggtatacacgtgccgtggtggtgtgctgcaaccaacaacccgtcatctacattaggtatttctcctaatgctatccctccactagcccaccaccccctaataagccccagtgtgtgatgttcccctccctgtgtccatgtgttctcattgttcaactcccacttatgagtgagaacatgcagtgtttggttttctgttcctgtgtttgttttctgagaatgatggtttccagcttcatccgtgtccctgcaaaggacatgaactcatccttttttatgactgcatagtattccatggtgtatatgtgccacattttctttatccagtatatcattgatgggcatttcggttggttccaagtctgtgctattgtgaatagtgctgcaataaacatacgtatgcatgcgtctttatagaagaatgacttataatcctttgggtatatacccagtaatgggatggctgggtcaaatggcatttcaggttctagatccttgaggaatctccacactgtcttccacaatggttgaactgatttacacccccaccaacaatgtaaaagtgttcctatttctccatattctctccagcatctgttgtttcctgactttttaatgatcgccattctaactggcattgacatggtatctcactgtggttttgatttgcatttccctaatgaccagtgatgataagctttttttcatatgtttgttggccgcataaatgtcttcttttgagaagtgtctgttcatatccttcacccactttctggtgtggttggttatttttttcttgtaaatttgtttaagttccttgtagattctggatattagccctttgtcagatggatagattgcgaaaattttctctcattctgtaggttggttgttcactctgatgatagtttcttttgctgtgcagaagctctttagtttaattagatttcatttgtcaattttggcttttgttgccattgcttttggtgttttagccatgaagactttgcccattcacaattgctacaaagagaataaaatacctaggaatacaactcacaagggatgtgaaggacctcttcaaggagaactacaaaccactgctcaaggcaataagagaggacacaaacaaaaggagaaacattccatgctcatggataggaacaatcaatatcgtgaaaattgccatactgcccaaagtaaattatagattcaatgctatccccattaagctaccattgactttcttcacagaattagaaaatactactttaaatttcatatggaaccaaaaagagcccatatacccaagacaattctaagcaaaaagaataaagctggaggtatcaagctacctgacttcaaactatactacaaggctacagtaacccttatcaattttttatgtgcctctccatattctgcagtcagaagcttcttcagtcctttcagggaattgctgggtgactatcaaactctggtagttcatttttgcagttggctgctgttgtgaggataagagttagactcactttctcttcagagatagaaattatgtattaattctctgggttctagacccacagcaaggagcatactgctcctcaaaataactgaattctgcgagaagccatcattgtaaaacaacaatatcttcagttatagtagccatgtgtgcaacttctggaaactgttattcagattttcatgttccttccctgtctcttcatagctaggcagctgctttcagccttgtacagatgctagtgagctttctacctacaaacctgcagaaaattgaactgagatttggaggtgaaagactcttgataaagggaacaaggtttagaattctcagtccctttgctcccaggctgtgttgtgactactgaggcactccagtgaaatcactattcctcctatctagactaatgcctgtctctgcagagcacctcataagaacaggcctggtagtaatatcctcatgcattcagtcagtaaatatttacagagtgcttactacatatagggtattgggctgacatatgcaagatacagggcctgcttccaggaggttatagcttattgatcataaatgtggcattttttttttttgagacggagtcttgctctgtctgtcacccaggctggagtgcagtggcacgatctcggctcactgcaacctccacctcccaggttcatgtgattttcctgcctcaccctcctgagcagctgagactacaggggctcatcaccacacccagcttttttttttttttctgtatttttagtagagacagggtttcaccatattggccaggctggtctcgaactcctgacctcgtgatccacccacctcagcctcccaaagtgctgggattacaggcgtgaaaatgtggcaatctttaaagctcttcagtggatgaaaggccaccctatctgctgtccttttgaacttcgcaactttcttggtacagagtgagaggttattctcttggttttccatataagtaaactgaggctttgccagttcatcaacaggtagtaaataatatatttggaatttgaacccaagtcttctggggtcaaaggcagcattcactctgctctgtcacagcagctcctcaaataagccaacatagaaaccaagtactatgcctaggcaacaagaaaggcagcaatgaagagcaacagcagagtcaaatatgagagaaggaagttaagaaagatgttaagtactgtggggagtaactgagaaaccaccaagtatcgctaacatcacagggaacttgtcttcctaagaaaattccaagcacttaaaaccgctggtagttcatcagcaactctcttcattagatgtgcgagggacatgtgggccatagtccttctactaacttatattcttcaggggaaagttctgattctgatgagacccagcatggtagctcttaattcactgttgtcacacgactatagaacaggaagcacaacttaacacctgtgctcatgagaattttgctccttatgaccaagctaaagaaagagcttagacaggatgtgtggctataaatgtagattaatggttccttggctctttggtttgagccttctcagcagagcatcccacggagtgttttccatggggccacgagcaagagaaatccacttccctcctcctcaatgtcagaaaatagagaatattgtctttcaggatagaattaaaaagtcatagaggcagcaacttgttttcctatattagggttttaaaattctgtttttccttcctctcctgggtcagatcattgtgtggatggaccttgatttcattgtggtatctgtatgtggaccctgaagaccatggacttctaacaattccttaagttacataagcacattcctacaggtcacaagctcatttacttacaggatggttgatttggtcacaggttatttcatgaaaatacttaaaagatttgcagtgttcaaaactgcagtatctttaaacactaaaacttgaaggaagggaatttagaaatcaaaaaatctggtcaaaccatttcatggaaaaggaaagtgaggctcagagagaggaaattactttcctgggtttgtatagcctataaatggcagaaatgagagcctccctgccatttctagttttctgtctgagagactctcctgcctaatagctaattagcagagtcacagaggtcattaccttgcaattctcaagaattatgtgaggcagcatagtaagcatttatggcccttggttcctagaaggagcttagtccctgatagtcatctctgcctttgccattgtgtgagactgtcttctgtaactgtatgtcttcctccctagtaagttaatgagtaataaaggtattctatagtgagaggactctgtaagacatttcttggtgtgaggattgttccaaggttgttttgtgtgtatgtgcatgtataaacttttttagggagcatattcatagcttttacatggatctcagaggctctataacccagagaagattacagaataccagtcttgtctttggtaaggattttatagacccatcctgactacagtgatatccaacatggctatgtaatgactggcactttccccacataacatatatttattccacactcagtgcctactgtgtacatgagacctataccgggcactgggataagagacatgaaataacagctaaaattgtttattgagcagtcagtatgcattagatgctttgtagtcattttcttattcaatctgtataccctcaatttacaaatgaggaaactgaggcacagaagagttgagtgatttgcccaaagtcatacaaatagtcagtggctatgtgatgaatagttaccaacataaaagagtgagattactgctgtactaaaagtaggtacataatcccctgagcagacagtatgagagaatgatttattttacctggaaagtttaggaaggcttcacagaggagttaagggttgatctgggtcttgagggatggataagagtttgccagatacaaaaaggtaggaagagaacttcaggaggagggaacaggctgagcaaagacacggcgatgtgaaagtgggaggcttgtttggggaacattatggaatctggaggttattgtggggaatctcatcagatgcagcaagctgtttgacaggccttcagttggctctttgtaccttgctccctccgcatgctgagctgtccatagctgccctaggctggtgtctgggattttcggaagaaggttactatccaggtagtgtaacaagatgcagtgcaaaagcaccagattggggctctggctctgctgctgacttaccacctggccttaagcatgtctagttccctctttgtacattaaaatctccattggaacagtaacatggttgtattaaatgatcttgaagattttacctgcacgttttgcacatgtaccctaaaacttaaagtataataaaaaaattaaaataaaaaataaaaatataacaatataaatctttaacaataattttagtagtaaatctctacaattttacagataatccagatgcatccattggccaatggttcactttgtatgcataatatttgggaaacaggcagacccaatttcaatccttagttgtaagacttaatacatatgtgatctcgagcaaatcacttttgtatgcctctataaggataataatagctcacagaattattttaagaactaaatgatgtgtaataaagctactggtactcagtaagttttgtatccttttcctagagtgagtcttggtcataggcatgcgtatacttgcagcgtccctgggtaggccgaaagagcaaataagagatggtatctatggtattccccaggtaaaggaggccttgggttggcataagatttcacttctctttagagttacttaattagggaccagaaaggccatcagcatttgtatgagaatataacaaaggtcaatctcttcctctttactttttacctcccagtacactgtgagtaacattccccagccagcccagccagcacgtgttcattgcctctcttgacttccagactttggacttgaaggtgtcagagctctctgtgtatctttgtccccaacaagataagtctgacctccccagcaaattcaagtcctaagccactgtccaggagaaaagctagcaaggtcataaattattctccatattttccagccattggtttcccttgtccagccagaggtgtgtctcaaagtatgctgaggccagattcaatagaaacctgagccagcacctgtgtaaataatttttaaagctccttttcctgaagctggatgaatatttttaaaaactaagctggattgtcttttatctagcatgccgtctcctacattcctagtgctatggacctcttggaggaatgtggtttggttatagtggtattgtcttgtctgttgtgggggagggagacatttctttcagaagcaaggtaatactttggtctggtctatgactctattttgtttaaaatgaaactatggcagtatagtggtattcattctgcttcccataggttaactttacatccctctgtcttcacccactcttcagttctgattcttttaaaagcagccaaccaaaaccagcaagtacatactgcttatctctgacttccaccagaatcaacttcagatcttgtccaaagctccatctgaagagaggggaataacacccagccaagagccctcagggcccatcagtaagtagacatcctgtccttgaggttccttaactctgctcagcttcagaatacagaaggggttggttcttcatttgtgttgtttataactaaaagcctcctactccccacttttttgcatagcttcttctgccatcccacctgtgtagcctcttcaactcccccaaaactcctctgtagcccatgtcacttggaaagagttttctttgtctcttttgcaacttgacaatgactagccagcaagtttaagttcaaattattgttccatgggagcagagatagatataggaaacaaaaaaaagggatatggaggtatagagtgatttcccacctacctagtgagcactactgagatattcaagtactctctacccaagaattctattgatataaaggtaaaaaacttgatcttaggtctaatatccgttagtagtgtgaccttgggaaaatgataccacccccaaaggcttagttttcttaactgtaaaataggcatacagatgaccacccccagaggattcataaggataacatgagataaggcaacttgaaatttcctagcatagtgatagactttcgaaaataaaatgaatcaaacactgataacagtacttcctagtacacaaatgagaaatcagtccctcatcaaattacagcacattttcaatgctccaattatgtcactgtagaaatgctaatgtggattaaataatttgtctgttgctatttatacggataatttgatagtagttatttttggacatggatagctttgaagccttacagatgagtccatccccaagtacccaaaactaaagaaagttggctagagtgatgacaaggtggcagcacagagctccctgcgttctgggccctgtcccctagctagagagaactccaggctataagcatttgtattctcatagtccaatggcagggaagaagggctggaggtgagtagttttcactcatttattttttcaacaagcatgtatggtatcaggccttgtatgcatccagagacaaatgtgaactagccgtgtcctcaaggagattccagtctggtgggcctgccttccaaggtcagttgcagctttagcactataaagagcacctacctgcggcagatacaatgtgatgggacatgacagagaaaaaatctataagcagagcctccccattcccaggcattgaaacaatcctaaccaagactggcatagtacaatgagcctgtccctatcagcaggtttggaagccttaacaacaacaacaaaaacaataataatggtgatgataatcatagagcctaatgttaccaaacattttccatgtgttaagtactatactaagtgcatacttaatcctcacaacaatgctataagatagtagatactcttactactaccctgattttacaaatgtggaaactgaggcacagaagactaagagaacaggaatacacctaattcacctcagttcaacaaacatcaagcatctgttttatgtcaggcctcgtgctggatggcagggagagagagatgagtaaagcatagtttcagtccagtgggagcaaatgacagcacacagtggggcaggtatattgcagcccttctgcttgatgctaagaactcagtgtcagtgatgaatgaaacacagtcattctctcaaagatcttaaagcttagtaggagatatctgtgtggaaacaaaaattaaatactgctgtgataagtgtcataagagataagtggaaaatgagagagagagatcactgtagcaattgattggtttaaatcaaagcccccaaaaaaatgttattgagaattataaaacaactaattgatttaaatcaaagcccaaacagaagtgtttgctaattttatttcaatttggttgataatttggttgaaatgaatttatttcattttttattccatccttacaatggaagattagtgcttgtttcccacccaaggataccaggatatttcaggggctgtattacaatatagttaaattattcctttatctcaaagcacatccacactttcccctatccttacctttactcagggtatctcttctgcctcaggtgctttttctccacatttccatattcttaagtcctaccttccttcagggcctcactcaaatgcctcctcctccatgaagcattcacccgactgaaaggtaccccgccctctcctgtactccacatcacttcatgggtgtctccacttcctgctttatctttcagtaatacacttacagttctctttcctccactagactgagctcttcagaggaagactcacttggctgaaaccatgattttactttaaacacattgaaaacctctactggagtgcattgtgtctggtgggcttcaaccttaattcttaagtatgtgaaaacacatcacctatctggaggtttacactttctgctaatgactttatttttaagcccaccaccctaacacaacaaatacttaaaacttgtcttcatttcctttaggtctggccctcatgcatgcatataatttatagagtcactgttttgctcggttgtcctcatgcctctatattattggaggtttagattgtttccatatactcaggttgtattcatgtcctttttttctttttaaatttccttagcatccatttccaccattggaaattcagggtcaaaacaggggtttgggattggagcatgtctatcacagataaccaatcatgtgttatgacttaagaatttatgaaagggccctctacctgaagatatcttgctactgatgctgtctcacagtgtctgaaactcccatcatatgtggaattgttttggaaggctttgcctcctgggacacattcagccataatcaagaaatagtattgagcattagactgtcagtatgtccattagcaagactgtggaggaatggaatcaccaatattatattttataggggatacagaatacaagagaagttctgaagagaaaattcttatgtagaataggaaggcttagatacagcatgaaagctgcaggctttgaggagccagaggtcaaatgaaagcattgagtatttgtttagatgaaagaacagaaagggaaaaagaagcagaggaagggatagtagagagaaatgtataagttttatccatttaacttgtaattgtgtttggctatgggcacaatagaagcagtgagatcactttattttattttattctttatagacagggtcttgctatgttgcccaggctgcagtgtgcagctcttcacaagtgtgatcatagcgtactacaccctcaaactcctggactcaagcaatcctcccatctcagcctcctgagtagctgggactacaagtgcacaccaccacgcccagtgagatcacttgaaactagggagagatgtgtgagttctgggcaaccagtagttggctttacatagaactgtaggggtcaaggccaaaggggacgtcctgttccaagtcaccttctttggacattagaaaaccacgaggggtttggaaatcagaaaaccagcagaggcaggaaaactcagggcagcatgggagattcagtatatacaaaaaggttcacaccagtaatcaaacagaattttaactgctgatgtggagtagaggcagctttgtctgctgtgtgataaccaaacctttacgaatagtaggtgtatatggggaattggagggagataggtggctgtgtttagtaattggttgacttcactgagatggtttggggattgtggcttccagatgatcagattttcttttttaggtagagactccaacatcattacagaactataaattacatgtggaaaagaaaggcctcctatgttagaatagaaaataaaatgctgtggggttgagggacagaggtgctgtctaggaagtcagatagcgttttccagttctgtccctcagagttccttgtcctcattgagactcaatttctcttacttttttttttatactttaagttttagggtacatgtgcacaacatgcaggtttgttacatatgtatacatgtgccatgttggtgtgctgcacccattaactcatcatttaacattaggtatatctcctaatgctatccttcccctctcccctctccccaccacaggccctagtgtgtgatgttccccttcctgtgtccatgtgttctcattgttcaattctcacctgtgagtgagaacatgcggtgtttggttttttgtccttgtgatagtttgctgagaatgatggtttccagcttcatccatgtccctacaaaggacatgaactcttcattttttatggctgcgtagtattccatggtatatatgtgccacattttcttaatccagtttatcattgatggacatttgggttggttccaaggctttgctattgtgaatagtgccatgataaacatacgtgtgcatgtgtctttatagcagcatgatttataatccttagggtatatacccagtaatgggatggctgggtcaaatggtatttctagttctagatccctgaggaatcgccacactgacttccacaatggttcaactagtttacagtcccaccaacagtgtaaaagggttcctatttctccacgtcctctccagcacctgttgtttcctgactttttaatgatcaccattctaattggtgtgagatggtatctcgtggttttgatttgcatttctctgatggccagtgatgatgagcattttttcatgtgtctgttggctgtgtaaatgtcttctttgagacgtgtctgttcatatcctttgcccactttttgatagggttgtttgtttttttcttgtaaatttgtttgagttctttgtagattctggatattaccctttgtcagatgagtagattgcaaaagttttctcccattctgtaggttgcctgttcactctgatggtagtttcttttgctatgcagaagttctttagttgaattagatcccatttgtcaattttggcttttgttgccattgcttttggtgttttagacatgaagtccttgcccatgcctatgtcctgaatggtattgcgtaggttttcttctagggtttttatggttttaggtctaacatgtaagtctttaatccatcttgaattaattttagtataaggtgtaaggaagggatccagtttcagctgtctacatatggctagccagttttcccaacaccatttattaaatagggaatcctttccccatttcttgtttttgtcaggtttgtcaaagatcagatggttgtatatatgcggcattatttctcagggctctgttctgttccattggtctatatctctgttttggtaccagtaccatgctgttttggctactgtagccttgtagtatagtttgaagtcagatagcgtgatgcctccagctctgttcttttggcttagggttgacttggcgattcaggctcttttttggttccatatgaactttaaagtagttttttccatttctgtgaagaaagtcatgggtagcttgatgaggatggcattgaatctataaattaccttgggcagtatggccattttcacaatattgattcttcctacccatgagcatggaatgttcttccatttgtttgtatcttcttttatttcattgagcagtggtttgtagttctccttgaagaggtccttcaagtcccttgtaagttggattcctaggtattttattctcttagaagcaattgcaaatgggagttcactcatgatttggctctctgttttctgttattggtgcataagaatgcttgtgatttttgcacattgattttgtatcctgagactttgctgaagttgcttatcagcttaaggagattttgggttgagacgatggggttttctaggtatacaatcatgtcatctgcaaacagagacaatttgacttcctcttttcctaattgaatgccctttatttccttctcctgcctgattgccctggccagaacttccaacagtatgttgaataggagtggtgagagagggcatccctgtcttgtgccagttttcaaagggaatgcttccagtttttgcccattcagtatgatattggctgtgggtttgtcatagatagctcttattattttgagatacgtcccatcaataactaatttattgagagtttttagcatgaagcgctgttgaattttgttaaaggccttttctgcatctattgagataatcatgtggtttttgtcgttggttctgtttatatgctggattatgtttattgatttgcgtatattgaaccagccttgcatcccagggatgaagcccacttgatcatagtggatacgctttttgctggtattttattgaggatttttgcatcaatgtttatcagggatatcggtctaaaattctcttttttgttgtgtctctgcctggctttggtatcaggatgatgttggcctcctaaaatgagttagggaggattccctctttttctatttattggaatagtttcagaaggaagggtaccagctcctccttgtacctctggtaggattcagctgtgaatccatctggttctggactttttttgattggtaagctattagttatatcctcaatttcagagcctgttattggtctattcagagattcaacttcttcctggtttagtcttgggatggtgtatgtgtcgaggaatttatccatttcttctagattttctagtttatttgcatacaggtgtttatagtatgctctgatggtagtttgtacttctgtgggatcggtgattatatcccctttatcattttttattgcgtctatttgattcttctcccttttcttctttattagtcttgctagtggtctatcaattttgttgatcttttcaaaaaaccagttcctggattcattgattttttgaagggttttttacatctctatttccttcagttctgctctgatcttagttatttcttgccttctgctagcttttgaatgtgtttgcccttgcttctctagttcttttaattgtgatgttagggtttcaattttggatctttcctgctttctcttgtgggcatttagtgctataaatttccctctccacactgctttgaatgtgtcccagagattctggtatgttgtgtctttgttctcattggtttcaaagaacatctttatttctgccttcatttcattatgtacctagtagtcattaaggagtaggttgttcagtttccatgtagttgagcggttttgagtgagtttcttaatcctgagttctagtttgattgcactgtagtctgagagacagtttgttataatttctgttcttttacatttgctgaggagtgctttacttccaactatgtggtcaattttggaataggtgtggtgtggtgctgaaaagaatgtatattctgttgatttggggtggagagttctgtagatgtctgttaggtctgcttgacagtggagtgttaaagtctcccattattattgtgtgggagtctaagtctctttgtaggtctctaaggacttgctttatgaatctgggtgctcctgtattggttgcatatatatttaggatagttagctcttcttgttgaattgatccctttaccattatgtaatggccttctttgtctcttttgatctttgttggtttaaagtctgttttatctgagactaggattgcaatccctgcctttttgtgttttccgtttgcttgataaatcttcttccatccctttattttgagcctatgtgtgtctctgcatgttagacgggtttcctgaatacagcacactgatgggtcttgtctctttatccaatttgccagtctgtgtcttttaattggagcatttagcccatttacatttaaggttaatattgttatgtgtgaatttgatcctgtcattatgatgttagctggttattttgctcgttagttgatgcagtttcttcctagcctcgacggtctttacaatttggtatgtttttgcagtggctggtaccggttgttcctttccatgtttagtgcttccttcaggagctcctgcagtgcaggcctggtggtgacaaaatttctcagcatttgcttgtctgtaaaggattttatttctccttcacctatgaaggttagtttggctggatatgaaattctggttttaaaattcttttctttaagaatgttgaatattggcccccactctcttctggcttgtagagtttctgctgagagatcagctcttaatctgatgggcttccctttgtggggaacctgacctgtttctctggctgcctttaacattttttccttcatttcaactttggtgaatctgacaattatgtgtcttggagttgctcttctcaaggagtatctttgtggtgttctctgtatttcctgaatttgaatattggcctgccttgctagattggggaagttgtcctggataatatcctacagagtgttttccaacttggttccattctccccatcactttcaggtacaccaatcagacatagatttggtcttttcacatagtcccatatttcttggaggctttgttcatttctttttattctttttcctctgaacttctcgcttcatttcattcatttgatcttcaatcactgataccctttcttccagttgatctaatcggctactgaggcttgtgcatttgtcacgtagttctcgtgctgtgtttttcagctccatcaggtcctttaaggacttctctgcattggttattctagttagccatttgtctaattttttttcaaggtttttaacttctttgccatgcgttcgaacttcctcctttagctcagagtagtttgattgtctgaagccttcttctctcaactcgtcaaagtcattctccatccagctttgttccattgctggtgaggagctgcattcctttggaggaagaaaggcactctgatttttagagtttccggtttttctgctctgttttttccccatctttgtggttttatctccctttggtctttgaagatggtgatgtacagatgagcgtttggtgtggatgtcctttctgtttgttagttttccttctgtcaggaccctcagctgcaggtctgttggagtttgctgcaggtccactccagaccctgtttgcctggttatcagcagcagaggctgcagaacagtggatattggtgaacagaaaatgttgctggttgatcattcctctggaagttttgtctcagaggaatacccggatgtgtgaggtgtcagtctgcccctacttgggggtgcctcccagttaggctactcggggttcagggaaccacttgaggaggcagtctgtccgttctcagatctccagctgcatactgggagaaccactactctcttcaaagctgtcagacagggacatttaagtctgcagaggtttctgctgccttttgttcggctatgccctgcccccagaggtggagtctacagaggcaggcaggcctccttgagctgtggtgggctccacccagttcgagcttcccagctgctttgtttacctactcaagcttcagcaatggcgggcacccctcccccagcctcgctgctgccttgcagtttggtctcagactgctatactagcaatgagcgaggctctgtgggcgtaggaccctctgagccaggcacaggatataatctcctggtgtgccgtttgtgaagaccattgaaaaagtgcagtattatggtgggagtgacccgattttccaggtgccatctgtcacccctttctttgactaggaaagggaattctctgatcccttgtgcttcctgggtgaggcgatgtctcgccctgctttggctcatgctcggtgcgctgcacccactgtcctgcacccaccatttgacactcccctgtgagatgaacccggtacctcagttggaaatgcagaaatcacccatcttctgtgttgctcacgctgggagctgtagactggagctgttcctattcggccatcttcacaaaaatcttactttggtttctagtgttaccacccactgttctttctcatctcaaccctgagtataagtacagatcacattccttgggttcttagaaaataatagaaatgaactctcattcatcaaaatgcccattagtaaatactgagggagaacaaactagaaatccagtatagaaaataaaaataggattatattccttggaatctcagaaaaaaacaatgaagagctttctttgggcattagacactttcccataaggtggctgactctcttttagtcatgtcagcttggcccaatcttcacttggtagcccttctttcttcttcattaatccatctcctatgctcctatggggtcctagagaaatgcccatcatgtacacacacatctaataacacaaagatcactctcgactagcaagcccttttatgatggtgtgagcatttgacacccttgttgctagtaacatcagtgagtgacctgacccatttttggaacagaatatgatcagtatgttgcctcaaggaggccctcactgttctaggaaatataattccagagtttgctgactcacaccatggaatatatgcataaaatggatcctgcagataagcctttctctgactagtttcagacatttttttctgggtaattttaaagttattttttatttttgtgggtacaaagtaggtgtatatatgtatgaggtacctgaggcattttgatacaagcatacagtgtataataatcaccagagttaatggggtatccctcaccacaagcatttatcctttctttgtgatacaaacaatccaattatattcttttagttattttaagatgtataataaattattgttgactgcagtcaccctgttgagctatcaaatactagatcttattcattctaactatacttttgtacccagtagccatcccacttcctcccctcccactacccttcccagcctctgataaccatcattccactctctatctctatgagctcaattgttttaagttttagctcccacaaatatgtgagaaaatgccaagtttgtctttctgtgcctggcttatttcacataatataatgtcctctagttccatccatgttattgcaaatgacaggatctctttcttttttatggcttaatagtactttattgtatgtatgtaccacattttcttcatccatttgtctgttgatagacaagagttgcttccaaatattgactattgtgaatagtgctgcaataaacgtgggaatgcagatctctttgatatactgattttctttctttagggtgtatacccagcagtgggattgctgggtcatatgatagctctatttttagtattttgtggaacctcaaatctattctacataatggttttactgacttacatatccaccaacagtgtatgaggatactcttttctccacatcctcaccagcattcattactgcctgttctttggatgaaagccattttaactgtggtgaaatgagatctcattgttgttttgatgtgcacttctctgatgatcagtgaggttgaggaccttgtcatatatctgtttgtcatttgtatgttttattttgagagatgtctacccagatcttttgcccattttttaatcagattgttagattttttttttcctacagagtgcttgagctctttatatgccctagttactagtccctggtcagatgggtagtttgcaaatagttgctctcattctgtgggttgtctcttcactttgttgatcgaatcacttgctgtgcagaaggtttttaacttgatgtgacctcatttgtccatttttagttgcctgtgctggtgcggtattactcaagaaatttttgcccagattaatgttctggagagtttccccaatgttttcttgaagtagtttcatggattgatgtcttagatttaagtctttaatatgttttgattttatttttgtatttgctgagagatagggctctagtttccttctgcatatggatatccagtttttctagcaccttttgttaaagagactattcattctctaatatacgttcttggcacctttgttgaaaataagttcactgtagatgtatggacttgtttctgggttctctgttctgttccattggtctatgtgtctgcttttatgtgaataccatgttgttttggttgcaaaagctctgtagtataatttgaaatcaggtaatgtgattcttccagttttgctctgttctttttcctcaagatagctttgcctatcctgggtctcttgtggttctatataaattttaggattattttttctatttatgtcaagaatgtcattgatattttgatataaattgcgttgaatctgtagatagcttcaggtagtgtggacattttaacaatatcaattcttgaaatccacgaacatggaatatccttctattatttggatgtcttcttcaatttcttatattaatttttttttagttttcattgtagagatatttcatttatttgactaagtttattgctaggtattttattttatttttacctattgacaatgggattgctttcttgatttcttttttagattgttcactgttggcatacagaaatgctactgatttttatgtgatgattttgtatcccgcaactttactgaatttgtttatcagttctaataggcttttggtgcagactttaggcttttccaaatataagatcatattatctgcaaacaagaataatttgacttctttcttttcaatttggatgcctttcatttctttctcttgtctgattgctctaactaggacttccagtactctgttgaataacagtggggaaagttaacatccttgttttgtttcagatcttatagccaaggccttcagtttttctgaatttagtatgatactagctatgggtctgtcatatatggcttttattatgttgaagtatgttccctagttttttgaaggtttttatattttaaggaagataaaaattgaactttatcaaatgcttttcatgcaacaattgaaatgatcaagtgctttttgtctttcattctgttgatacgatgtatcacactgattgacttgtgtatttagaaccatccttgcatcccgtggtaaatcccacttagtcatggtgaatgaactttttaatgtgttgttgaattcagtttgctagtattttgttggggatttttgcatcagtgtttatcagggatattggcctatagttttccttttttttatgtgtcttttgggttttgttatcagggtaatactggccttgtagaatgagtttggaatgattctctcctctattttttgaaatactttgaataggattgatgttacttctttaaatgtttggtaaaattctgcactgaagccattgggtcctgggctttttactgctggggagacttttcattacagcttcaatcttattacttgttattggtctgttcaggctttagatttttttcatgaatcaatcttcacaagttgtctgtttctcaaaatttatcaatttcttctaggttttccaatgtattgtcatccagttgctcataatgccctctaatgatgccttgaatttttgcagtaaccactgtaatgtttccttttttaatctctgattttatttgagctttctctttttttcttagtctagctaaatatttgtcaatgttgtttgttcatccacaaaaccaacttttcatttcactgatcttttgtattattttttccttttaattttatttatttctattctgatatttatcatttcatttcttccagttatttgagtttggtttgctcttgcttttccagttctttaagatgcattgttaggttatttatttgaacttttttgatataggtgcatattgctataaactttcaccataatattgcttttgctgtatcccataggttttagtatgttgtttagtatgtttccaatttggtacatttcaataaatttttaaattttcttctttatttattgacatagtcattccagagtatactgtttaatttccatgtggtttgtatagtttccaaaattcctcttgttattgatttctagttttattccattgtggtcagagaagaagcttgatatgaatgcaattgttaataatttttttaaaacttgttttgtgacctaagatatgatctgtcattgagaatgatccatatgctgaggaaagaatgtatattctgcagccattggataaaattgtctttaaatatctattaggtccatttaagacataatgcagattaaagccgatgtttcattgttcatttttctgtctggatgatctcttcagtgctgaaagtggtgtgttaaaatctctaaatattattgttttgggatctttctcttctttcaactctgataatatttgctttagatacctgggtgctccagtgttgggtgcatatatacttaaaattgttgtatcctcctgatgaattgacccctttatcattatataatgaccttctttttctctttgtgtagtgtttgtcttgaaatctattttgtcggatattagtattgctgctaatttttttggtttccatttgcatgaaatatctttttcattcctttattttcaggcagcgtgtttctttatatttaataggtgaaatatgtttcttgtaaataaaaattattattttaaaatatttttaaaataatactattttttaataagaacaattattattttttaaaaaatttcattagttttgggggcacaagtggattttggttaaatgggtgagttctttagtagtggattttgagattttagtgcagcagccacctgagaagtgtacattacccatatattatatatatactatatatgctttatatatatagtgtgtatatataatatatatacaactacatattgggtaatgtacacttctcaggtgactgctgcactaaaatctcaaaatccactactaaagaactcacccatttaaccaaaatccacttgtgcccccaaaactaatgaaattttttaaaaaataataattgttcttattaaaaaatagtattattttaaaaatattttaaaataataatttttatttacaagaaacataattcacctattaaatataaagaaacacgctgcctgaaagtaaaggaatgaaaaagatatttcatgcaaatggaaaccaaaaaaattagcagctatactaatatattatatatatactacataaagcatatatatagtatagtatatatataatacatttataaagcatatatatagtatgtagataatatatgtttatatactttaagttctgggatacatgtgcagaacgtgcaggtttcttacataggtatactcgtgccatggtggtttgctgcacccatcaacctgccatatacattaagtatttctcctaatgctatctttcccctagccctaccccactccctgacaggccctggtgtatgatgttcccctccctgtgtccatgtgttctcattgttcaactgccacttatgagtgagaacatgtggtgtttggttttctgttcttgtgttttagtttgctgaggatgatggtttccagcttcatccatgtccctgcaaaggacatgaactcatcctttttgatggctgcatagtattccatggtgtatatgtgccacgttttctttatccagtatatcattgatgggcattttggttggttccaagtctttgctattgtgaatagtgctgcaataaacatacgtgtgcatttgtctttatagaagaatgatttataatcttttgggtatatacccagtaatgggattgctgagtcaaatgatatttctggttctagatccttaatgaattgccacactgtcttccacaatggttgaactaatttatgctcccaccaacagtgtaaaagcgttcctatttcttcaaatcctcaccagcatctgttgtttcctgactttttaatcgccattctaactggcatgagatggtatctcattgtggttttgatttgcatttctctaatgaccagtgatgatgagctttttttcatgtttgttggcagcataaatgtcttcttttgagaagtgtctgttcatattcttcacccactttttgatggagttatttgttttcttcttgtaaatttgtttaagttccttgtcgattctggatattagctctttgtcagatgaatagattgcaaaaattttctcccattctgtaagttgcctgttccctctgctgatagtttcttctgctgtgcagaagctctttagtttaattagatcccatttgtcaattttggcttttgttgccattgcttctggtgttttagtcatgaagtctctacccatgcctatgtcctggatggtattgccttggttttcttctacagtttttatggttttaggtcttgcatttaagtctttaatccatcttgagttaattttgtataacgtgtaaggaagaggtccactttcagttttctgcatgaggctaacgagttttcccaacaccatttattaaatagggaatcctttccccattgtttgtttttgtcaagtttgtcaaagatcaggtggttgtagatgtgtggtgttatttctgaggcctctgctctgttccacgtgtctatatctctgttttggtaccagtaccatgctgttttgggtactgtaccacttgattggtgagagagggaatccttgtcttgcactggttttcaaagggaatgcttcagcttttgcctattcagtatgaccaatatgtagtcttttattcctcaccctctctcaacaccccacccccacggagtcctcaaagtccattatatcactctgtatgtttttgcgttctcatagcttagctcccacttataaatgagaaaatacagtatttggttttccattctttggttacttaattagtataatggcctccagctccatccaggtgtcttgtttttcatccattcagccagtctataacttttgcttggagagtttcgtccatttagattcagcgttatgattgataactaagggcttactcctgccatttggttgttttctggttattctgtggtcttctcttccttttttccttctttcctgtctcccttttagtgaaagtggttttctctggtggtgtattttattttcttcctttttatttttttttgtgtgtatttgttgcatgttattgatttgaggttaccatgaggcttgtacataatattttctaactcattatttcaaactgatgacaacactctatcgcataaaaaaacatggaaagagaaaactaataaaaactctacattttaacttcatctctctgcttgttgtcactttgtcgtttctatttacatcttattgtactgtttatgtcttgaaaagtagtttcagttattacttttgattggttcatctcatagtctttctactcaagatatgagtagttcacacaccacaattacagtgttacaatattctgtgtttttctgtgtactttcaattacccatgagttttgtattttcagataatttgttattgctcactaacatcctattctttcagattaaagagctccctttagcatttcttgtaggaaaagtctggtgttaatgaattccttcagctcttgttgatctgtgaaagtctttatttttccttcatgtttcaaggatattttcactggatagtctattctagggtaaaagttttttttttttttttcttcagcccttcaggtaagtcatgccactctctcctggcctataaggctaccactgaaaagtctgctgccagacatatatgagttccattctatgttacttgtttattttctcttgttacttttaggatcctttctttatctttgacctttgggagtttgattattaaatgccttgaggtggtcttttttggattaaatcttcttcgtgttcttgtacttggatattaatatctttctctaggtttgggaagttctctgttattatccctttgaataaactttctaccaagatctctctttctctctctgtctctctctctctctctctctccttcttaaggccaataacttttagatttgcccttttgaggctgttttctagatctcgtaggtgtgcttcattgtttgctattttttttttttttttgtctcttctgactacattttcaaatagcctgttttaaaactcactaattctttcttttgcctggtcaattatgctgttaagagactctgaggcattcttcagtgtgtcagttgcatttttcagcaccagaatgtctgcttatttttttttagattatttccatctctttgttaaatatatctgatagaattctgaattctttcttagtgttatctttaatttccttgaatttcctcaacacaactattttgaattatctgtctgaaaggtcacatatctctatttttccaggattgctatctggtgctttatttagttcattttgtgaggtcatgttttcctggatggtgttaatgctagtagatgtttttcagtgtctgagcattgaaaagttagatgtttattgtagtcttcacagtctgggcttgttcatacctgccctccttgggagactttccaagtattcgaagggatttggatgctgtgatcttagtctttggtcactgcagccatatctgctttatggagcatcccatgctcagtaatgctgtggctctttcagactcatagagttactgcctgcatgctcttgggtaagagccaggaaaattccctggattaccaagcagagactcttgttctcttctctcactttcccccaaacaaatagagtctctctctctctctctctttctctctctctctctccctctcattctctgccgacctgcctgaatctggggtagggatgacacaatcacatttgtagtcaacaccattgggactgtgctaggtcagacccaaagctggcacagcactgagtctcgcccaacgcccacagagaccactccctgggtaatgtctgtgtttgctcaaagcctaagggctatacaatcagtcagtggtgaagccagcctgtcttatgtccttcccttcagggtgatgagttcctcaagcaggtccagggatggtgtccaggagccaaggcctcgagctgtgactgagctggcacccaatccataagacaaagattttttccacactttccttccttgtcctcaagcaaaggagtctctccctgtggccaccaccacccccatgttcatggcaagtattgtctggctaccaccaatcttcactcaaggcccaggggttctttagttagcttatggtgaatgctaccaaggctgagtctctcccttcaaggaagtgggctcctctctggcccagggcaggtccggaaatactatccaagagccaaggcctggaatcagtttccccaagagtccatttggtgctctacacccactgtggcagaaccagtacccaagctgcaagacaaagtcctctttactcttccttctcctttacagagactctccctatagccaccacagctgggaatatgctgggtcactcttgaagcaagaacagctctgagtctcactcaaaactcctggcaagtactgcctggctatcacactgattattcagggcccaagggctctttagtcagcaggagatgaatcctgccagtactgattccttcccttcaaggcagccggtttctttctggcccagtgtgtatctagaaatatcatttgggagctagggcctggcatggtgacctcaggactctgcctggtgccctgttctactgtggctgatgtagtatccaaattgcaagaccaagtcctctttactctcccctctcctgtcttcaagcagaaggaatgagtccgccctggagttgggagctgcattgcctgggattggaggaggggtggcacaagcactctcttggtcaccccagctggtgtcttactaggtcgcatgttccccaagtccactggctctgaggctagcacaccaggatttgaccaagaattgcaattcttgtggcttacactgcctttcaagtttatttgagatcccagagcactttagcccacagtgacagggcttgccagaatttagtttctgactgctgagatggacaatttgcgtctgattagggctggtctaagtgctccttctgtgggcactggctgagttctgctccatgttgctttctgctgtgacagggcaacattgagtttcaatgcaagtcccacagtcactgcaatcttcctctcccaagcctgctctgaacaccatgtggttgctgctgggggctgggggagggatgttgtaggcaattcaagaatgtctttcctacccttttcggtgcttctttccttggtatgatattaaaaccagttactgtgattgctcacctgatttttggttcttatgaaggtgcttttttgtgtggatcactgttcaatttgtgcctgcaagcggggatgggggacaattgctggaggcttctctttggccatcttgctccacctctaccctagtattagcaatttcaaagcagttgggatggaggtagaaggaaagggcgcttggaatcagaaaatccatgtcttagctttgagccttagaaaattcatttgacccttgtaagcctcagttgcttcatctgtaaaagagaaataatataatggctgaaaagatcaaaggtgataatgcttttgaaaacactatagaaaatgacaaaatatcacatgagtattattttctagtttctaggagtctccttaccattgtacaggacaaccatgtctatttttaaataaattattatttgcctctgagcaaccctgcaaagagttgcctgtaggagaaacagctttacttgcaaatcactccactgttttctttgtgcacagcttattaatacataaggcacatgtcctccagcctgcagtaacattggaatcattacctctttggagtacctaccagagcttctcaaagtgaattttgtttatcaccacaaaaaatagtctgttgcagagataacctccaaattcaatgacaatatttccaatcacttttgcatgatgcagaaatagacaaatatataattttgcttatagagacaattattgtctcccaacaagtgatcagtagtcagaaaatggccaagaaataccatggggtgtgccttcccataacagcttatctttgtgttttagttgcaaggttactaaaagcctgtgcagggtttatggcaaaagtaaaacttgctccaggagcaagcccttgtttcattgtctaatgttcttaatccccagcagacaggatttggatctggcatttggtaacagggcagtttccaaagttgctgtacgcaacttgaggaagagaggtgatattatcggaatgaatttctttgttgtaagttataaatgtatgggcttttccaatcccatcacccttaaaactttatttgttttctgcagtgagggtgtctccgttgtctttaatatgcttgctttgagttcatggatgaacattcctgcctggctgacatgtggactctctgaaattgttataaggtctttttctttgtttttttcttgatgcccaagctgccaagggtagtactggcagtggtgggcagacaaggaggtgatagcaaactttgtcctctggcctcccttgacccattccattcattatctaagggactccaagccagcattccacagagtgccctcaccaaactcactaagactgaaggcgaaccaggattccaaacagccattatgaaaggaaagagagagagacttagggtttgcaaaataagataccctgttgattctttttattccatacagatactactattctttaggaaaacgttaaaatcacatgatcttccaggacctgggctgcttctttaagaagcatgttacagaaagctttattggccaacaacatattgaaagatagattaatcaatcattcattcaaataaggtatattcagaattgaggtatattgtagccagacagtgagactacaaaaaaagaatgcaccgtacccttatctcttgcacaatctaacgagggagataaccactctttcaatttatagtgacctataacatttcgtacactgctgaatatctttacatggtaataacacaatggaaagcttgcaaaatagacagaggctaggggaagaaggattgagtgtgaatatagcctcttataaatcgagaggaatggtctgtgtcttctgatcatacagagataataaatatggaaatgatttcaaactaacaaagcaaatgtgcagaaaatactgagaatatagtgggcaggatacctgagttttggttccatctctgttattgactcattgtgtaatctgagtcaggtctgttctgctctctggatctcaccctttcctatctgtaaaatgagattgttggattagatgatctccatagaggttctcacctattctgacattcaaaaggactcctaatttttcttatataataataatatatatgatctgtagagtgctttacactttatatgatatttttgcatctgttatctcatgtgagaaaagcactggactgctggactggcaatgaggacacctggattcttgtctctgttttgacactgattcatggtgtgatcttcaagcaaattctctgagtttcagtttctcaatctgtaaaataggggggtatgaagattggactaaatcagtaggtctctaaaatgttccacaaagccctggggtggggggctcctacagagtttcgctaaggcaaaccacaacgctaagcctgcatggaagaggagaaaaagagtggcctgacaagagaagttcccagtttcctatgccaaccccaggcagattacatttaattttatctgatttatatagagagtttctatgtaatgttttattcttaaaaatagtttactataaaaaactcaactggtttgatttttaaagattgcacatataagtgagatcatgcagtcagtatttgtctttctatgcctggcttatttcacttagcataatgtcttccagcatcatctatgttgctgcaaatgacagacttttcttttcattaaaggctatatagtattccatcgtgtatgtacaccacattttctcttttgtaactttcattttaggttcaggggttcatgtgcatgtttgatatataggtaaactgcatgtcagagaggtttcttgtacagattatttcatcacccaggtaataagcatagtatctaatcaatttttttctgatcctctcccttctcccaccctacaacctcaagtaggccctggtgtctattgttcccctctttgtgtccattacaccacattttctttatccacttatccatccatggacacttagtttgcttccatatgttggctattgtgaataatgctgaaaaaagtcaaactcatagaagcagagagtagaatggtggttaccagggactgggaggcagttgactgagctaggaaaagagagataataaaagggtacaatgtgtcagttatatagaaggaataagttatattgaactattgcacagcatggtgaccatagttaataataatgtattatatgtctcagtattgctaaaagagtaaatttaaatattctaaccacaaaaaattattagtaggcaaggtgatggatatgttaatttgcttgatttaatctttctagaatgcatacatatatcaaaacatcccactgtaccccataaatatatacaattattatttgtcaatttagaaatttaaaaacttgatttagatgagctctaaggccttaagtattaaagtattaagtattaaagtgatatgtaaccaagtatattgtttggtaacttcatttttgttattattttaacaaaccaatatattgtgaatatacttccaagtgaaaagaaaaaagacattgcagtcatcactaataactgcaaaacattcctttgcaagaatatggaataattcatttaatcattcccctaatgttagacattcaaatgtttccaactttttctatttaaataatgctacaataaacttctattttgtgcttattgtattattttcttacaacacatccctagaagtggaattcctagaagtttatacacatttccaatttttttccaaatatatggcaaaatttctctctaaagtatttttattcctaccagaaatacctcttcaccaacacgtagtatttaatctgtaccaatctggcttaagacaatgatatttaatttgtatttctgtgatttctagctaaattaaataatcttcatatgcttattggtcatttgtacttctaactgctttctcctgtctgttgcccatttttctattgtgctgtttatttttatatatcgaatatattgaccattggttttacatacttgatgctaataattattcttagtttatggtttgtctttgagttttataatggtgtttatttcacataagaaattataaatgttttctaatgaaatttatcaagtctgtcttcacttatgttttcttcattgtcaataacttaaaatgaccttttctacctttaaaaattttgaaattttcctctgtattgtctaatagtacttacatgatttcctcttttaaattgacatatttaatccatttggaatttattttgattttaactagtaatttaactttattttcttctccaaatgattcactagttgttctgacattatttagtgaataattcatcctttcttcactgaattggaatggcatattccatatactgtgtctggttttggcttttctgatctcttccactgatcaacctaagctggagccagtatcaaactgttgtaatcattatgcctttagatactttaaatgtacagcagggaatgtcttattactcttatttttcacaaatatcttggcattgtctcatgttttattccttcagataaattttgggattattttgtcaagattttgtttgagttgttttaaatttttagatttcattgggaaagaactgaaatccttgaaatattgcttcttcttagccaggaatatggtacaactttgcatttaattcagttctttccttaaataccaccatgaagttttttgttttgttcatataggtcctgcattaacaccatatatataaagtgtgagaaatactacattcttcaggattctctgtaggttaacaatgaagatgatgactcaaccctttctttgtttgcataatgtgatgccactaatagtgggtaacttctctgccttacctcctctgttccaaacaggatttttcagaatgaacaaattaaaagaatcataatcagacactaaccccaagccatactgcatggcagcaccaatgggactgacagaaaacaacagaaataggaagaaatcctacagagaaacaaacttgaaagctgtctcatggcctttgaatcatacttaagttttatgatggaaggatacgactatgaagaaagacacagagcaacatcagacagtcaagaatttcagagccagctggcatgcagtggacctcatgccagcccattttatgactatttaggtagtcaagggtttaagatttttctaataagacagttattatgcatttcaatgagtgatttctttgcagctctagagtgtggccttacctacttcaacatgagaagatttttgtattttgtcagtcatttcacaatgacttttagtgagcccttcattatagactgtggatacaactttgctgttggaaattaacagtgtcaaacaactgggtataatgtttgtaatatctgaggagggggagctgcctaggaagttgtattccctgtgttaatttttcagtctcttaggttatagaggaccttctagaaccaccttacagcaggattacatcccatttacacagttctctgtcacttgaatacagagaagggatccacaaggccatatgcttcctagacaaagagaaaagatttctgccacactcagaacgctttgtcttcagactataatcacccacaccatatttcctttggatccactttccagatttttgtgctggcactaacaccaacttgctgtggcttggggcatgtaatttcaatactttgtgcccattttcataagtgaagtgtcaggcatcacattggacattttaagattctttacagcccaatgattctgtgtttctaattaggcccaatgggttagagctaaaaggaaacagtgagtttcctggaaggaaaggacatataacacagtccagaggtaaaatgggctgtattcaagaaaagataggacaatactttgcagggatgctgcagagaggattcaagccttgtatggaggaatggatgtgatacaaccaaaaagtctttaaaaattctttccaactaatctgagatttgtaaccttatggactgtgatttgcagcaaaccaaggatgtgataaagactagtattgtttctagaatgcaaggatggttcaacatatgcaaatcaatagtattaacagaatgaaggacaaaaactatatgatcatctcaatagatgcagaaaaataatttgacaaaattcaacatcattttatgataaaatctttcaagaaattgggtattagaaggaatgtttctcaacacaataaaggccatatcagacaagcccacagctaacattatattcaatgaccaggaatgagataaggatgctcactctcaccacttctgtttaacatagtactggaagtcctagccaatttcatattaatgagcctcattttcttcatcatagaatgaagtatataataatccctgttatacttactttgcacagattattattattatttaattattattttgagacagggtctcactctgtcacccaggctggagtgcagtaccacaatcacagcttacttcagccacgacctcccaggcataaaggatcctagcccctcagcctcctgagtagctgggagtacaggtgcacaccaccacacctagctaatttttttttttcatttttttatagagacggagtctcactatgctgcccaggctggtctcaaactcctgtgctcaagcaatctttccaccttggccttccaaagtgctgggattacaggagtgagccactgcacctggccttgcagattattattaaactttgtaaactaatcaaatgagagtgattattgttactgttaagaactctgatagcctcatccatatatttggagaaattgaataaataataggaaagaaataatagcatcccaatgattttaccttggctctaccatcatttggggaagtgataattcagataggagaagtgacttggaagcagtcttgagagattgcctgttccatcccctatctttgtccttaaaccaaattgtacagataaataaggtcttatttttaggacttacagaaaaaagattcctttcatatccatctttgcaatcctcaaccacttctgtcactattatgtgtcatttcaaacattaaattcctcattctgctttgaaggaacacatgtgtcatgtgtacccatttgtatgttttggtgtgttttatgctttatgtgatcacccacatatgcacagataattccaaaatccagtgtgtgggtgttgtattccctgtgttaattattcagtcacactcaaacacctatgcactcacacatacatgaatacacacatgtacattagcatgtttatgcttatgttgcatgtgactggcaacatcagtgcctttctaaggcaatgttaactaccttgagttttgggagagctttagagaacaaagacaagagactaaatgattctagatgtaagagacaatgttgcaataagttactatcctaaaaagacagaatacagggacaagagactattattttggatagtttcttgcttaccagtaatacttaagtcctttacattaaaaaaaaaaaactctgtaaatatattgcagaagaaatccagacatccttcaagattcttagagctggaaaagattttaatgactttccagtccaatctatctcatgtaatcaatggggcccagagaggcaaaaggtcttgtccaaggtcatatagtgagttagtgataaggctgaacaaggattcagatgttggggcttccagcccactgctctttctctcatctgggatttgtgtatttttgttcattagagattttcctctgtaacctcaatatccaatgcagggccttgcacataatagattatcagtaaatgttaaattaatatgtcatggctttggttgtactgggcttttgcacttactcctgagtaaattgtaaagaatatctacgttttaggttgccttgttttagaccaagaggtacccagagaaaaggtgtgaactatgctaaggaaattatccgagttccaaattgaaaaaaaaaaaaaatcatgcttttccgctataacctctctcattcacagagtgattctctttcagaagggcaatctagaactattatgggagccatattccattggtggtgcaaccatttcttgacaaactagggtccaagaaagtattttcctggggaagatgagatttctcaaagaaggcacgcactttctaacctaagcttatttcagtaatcaatgtaacaagctggtcttgatgattgcagcagtaccaatactgtgggagtgtaccagttctagaacagctacaacattggaattgaacgcactagaattggatacaggacctgtttttgaggagctaacacccaaaggctgaacagcactcgtagcaccgtcctttctgtgcacatatggtagtcctcagtttgcaacagaaataaagctgttagcaaattatgtgttctatttatgcaaataaaatcttgtggtatgctagaaagagcactggcctggagaccttagttttctcatatgttaaaaacccctaacacaggcctggttcatagtaggcacccaataaatagtagttttcttcctttgggggcctccgattcagtgtgcttcttcaggtaagtcacttccctggaactcctccttggaatgagagttgtactgttgtgatttttaacagttccttcaagccaagcattttggaatcctttcataaagggagaaaggaaggaaagaagaaaggaaaattaaaggaaaaagaacaaataaaacgttaaaaaggaggaaaggaaaaaggatcctttactacaataaaactaatcttatgttcttgcaagtagcactttaagtaaaagaagttctttgctgacctggttactactgaacctactacataaaatagcctactataatagatgcatttatgtgcctaatcttcactttttaggcttagtaaagggagaggaaagctgatgtatagttaaatttatgtttttagttgtttttttttctactctcaaatatcaatcactctttagtttctctttctttttccgaccacaagcattcttcctctgcttaaagaagcttccctaaaatcccagtctatccagtaagccaaagcacagcaataaatttgaggaaaaaataccagggacttagagacagaaaggagtgaggggatgcagaagctgaagctggagcacggttgcaagcatgagaagttctgcgtgtttcagagcagccaaggatgtatttttgcctattcctgctggtgactctgtgtgtctatgcatccatctgctatatttacatgtttagtcagtcaatccacgtttgctgagagcctgctgtgtgccaggattgtgctagcgtaaaggagcaaagtattgagcaaaatatgtttgagcagctgtaattctgaggatctctaggtctgagcatgtgtatgtgtgtgcgcttctatgtatctgtgacaactccaggtgttcatgacagtgatctttgttactctgttggcttcatcgaacttccttttacttgctgtgattcactacatagagtgggctttatctctgatttttataacctgcaagactgggggtatgatcaccagcaatctaaaaacagttagaaatcccatggagttatcttttgtagaaattttcctctactaatattatgaaaaataagcatcttattagctcgagtgtaattctatgcatgattacaggtatcaataggaagaaacattgactgagttcaaatctcttctacgccatgctaaaggggtgacaagttccacaatggatcattttctcatgggcatttctgacttttggtaaaagtagagcaccttattttaaaaaccattgagtagtcctaatagtggagatatcatcaggatctgaattgttcatccctaaaaaaaacaccaatggaaatcaaacaatatagtgccaaattaaactgtttgaatatttaggttctgtatgatcaaattgtttggtgccatactctgtccacttttttcatgtggtaggatataatttcatatcttttctgttctagaaatacccgaagaaagagactctggaaactcattatcaggtctatcaactcttgtatttgttctcccagggaaacagaagtacctgtgcgccagcagaaatgattgcactattgataaattccgaaggaaaaattgtccatcttgtcgtcttcggaaatgttatgaagcagggatgactctgggaggtaagatacttttctttctcttcctcctccttcctctctcccccttctccctcattttctagtctctctttagaccagattttcttctttgatgcttccaaggggaccagccatgctctagacacaggctgaccctttcataggcaacgtggccatcagccagctggtgccttttttttaatccttatctataccaatccccattccggggctcagcattagagcaggcggtgtgaagcagggatcaggagccaacagaaggtgagtgaggatgcatctgactgggcagggcccccaggggacttaatgatactggcctgatgttgttcagtggtagctaggatgagagaactaagaaatccagaacagtcagaggtgcaggatgacccaggcataggcgcaggatgacccaggcacaggctgatcctgaacacctgggaatatcccttagctaactgctgcctatgttgtagggccagccacctcgaatgagaagctacttctctttggagcctgtgactaggctgccacacagagccaatttcctatcctatctctcccaaagatgagcaggtgttttaataatttccttttctttgcaaagctattgaccatttccaaaagcattttttttcagtagcacagtaacgtgatagatggaagatacagctctttcaagggcgttcctctatcataaggctctctgtcccacaaacctgtctaccatgagtgttgtcaccattccagaaaggcttgacatcagttgattgagacttatattttccctctccaaactcccccatctcttcatgtttacatctgcccaatgccagggtcctcgctgctgcctgctacttccaaaaagatgtgtctttcatgagaaaaacaagatcattaatccacttcgatttggaaatggaatttgaagaaaggcaagcctatttctgagtgcctgcaactgtagcctcatacccaattattcattattagcctggaaaacccaagtgcctagaatccaaccctctcccctctcctcttaagtctaatttagaccagttgtctatctctggctttctgtgaggtgttcaataccttgtctgcctatgtgcacatttatagacaacaactagttctcttatcctggagcagggccatgtgtggatcttcatatagataactatatcctccccatcctcacagggcagtagtattatttaaacagaacaaagtacctcacatgaattgacccaggctggatgagagacaatttcaaaagaatcatctcaagtagcgtccagtactcccaaacatcacaggtagatgttctgtgagtggctttccaagcatccacatcaaatgagactcagatatctgagaaaactcaaccttgttttggtttgcttggtgcaccccaaagaaatccaacaattgaggtctacagtggagaagaagtaggactggggtcagggagtacagaggcaaaggcaggaagggtgacaaagtgattgacaagaaaaaatgttctccatatgaatgttgcagccccatgttgagggttcttatacactcaactgtcaattatttagccttctgtgaattatgtatagtataaaagatagggactctcaagtagggaacctcttggcttgccatctggcaatatgaattgcaagtccactttgatgcaggtaaagtttaatggtaacaaaagtcctcataacatttggatgcaaatcttaacattaattccatgtctcagccaacattctccattattaagcagcctgtgatgtgattacagtgaaccacttttgaaaaggagcctgtgtataacagatagtttcactatactatataaccgtcagatgcaggcttgtaaattaatttgttggtgacaatgtttcagtacattttcaaattgattcattggtatagtactcaaatttgagtgggcttggtgaacacaatgaagacaagctgagaagtgctgtgactggccttcatttcagttgcaggcccatgatattttgagtgtcttccatgtacaaggcaccatgctaggcattagagcttgaggctggcaaacttcaggaagtgttcacaagataccaggattcttgatgttgtgtaaatggccttgcctttagagtcaggcagatctagtttaaaggctcagctcctttatttactgtgtgcccctctgagcctcaatttcctcatctctgatttagaaataccatcctcatagagttataatgagtatcagatgacatgatgaatgtgaacatccttgataaatagcaaaatgctagacaaatatgggggcttaatatgacattgaggtcactagtaatttagctggaaagtctgtaacacagcacttcccgatggcttttaccctaagtaacttggtatgccatataatatgtaacagcaccaacaggcagagaatcgccagaaaacactcttgattacctcaaacgaaaaagtaccaccaggatcctgttcagaagctaattttagtaattaagggaatcatatgctatgttcaaataccatgccagtaaaaacccaattgtttaccttcttaaatcactgcttgaagagcaaatctttccattttgctgaatgaacttatctccacgttccctgccctactgacacaaccccctcccaagtttattgttaacttacacattcaatgcacagcacacctttactcaaacaatggaaaagaaagaaagtgtcaattcaaagtggcccttgtctattccttaaggagtagacttccattttcatcagatttggatttagcatagacatattgattaccttgaagaagaattcatataattttatcttctgattcccatcactcaaatcaaaattacataatatattccaaaatggcaactaggaatgtggccttgggcaagtcccttctctcctctgatgcttggttttcccatcatagaactggaattgtggcttcaccgaggacctttctggtgctaacattttgtgattctatgtaaaaagccacacagaaaggattgtttttcagccctttcttagattgtctgttccctgctcccagaagtatagatagtgagacttgagtgctttgatacatcgtaattgtatctacctccattcacacctacttaagatatctgtctaaaagtagactagacagattattcagagagtggagggcagaagggctgtctctgtatcttaaagaagctggcactcttcagctgatggctgcttggtcttgaggcctcaagatctttaatctggctttctctatagtgtttcattcactgtttggtgatggaatctcttcagttcagagatacttaatagatatagctttttctttcctgcttccaggcctacctacctgtttcttgcttttttttctagcagctgttgttgtttctgaaagaatcttgagggtgtttggagtctcagaatggcttccttaaagactaccttcagactctcagctgctcatccacaacagagatcagcctttctttgtagatgattcattcctggctgcatttgaaaaccacatattgttaattgcttgacgaatttaaatcccttgactacttttcatttcagaaaacacttacaaaaaaagtccaaatgaggaccttccctccagtgaattagctgtggctttctcacagtccatagttaggataaatgtaaagccatttctcatttttctccgcactttccaagggtacactccttgtttccaagatggaatgagaaataaagaagtgcccttcctgccatcttctcccctgaccctttcctccttcccactttcctcctattcctccccaaacatgatttatttctgcgttttgcaactcttgagttctcagcatttagtaaatggtgttggtccctgttgattccttcctctcctggaccatggaaggtagtaggcctttcagaaatttcaggtagcagccaaaccccagaagaagagaaggaacacagagacctagaccatgtgagaacctgaggtgtgcagcatttacttcacagattcgtctagcatatttgagaggtgtctttcctactaggagactgaactctgcatctgagaataaaaacttaacatatctacaggttttgacaacctctgtgaattatctagttgagaggatggctcaaggagcctattgccatggtctgatgtcgttatggacgctatgaacatccttgcagtttccattgttgaagacagccctgatgccagctgtctcatcattccccatgttcaagagcatcccagcattgctacctcaggatcccatgtcctgaatgcaacagagtgatttcgctgctgaattactattcatggcatggctcttcacagcatttattcatccatgtatctatccattcatccttccagccagccaagaagttcacgctttcatcttttcatccatttactcacctatttattcatttagcaaatatttattgagtaccaactatgtgccagacactctgctaggcattttggggaagcagaactgaataagatactattcctttcctcaaaaatttgagcaagaggagaaaggaagtaatgaggaatattccttagccataaaggaaaaataagaaatcacttggaagaagttaggtgagatggaaggaaaaggacatctaaggtaaagcgtacagtttgaataaaggcacagagacatgaacaaaatgcattgagggtttgaggaacagcaattggtttaacatggccagagctggggaaatggtaagggcaagctgaaaccacattgaaagcaaacttggttattatactaggtagtttagacttcaagcagttgaaaatctttgagcatgggataggcatgatgacattgtgtttatttgcatgtttctttaaagaaaactggcagcagcacaaatgttttgttgatgagggtttaaattgtagaaagtgagacaattttaggaaggccagctagagagaaatttctagcatcaaattttgctaaacacctaggatttgtagttacctccatttgggttgttacctgcaagtactgaccacgtatatgaagaagtactggtttagaccaaggcaattggcttgtataagaggcctaccctcataccaaaagccagtttccttggtctaggccagtgtttactggtatgtgtcctgagaaaactagttccatgacatgttccatgaaaaatatgatttctattgtcaaataagtgagggaaacttgcatatcatggtcctgctcaggaagatttacaatccttattagcatatcacaggtcctggtgaatactgcggtaaagtaaccgaggagctttgtaactcaggattcccgaagttgattcaaccacaggacctcatttattcacataacacctgttatcctacaaaaccactgttctctggaatacactttcgaaaacatgggtatagacaaaaactctatcctataggcagagaatacctatacctctagctcaggtcatcattttgcagatgtgtgtgtcattaagaatcagtcaataatgcattaatgatcaaaagcagaccatccttaccacatggtgcataagattatgctattatgctattagctactaatgccactaaagttaattatgttgggtctgcaacgttgtcatacacaaaggataggatgcaaaactgtcctaggccaaagcatggttattgcccaagttatctaatgtctgcaggtacatattcctggcctaaggattgtgctaaagaagttatttctaagaaatatagtgacttccagcatcatgcagaatgaccatttaatattttgaatatctagacattctgctgtagaatttaatagtccttttatacactgtctgaccaacattttgacatttactcagaaccccatcacagtgctaccacataacctcattgctaaagtgggaggcctagaaatcacagatttgtagaaaccatccaatgattgaatcccctctacttcctgttcagcaggcagcagagtgtcataaagaattaacaacgtggaactcagttactgggatttcttccattctcctttgattctctagactagaattccaaagaccctcaggctggtgatgcaagtgggaagtctcatttctgagaagtgctgcttcctacccacaattctttgatagctgagtgctttagctgatctgcataactgaggtgtgcaccaaggagcagaattactctataaattttggcatcaacatgtgcaacttgtgactcagcactttgaaactctggggatttttttgtttggttggtttttgttttaagatgtcctgtggtatagtggaaatagtacaatagactcagatacagagaggccttgtttctagtcttggttctgtcacttactatcttgatgtccttgcacaaatcaccagacctctctgagcctcagtttctccaaccacactgtgggaataataaaatcttttttacggcattgttgtaagtatgtagagaaactggtacacagtaggcacacaatcaatgtcaccgtacccttcagcccttcttttgtggatgaaaaatggtctttgtgctcccagtcaccactggggtctgttctctctctctctgctgttacagtgtggcttttggttcttgtttctttgttctttggtctgtaaattacccttgaaacaacccttgaaatttccactccatgacctaaatcgtcatccctaaattggttacatacatatttggtgacactttggaggggaaaagctttatgtctctctaactgtagttcttaagggaatttgcatatggaaaaaacagagactgcgtctcttaattcctccaaaccaaattatctgggatagcacatatatgttgtactctgtctctgagcatttgctcttagagaactatggttagagcgaagtaaatttttctaatcataaaaattaatgataccgcatatctgatacttgaatgagtacctccttgtaaaatttatacttaaatccttgagtttttaaagtgtaatagcaatagaaagattttattgttgtttacttttactgtgagtgctccaaaatccctcagttgctcttgaaagagcaagatgatgccataggcaatattttccaaaggtagtaggcagaaaactgagtacacagcacacaataggccatatatacaaaagcaagtattttgcaaataataataattcaggaaaaaagcttcactttcgttggtaacctgtttgtttaaaaccattttattatttattatttaaaaagagtgtcacttgttacagattgtgggatgtgttccttaagatcacaaaaatgtaaaatattttctttttatactgaacacatgcatagacaacttacctgagcaagctgctttttggagacatttgcacatcttttgggatcacgttgttaagaagtagaactaagggaaaaacacgcagccacccagaaatcggtagagccttcagctcatctgttattaatatttctgtgacaacagatatctaggaagtaaacaggaaattgcatcgctatcctgcatcaccttttttggaatcaggttccattcttctcagtccagttcaaccttgtgatactttttagatctcaaccaaggcatagaaatatattttcccttgcttaataccccatggaaccaatgcccctgtggttgaagtaaaaattgattgttgagggacatttcagccctctagcagtcaacaattaaaaacatgtaagcaccgagcacctgcagaaaacttggactggcatttggatctaagaagaaaatctgcatcttgaccaagatgaaaagtcaccagcccaagcttgtgcagtgaagtgtcatgttggccacaatgaaactgaaagagactgatgactctcctcagggtggaaaatgaggcatggaagctttgattagtgagctgttaggcacacagacattaatttcaaagcattctcatctccagtctgagtaataatgcttatagtattatgcaattgtttggctgctgcaagaaattcagcagactccaacaagtagtctttcttggtctctgagtgactgtaacttaaattctacctcccttctcttctcctacatcttctcactccccaccccacccccacatacacacaattcttgtccactatgttcagagagatgcacgcacacatatatatgtatatatatagtatatttgtcaataaagcagaaaagaagaaaaaactccaagtaaacaattttccatttccccatctcacttctgtcttacaagtggataggaaaagaaaaacccccagtaaaaaatggcaaccgcccacctccccaactttacatgctgcttcctatgttagaggatctgtcttaggcatctgattatggagcctgctagatacaagcccgtatttagactgctacagtcaacaatgtctctctttcatactagaaaaattccgggttggcaattgcaagcatctcaaaatgaccagaccctgaagaaaggctgacttgcctcattcaaaatgagggctctagagggctctagtggatagtctggagaaacctggcgtctgaggcttaggagcttaggtttttgctcctcaacacagactttgacgttggggttgggggctactctcttgattgctgactccctccagcgggaccaatagtgttttcctacctcacagggatgttgtgaggacgggctgtagaagtaatagtggttaccattcatgtagttgtgagtatcatgattattgtttcctgtaatgtggcttggcattggcaaagtgctttttgattgttcttgatcacatatgatgggggccaggcactgactcaggcggatgcagtgaagctctggctcagtcgcttgcttttcgtggtgtgctgccaggaagaaactttgctgatgggactcaaggtgtcaccttggacaagaagcaactgtgtctgtctgaggttcctgtggccatctttatttgtgtattaggcaattcgtatttcccccttaggttctagccttctggatcccagccagtgacctagatcttagcctcaggccctgtcactgagctgaaggtagtagctgatccacagaagttcagtaaacaaggaccagatttctgcttctccaggagaagaagccagccaacccctctcttcaaacacactgagagactacagtccgactttccctcttacatctagccttactgtagccacactccttgattgctctctcacatcacatgcttctcttcatcagttgtaagcctctcattcttctcccaagccagactcaaatattgtattgatgtcaaagaagaatcacttagagtttggaatatcttgttctctctctgctccatagcttccatattgacaccagtttctttctagtggagaagtggagtctgtgaagccagggaaacacacatgtgagagtcagaaggactctccctgacttgcctggggcctgtctttcccaccttctccagtctgtctaaacacacacacacacacacacacacacacacacacgctctctctctctctccccccccaacacacacacactctctctctctctcacacacacacacatacacacacacttctttctctttcccctgactcagcaacattctggagaaaagccaaggaaggacttcaggaggggagtttcccccttctcagggcagaattttaatctccagaccaacaagaagttccctaatgtggattgaaaggctaatgaggtttatttttaactactttctatttgtttgaatgttgcatatttctactagtgaaattttcccttaataaagccattaatacaccaatcgtattttcttatttacaacagactgagagaattaatgctgttaacattggatcttttttcttttttttttttccttttttttctctctcgtttgctttccaggtcatgctgacctgttcagcttggactgtttcacatttgtttttaatgtcagtttaaatgtaattgtaaaagcatgtatgctctaaaatcatgtagttacttttttcagtggaaaagcctggtattcgaaagcatttccaggctctgcaatttcatatgagcaggtttttggtaaaatcttttgtccctcactcagggtggtatctggacagtgagcccctttcttctggctcagtagtcagagagaggagacttggagacagtttctgctggatcctgtgctttggcaaggatgtgcagcattgcatatcattctatcattaattatgtttactcctccatgaactaaaaaccattagactaaatagtccaacataaaccttgaaagataaaatttgatattcttttgcctggccatttctctgacccagaattggggctgggaggggattggagacttgggggaaagaatcaaggagccttcttgcctgggggaatttggcatgcacttattaatcccatttggttgcactccctactaatccctcactccatacctgccaaggattggctctgctccctgcttctcatccctgtcctagttcttcctcacctatctccatttcccactactgatccttctctccagtaagatgctattcaacccgatgaaatataaagagtagcaccaccctggaagtcaggataccttagttttagctcctgctctaccattatctagctgtgtgacctggggcatgacttaacctttgctcttcagtctgaacagtctttaagaattggtttggaggaggaaggaagggatagacaagatccaaggcctttgaactcttttttggaaatgggtccttttcttcaaacaaaatttgatgcagagtcccaaatttacctacagaataaaatactgctgttcttgtttgaaaggaagtggggtgcttggagccacatgctcaggcccactttgccccctctcaggaaccctcgaaaaaacttataggacttataggactgttggggatctgccaagtctctcttatgttacatttcagtccttgtgaaactctatatgtttcatcagttcactttttcagaaagttcacctgcttggggtaaaggtcatgaagtggagaatgtggggctcagtaactagcaatagtaaaaaacatcattgattggcttgcagaatttactctgttctaagcatcttacacacatactcatccgaaaactcacaacaaccttgtgaggtagatctgttattatcttaagattctgaaacctgccagcatgactctcaatctttgacttgagaccagttgcccaacatggaaggttatacttttcacagtttaccaccataagcagtctttcagagtgatttctagctagagatccattcttagaaaaagtcagaacctgcccattagcatacactgtcacatggtgcagagtaccttcactgggttcatctcatttcctcctaaaaatagtcctatgcagtagtccagtcatatcatcaccattatatagatgagaaaaactgaggtgtaggagaaatcaagagatctgttcaaggtcacacattccataagactctgaataccaccatcaagaataataaaccttttatgtgaaaagcattttagaacttcagtgtcattattgcattctgcctcctggagttcagtgcactttttcaccatgctttaatcttggagtcctggtggtacagaatctgccttctactctcagacaacaccacagtgtctttatccctcataacaaacttatgaattaagtaatgatattatccccattttacaaattagttaactgagataccaagaggctaagtcttgcccaaagtcacacagctagtcagtgatagagccggagttacaaatgaggcatcctgactccagaatatttgctcttaactactactctttatacatatgtaaggaaactaaaagcaaaagagggaaagatgtccctgaggccccacagtgagctcccctgactcacaatccagtattcctctgaccttctaatcctaaagttatacagtaaggtcccttgactctaatcctagtagatggaaagatggctggcatgatttaagccagaggccacaaactggcttccccagagccagaattcacctgcagaattctgtttgtccagcacagtgtttgtttagaaaattgacgtagactgcccctaggcagggcatcaatcactgtcattgtccccagccctccttatttatgtttgccaggcttttttactcatttatgtgtctgcctgacttgtgaaggtatttgagtttatgacttttagatttaagcattgcaatatataagcactgcacacatgcattcacaaaagtatagcctagtctagcttcacaaagaatttgtagccctacaccaaacacacctttatgtttacttagtgtttagaattagatttaagatcagaatttagtttcacaggcattcatgtgtggaagaacctcagttattgttttttgtttcatactgtctcacccttgctttccctgctgtgtctggacccctgtcaatcctgctttctgccattcttcatgcctgagttagggcccctgcaagccattcactggttaatctttaggaatgaatggagagtgaaaaccagtttggagggttcactgtgtcccaagcatcctctcatttagttctcataagtgtcctaagagacaggtagcagcacattcgttttataaatgaggaaactaaatctcagagaagctgaacaaagacctcaaagtcattaaggtagtaattaacggagccgggatttgaacgcaagactgttggactccagagcctattcttttgccctacaccacagttccttacaaggaagatgtattcattttctattactgcataacacattgccacaaatttagcagcttcaaacatttatcagctcactgttttgtaagtcagaagtctggcacagcatggctagattctcagttcagggtctctgaaggatgaaactgatgtgtttaccaggatgcattctaatctgaagctcagggttctcttccaagctcatgtaattattgcaggattcagttatttgtggttgtaggactaaggctccctcttcctttctggctaccagccaagggccattctcagctcttggaggctgccctctttccttatcatgtggaccccaacgccttcaaagccaacaacagagactcttccttgtgttgaatgtttctcactctacggatgtctttcctggaggatcccagtcccgtaagggctcacctgatgaggtcaggtacatcaagaatagccacccttcaaattcaactgaattagcaccttcattacatctacctagcctttttacaacagcatctaggttagtgcttgactgaatgactggaaactaaggtctcagaatctcggggaccgtcttagaagtcagcctactacagatgttgattcttttcatgtgtcaaatttcatagtgagatagggagaacagaaacatcacatccttgaccttaggtaaagggattcaaacttcctaagactttggaaacttcacgccactttcaccttttccttaatcatggttgagaaggcctatatcttggagtggccaggagtgagactggaacagtacctaaaggttaaggacgctaaagaagttacagattggttacatctgctcctccctaggaatgatccatggaacctgatttgaaatttttttctctggtgctatagatagctcccacaggggtctaatgccccagggctgaaaagttagttccccataggatccatccaggcatgatatcaggccaggtgttacaatctcctaaagaggaggtatggactggaaagccccttgccaatggccctttcttgtcactgctctgacccaagactaacagggcagagatagtgaactcacatactattaaaactatccacttatacttccccctttctctttgctttatcactccatttaagtaaaccaatgagtctctgccttgacacagtggcaagctgacctgtatcttatatgaaagaattagatttgactctggggctcaggtgcagagggcaggaggggcataaggatggccttcatggaagaaaagaagtccttggatactgagtaacagctgagactagcaagcctcattgtccaggattccaagtcgtctagcaacatcctggtctctgctgcagacagaacagaggatcccccggcagaatgaatggagtctgatttcaattacgttcagtatagtcactctctttaggcagagaagccagaacacctggtgcagctagggccactgtggtcacagggacaagcacactacctgggtcctggaggcaagtgggaatgcagtttttcttccttaagcagatgccatataggcctggggaggaggatgtgagaataccagccaagttctcattggcactatacagagaaaggggaattatttcatcttgatggattctccccacagtctctgcacatattgatcttacttgtaatgagtttgcttaggttcacgagtcatcatcccagggagatctgagtcattggtgggaaagtcgaggcgacagattatatctcactgatctcactgtcaccaattgctctgtgtgtccctccaccttttgaaaaagtccatggattcatttgtgtgtaattcatttggatttatttcttctttatcaatagctttagtggggtattgcaaatgggaaagttgccccagagaacagtgtacattcacagcattattcagtagaactttctgagatgatgaaaatcttctatatcttatgttgtacaatataatacagccactaactacatgtagcttttgaacactggaaatgtggcaggtgagactgagggattatatttttaattttttaatgttgtaattaatttaattttttaaaatttttgctttctattttatagtttaataattaaactaaacttacgtagcccacatgtggctagttggctactatactggacagtacaagtctagaaggatctcagagagacacatgctgagatacagcaggaataagtcaaaaagagagccaatgtaacatagggaattctggattgggaattagagccctggctctaatctcagctctgccactaggtgaccttgccctctctggcttcagcctccccatctttgacttgaaaggttaaactaactaacgtcgaaagtcccaaaatggtggctatggactgaattcaattttgggatacacaagtttcaggaattttttaaaaatctattaatgccttctaggtgtgtgtatgcacgcttgcagacatgtgcccatgcacaagcatgggaaggcagtaaggcattcatttcaattcaccagtgtactaaccattcacacacacacacacacacacacacacacacacacatgcacacacaccctactgtattgcctatgtagagcctgaagatcttttaatctgtcaccattggataagataatttctaaggacccttcctgttttgtcatgctgaaaatctttaagccactatagtgtcccaaatctattccagtttgggcagatgactggagtattctcatagcctcctgtctattcccttctggatttgatactagttatgaagtttggagtcaagggtgaagaagggaggcagggatgatataaccccagccccactcctcaactctgcttttgagttagaagtagggttcagggcttcagattccttggggaggcagtagagagaatatgggctttataatcagaagatgaggttcagatgattgggttctcaccttttttatagctgtgttacctcagtttattcatttgtaaaatagggataagaaatatctttaacctcctaagatcatgtggaattaagtgatgtaatgtgatgaagcgaggcacgcagaaggccctgaaaaaattagtagttacccttaaggggactaaatggtctggcaactcccgagctcaaagctagaaaggtccagtaatggggaagatggggtctttctgtaggaactgtagcaggggagcagatcctgtaggccaccagtctgtggagctgtgtccaagaactcatgtttgcaataagcccaccaaatgacaagttattgtggggttcaggcctctaactcaagaagatggtcttggcccagatcataccttgcagcctgtgcctttggtgggatgtgggtgttggcagtggctatgcatatctccttattactggctgtgccaaagccccgcagaaatgattgttggacaaagtcatcttgcactcagggctggttttccaggcttccttgttattttcccctgagttcttctgtgttcctcttgcaacaccaaccccactattttcctcttccctaccctagttgttggtccaaacatgtaatccattcttgcagtgatttattgggtgacaccatgactggagtttgcattgaaggacttctttttctaattagaactaaaagtcagttccaggctgggtgtggtggctcacgcctataatcccagcactttgggaggccgagatgggaggattgcttaaggccaggagtttgagtccagcctggacaacatagtgagatcccatctctacaaaaaatgttaaccaggagtggtagtgtacaactctggtcccagctacttgggagactgaggagggagaattgcttgagcccaggaagttgaggctacagtgagctttgatcgtgccactgctctccagctgggtgacagaggaagatcctccttcaaaaaataaataaaaactaaaaaaaaagtcagttccaggttgtatcttttttcacaggggccagacacagatgagagcaggttttgttgtatttatccatttaaattgagcaataaaattctctctttggtttctacctttcttatttattattattatgttaaagggattaaagtggttcatggtctttctcagtgcaactgcttatgctagacctcagaattatgaccttttcaattatttatatttctgtctatataaatactggaaaaaatagtacaaagtaagcatcggaatgcctaaggacctctaaattgtgtgtgtgagcacatggggaagatggttcttaaggtttgagttttggattattgtggttgtcttaaataatgttatttctatcattctttccaatgactgtctcctagcatagttcccattttacagactgatggcagaggcagaaagattctctcacttctttgatactattgaggacttcagcctttcaccgctcttctcccctttgctaaaaaagaaaaaaatcaatatgtatgttacagtgcatttttttaaatattttttattatactttaagttctagggtacgtgtgcacaacttgcaggtttgttacatatgtatacatgtgccaagttggtgtgctgcacccattaactccttatttacattaagtatatctcctaatgctatccctccacccttccccaaccccacaacaggccccagtgtgtgatgttccccttcctgtgtccaggtgttctcattgttcaattcccacctgtgagtgagaacatgcagtgtttggctttttgtccttgagatagtttgctgagaatgatggtttccagcttcatccatgtccctacaaaggacatgaactcatcattttttatggctgcatagtattccatggtgtatatatgccacattttcttaatccagtctatcattgatggacatttgggttggttccaaggctttgctattgtgaatagtgccacaataaacatatgtgtgcatgtacctttagagcagcatgacatataatcctttgggtatatacccaataatgggatggctgggtgcaatggtatttctagttctagatccctgaggaatcaccacactgacttccacaatggttgaactagtttacagtcccaccaacagtgtaaaagtgttcctatttctccacatcctttccagcacctgttgtttcctgactttttaatgatcgccattctaactggtgtgagatggtatctcattgtggttttgatttgcatttctctgatggccagtgatgatgagcattttttcatgtgtctgttggctgcataaatgtctttttttgagaagtatctgttaatatcctctgcccactttttgatggggttgtttgtttttttcttgtaaatttgtttgagttctttgtagattctgggtatttgccctttgtcagatgagtagatggaaaaaattttctcccattctgtaggttgcctgttcactctgatggtagtttcttttgctgtgtagaagctctttagtttaattagatcccatttgtcaattttggcttttgttgccattgcttttggtgttttagacatgaagtccttgccggtgcctatgtcatgaatggtattgcctaggttttcttctagggttttatggttttaggtctaacatttaagtcttgaatccatcttgaattaatttttctataaggtgtaaggaagggatccagtttcagctttctacatatggctaaccagttttcacagcaccatttgttaaatagggaatcttttcccaatttcttgtttttgtcaggtttgtcaaagatcagatggttgtagatacgcagcattatttctgagggctctgttctgttccattgatctatatctctgttttggtaccagtatcatgctgttttggttactgtagccttgtagtatagtttgaagtcaggtagcgtgatacctccagctttgttcttttggcttaggattgtcttggcaatgcaggctcttttttggttccatatgaactttaaagtagttttctccaattctgtggagaaagtcattgatagcttgatggggatggcattgaatctatgaattaccttgggcagtatggccattttcacgatattgattcttcctacccatgagcatggaatgttcttccatttctttgtatcctcttttatttcattgagcagtggtttgtagttctccttgaagaggtccttcacgtcccttgtaagttggattcctaggtattttattctcttagaagcagttgtgaatgggagttcactcatgatttggcttctgtttgtgtgttattggtgtataagaatgcttgtgatttttgcacattgattttgtatcctgagactttgctgaagttgcttatcagcttaaggagattttgggctgagacaatggggttttctagatatacaatcatgtcatcggcaaacagggacaatttgacttcctcttttcctaattgaataccctttatttctttctgctgcctgattgtcctagccagaacttccaacactatgttgaataggaatggtgagagagggcatccctgtcttgtgccagttttcaaagggagtgcttccagtttttgcctattcagtatgatattggctgtgggtttgtcataaatagctcttattattttgagatacgtcccatcaatacctaatttattgagagtttttagcatgaagggctgttgaattttgtcaaaggccttttctgcatctattgagataatcatgtggtttttgtctttggttctgtttgtatgctcaattacatttattgatttgcatatgtggaaccagtcttgcatcccagggatgaagcccacttgatcatggtggataagctttttgatgtgctgctggattcagtttgccagtattgtattgaggttttttgcatcgatattcatcagggatattggtgtaaaattctctttttttgttgtgtctctgccaggctttggtatcaggatgatgctggcctcataaaatgagttagggaggattccctctttttctagtgattggaatggtttcagaaggaatggtaccagctcctccttgtacctctggtagaattcagctgtgaaatccatctagtcctggactttttttggctggtaagctattaattattgcctcaatttcagaacctgttattggtctattaagagattcaacttcctcctagtttagtcttgggagggtgtatgtgtcgaggaatttatccatttcttctagattttctagtttatttgcatagaggtatttatagtattctctgatggtagtttgtatttctgtgggatcggtggtgatctcccctttatcattttttattgcatctatttgatttttctctcttttcttctttattagtcttgccagcagtctatcaattttgttgatcttttcaaaaaaccagctcctggattcattgattttttgaagggtttcccatgtctctatctccttcagttcttctctgatcttggttatttcttgccttctgctagcttttgaatgtgtttgctcttccttctctagttcttttaattgtgatgttagggtgtcaattttagatctttcctgctttctcttgtgggaatttggtgctataaatttccctctacacactactttaaatgtgtcccagagattctggtatgttgtgtctttgttctcattggtttcaaggaacatctttatttctgccttcatttcattatgtacccagtagtcattcaggagcaggttgttcagtttccatgtagtagagtggttttgagtgagtttcttaatcctgagttccagtttgattgcactgtggtctgagagacagtttgttataatttctgttcttttacatttgctgaggagtgttttacttccaactcagtggtcaattttggaataggtgtggtgtggtgctgagaagaatgtatattctgttgatttggggtggagagttctgtataagtctattaggtccacttggtacagagctgagttcaattcctggatatcctttgtgtcttgttgatctgtctaatgttgacagtggggtgttaaagtctcccttgattattgtgtgggagtctaagtctctttgtaggtctctaagtaatcactttatgaatctggttgttcctgtattggtgcatatatatttaggatagttagttcttcttgttgaactgatccctttaccattatgtaatggccttctttgtctcttttgatctttgttggtttaaagtctgttttatcagagactagcattgcaatccctgcctcttttggttttccatttgcttggtagatcttcctccatccctttgttttgagcctatatgtgtctctgcacatgagatgggtttcctgaatacagcacactgatgggtcttgactctttatccaatttgccagtctgtgtcttttaattggagcatttaggttaatatttacgtttaaggttaatattgttatatgtgaatttgatcctgtcattgtgatgttagctggttcttttgctcgttggttgatgcagtttcttcctagcctcgatggtctttacaatttggcatgtttttgcagtggctggtaccggttgttcctttccatgtttagtgcttccttcaggagctcctgtagtgcaggcctggtggtgacaaaatctctcagcatttgcttgtttttaaagtattttatttctccttcacttatgaagcttagtttggctggatatgaaattctgggttgaaaattcttttctttaagaatgatgaatattggcccccactctcttctggcttgtagagtttctgccaagaaatccactgttagtctgatggcttccctttgtgggtaacccgacctttctctctggctgcccttaacattgtatccttcatttcaactttggcgaatctgataattatgtgtcttggagttgctcttctcgaggagtatctttgtggcgttctctgtatttcctgaatgtgaatgttggcctgtcttgctaggttgggtaagttctcctggggaatatcctgcagagtgttttccaacttggttccattctccctgtcactttcaggtacaccaatcagatgtagatttggtcttttcacatagtcccatatttcttggaggctttgttcgtttctttttactctttttttctctaaacttctcttctcgcttcatttcattcatttgatcttcaatcactgatacccttttttccagttgatcgaatcagctactgaagcttgtgcattcgtcatatagttctcgtgccatggttttcagctccatcaggtcatttaaggccgtctctacattgattattctagttagccattcgtctaatcttttttcaaggtttttaacttctttgcgatgggttcaaacttcctcctttagcttggagaaatttggtcatctgaagccttctctcaactcatcaaagtcattctccgtccaggtttgttctgttgctggtgaggagctgtgttcctttggaggagaagaggggctctgatttttagaatgtttcagtttttctgctctgttttttccccatctttgtggttttatctacctttggtctttgatgatggtgacatacagatgggattttggtgtggatgtcctttctgtttgttagttttccttctaacagtcaggaccctcagctgcaggtctgttggagtttgctggaggtccactctagaccctgtttgcctgggtgtcggcagcagaggctcagaacagcgaatattgctgaacagcaaatgttgctgcctactcattcttctggaagtttcgtctcagaggggtacctagccatgtgaggtatcagtctgcccctactggtgggtgtctcccagttaggctactcgggggtcagggagccacttgaggaggcagtctgtccgttctcagatctccagctgtgtgctgggagaaccactactctcttcaaagctgtcagacagggacatttaagtctgcagaggtttctgctgccttttgttcggctatgccctgcccccagaggtggagtctacagaggcatgcaggcctccttgagttgcggtaggctccacccagttcgagcttcccagctgctttgtttacctactcaagcctcagcaatggcgggtgcccctcccccagcctcactgctgccttgcagttcgatttcagactgctctgctagcagtgagcgatgctccatgggcgtgggaccctccgagccaggtgtgggatataatctcctggtgtgccgtttgctaagaccattggaaaagtgcagtattagggtgggagtgacccaattttccaggtgccatctgtcacagctttgcttggctaggaaagggaatttcctgaccctttgcacttcccgggtgaggcgatgcctctccctgctttggctcacacttggtgcactgcacccactgtcctgtacccactgtccaacaagccccagtgagatgaacccggtacctcagtcggaaatgcagaaatcactcatcttctgcgtcactcacgctgggagctgtagactggagctgttcctattcggccatcttatgaatcatgcatgttcaactatgagcaactatgtgtattcaatgggaaatggaataccataaaattgtcatatgttgagcccaaaatgataggatagaatttgatagtctgaggatggaaaggaccttcaaggccacttttaaaaaccccattcccatatgatgcttgaattcttaaccactgtgtgtctagtattttctcatttccagtgatatgtgtgcctgccaacctttccgtctccaagagctttaactatcaaaatgtatgtgtgtgtgtttttgtgtgtgcatgtgtgtgtgagtgtgcgtgtgtgtgtgtgtgtgtttagagagagagagagagacagaaagagaaggagagactaaaatccaattcactgttctttctgggacccaaagaacaagtctagtcattctccatttctagtctctttccctagcaatcggctagacatgctagacatagacacatgtacatcactcctttgaattacaacattcagtatttgtctatcacttatatgataaaatacaaacttagcttttatttttatttttttagagacagtgttttactatgtcacccaggctagagcatcagtggcacaatcatagcccactgcagcctggaacccctgggctcaaggaatccttccacctctgcctcctgagtagcagagactacagatgtgcaccaccagacccagctaatttggttttttactattttttgtggagatggtgtattgtcttgtggtgttgctcaggctgatcttgagctcctggcctcaagcactcctcccatctcagcctcccaaaatgctgggattacaggcatgaaccaccttacccagccaaatttcttaatatgatatacatgctcctttaaaatcaagcaccatctttgctttcaacctcattattaaccactttcccatatatgcaacatatgtttcagccatactagtgtctagtttttccctgaacactccttggtgcttttgtttatgccctttctgcccacctttgcctggtgaaatcctcatcaatcttcaaattctatcaaatactatcttccatataaagcattttctaaacccacctatgtaaaaagattagtgttttcctattttgttgatgcctccattgcagcattttccagtccaacgttttctagaattgattgtggccaggctaccagactgggccagggcctgtgtcttttctgtcacccagaagcaaaggtctaacaatggatatctgctgaatgaatgaacgaaaatgaatcattaatatattagtaaatacgttaattaaagttccaggtatgaatactgaaggctgcattcaggcagagctggatccaaggatatgctaggttggtctagcacaagaatcagagttttcctctgcaagctatgaaaaatttgggtttagcaggtatttgggatgatgaattatacatttaaccagtgttgaatgagcacttgtccttaaggagtttagagtctgtgaccagggagaatggtgattttcttagctagggcagtttttctaaaaaggtagttgcattgtgtgtttttgaccactgatgataaattcaagtctctcttccttcccaatagcccggaagctgaagaaacttggtaatctgaaactacaggaggaaggagaggcttccagcaccaccagccccactgaggagacaacccagaagctgacagtgtcacacattgaaggctatgaatgtcagcccatctttctgaatgtcctggaagccattgagccaggtgtagtgtgtgctggacacgacaacaaccagcccgactcctttgcagccttgctctctagcctcaatgaactgggagagagacagcttgtacacgtggtcaagtgggccaaggccttgcctggtaaggaaaagggaagtgggagcatgagataagggggatcatatttagtgaacgctcctatggaccagccaccatgtctggtgcttttctgcccattaactcaggcagtcttcatcataaccctgtgggagagggattgttacaagtctcaatttaaacatacagggatcgaaactcagaaagcaaagagaaagatagtattatcgggtgtcttatgtggcccacattgatgcacagcagtcatgctttcatattcaactcacaaaaatggtcagcaaattttccattaatcacaaatcacatagacatacccatatatgccttaggatgctcttctatatttgcacacacaggctcaccccaaagataatctctagtttgactgacattctgtcttcaatgtcatctttaggagctatatcatgggaactctcataatatggtatggtggaaagaacatgaggttgggaatcagaacacttcgggtctgctcttagctctgctagtaacttattgtgtgatcccttccccttctgggtctcaatttctctatctgtataatgtataaagcgtggtttgtatcaaattgatggtttccagtttttgaaaaaaggaacgctttttgcaccttaaactacctaaggaatcataatgagaggaaagattaggtaatagtgaaagaattaccaagtgttggtctaacagaagttggataacagaagttcctcagtgatggggaactcacttctttcttatgtcatctgttgtttaaacaagtctggttattaaaatattacagcttaaggaattcttagagatcctctatccaatgattcacaaactttcctttagcagccaagtgctttatttctcaaaagaattgtacacagatacaagtggagctagtttatttaaagccagagcctgtagcttgggcctcaccagttcagcctctttctctctatcccagggaagccctaggtcactcttgcaaaatcttagggctccaaggaacacagtttgaaaaccagtgaagtatatgccctttaaaggttctcctaatcctgcaattatgattcaaagattcttttgaaataacaacaaccaaaccttctcttgtggagtcaaagattaacctgcctttcaataataactgccattcaggtagaaatttatagtgaacagagcaattttgtatgtattacctgaattgattcttataggaatcctataacatgagattctttctcttattttacagaccaaatagggaagctgtgagaatgatgtgattggcctatagttacatagtcagaaaatagcaggaccagaacttgagcccaggttctctcctgattccaaattctctctattccactccacctgtaggctgtagcaccactgcagttctgtagctctgggctttacagtgaggggccaaggcttcattgaaggccacttgggtcatagtatgggcttgttgcatttgaagacatttcatgttggctgtcaagtcttagatttgtatttccaactcacagggcctggtcacagccctaaccatctcttataccttctcagcttgggaagctgaggtcgactagccaataagaacactgggaaggaaacccaaggactctgactggatatgctctgtgccaaaacagagggttcactcagagaggaaaaatataaaaaagaaaaaggagaaggttgctttaattcttatcactttttcatctggatattttgatatcatgtgtttgacagagattcaaagtttaatcttcccaagcagtttccaaacacttatctcattttataggctacagagctttttcatatatatgatcccacttaatctttacaacaattctatgaatcatagagactattatttccatttcacatgccaaggctcaaagaggttaactaacttgctccatttggtcacttaacacatggaaccagaacttgacctagaccttcgggtttctaaattggttatcttgacaataacctagtgcaaaacactatagcagaatttgtatgacttgggatcactggggctttccttggcccaaccaccaagatggaaagccccctccccttacattaacaaatctgcaagccaatatcagttcaccatctagcttgccagactaaatgatttctgaccccaagtcttttaaaagaatagcttcaaaagaaagccaattaccacattcacaagaactgttcttcatattatctataattacctacaagtacaagtaatttgctaattcaatagattgagttcttgacctgtaagatgaactgtgctaggcccctaataagataaattttgttttaagttttctgtgacagtaaagatgtatgaaaattgcctagtagagtacctggcacattaataaatgataactgttaatttggagtgggtgagtagactgggtgtgcacagtatatttagaatcaaatttatctggtttggaatcctagctatggactagttctgtgaccttgagcaaatcacatgtcttctctgtgcttctgtgtcctcatttgtaagatgatagaataatcactacctttcaaattgttgtcaacaaaaagattatgtataaagagcacctagtaacgtagcctgaaacatagtcaatgctctgtaaatggtggtttattattatgagacttgaatgctaagccactgctttcacgaaactcaattttagctaccacttgccttgcctagaagctcatgcatggaccccaaggtgaaattgtgttctctgaagacctcggctggcagatgtactacagcagcaaagatttccaaactggcctttctttgagcccattctcccagactagacaggagactacaagtttctgctgcacatgaaaaaaatatgatgtcaatcggattctagtgagaaaacagagtctcaaagaaactgcttctgctccctagcgtgtttaatgtgtttcagaacctgagaatgactcctctctgtttctccagaacagcctaacacagtggcaaatgggtgttgagtgaatgcatacttaaggaaatctgtagggttgcagctactctttcctcaagtaatcccttgatagtcatgtaggctacttcagagattgggcattagagaacagagtcaggtattataatcagattagactctagggaggttagccagccatattgctgatatgtgcacagttactgggtttgagtgctaagcagctctcattaaggacggttaattaatattatggccaaattaagctttcccttttctctcctctttgttagttcggtggcattttagggagaaaaaaataagcatcagtatggacaatttgcttgatacctgtacaatttaattctcatccttccatgtgccttcacattcacacattccaccagaagaccaaggttcaccagccaaaagcttttcttgctccccactgcctcctacccaagatattcagggtcaacctcccaggcctcttctctaagagatccttggttgctacatgcttagaccctgcttcttatttcctgctgagaagggtcagtccaaggcattctgtgctacagaagggttccaagcaggaactactctgggatctgaggctccagccggtctgtcagcgtgtcattacagtgaaggtgggaagcacaggcctgggagctaagactgctaagatgagggactctagaatccctgatacctggaaggcctaggatctaaaagaaaagaacagggaaatggggctatatgagtggacagggaccaaccaagcagaacaatgtgtctggataatgtagacttcagacctgatcctatggctgacaaaagctggtgaccttggtagttcctgagctgtaaccttcattagtggagtagaaaaaacactggagaagagaatcagaacacctgggttctagtattagttcagccacatataaaccatatgaccttgggtaagtcagtttatttctctggccctcatgttccttgttggtaaaataagtgccacatcacctaacctctgggattattgtgagagttaaattaggtcatcaacaggaaagtgagaagtttgatctaaatttggggaagcattcctaatgaggtatgatgacaaaatttcagataattctggatttgttggtgagaagagagagtgttggtagggacgagctctgaggtgatgcctttataactttaagcatccaactgtttcaaaaactccaggagaacatggccatgtctgttctacctgtgtattattgtagacgtagcttctgggagcctctgctctctgagcttaagggaggtaatttggagatcatttaattctcattttacaaaaggaaaaaaaattgagggtctttaggccatttgtttaggtaatatttcttaagtgcccactcaaatacgtggactgtactaagtactagggaggtaaagataaataagaagatatggtccctgtcttcaagaagctccaagtcttgtgggggagacagacatgtatatacatagacttcaatgctgtgtaatgactgctataattgggtgaggctacacaaggtgcaatgagaatgtaaaagaagaatctttaagccttcttcttggatgagttgggaaagccttcacagaagaggtagcctttgagtgaagacttgaaagatgagtagtgtttaccggatgaaaggcctgagaaggaggaatgcattctaggcaaaagtaactgcctgtgcagagataacagagatatagaggcatgtgagagcgcaagtggcaagagatcagtctaggtaggcaggtcataaagggcctattcatgtataatgatggcagtaagatgaggatggcagtagggtgggaaattagtagggccagggtacctattgagtagaaaagaatggagaggaaatgccaggcagaaagaggatggacgcaagagagggaacatgaaagtggtgaacaggtggcagtggctgtcaagacatctctccataccctgtacactgtatgtaatatccatctcccagggttgttagaagggtcaaaccagatcgtagctggaaaacagctttgtgaagtgaaaactgctgtttatgtgggggaaatgattgttaaactgcatctttggaaaggtgaagtgatcaagagcacagaccttggaatctgactgctttgctttgtaacttggtctgccaattactagctgtatgatcttggacaagttccttaacctctctctgactcacttgtactggttcacagaatggagataataatagtacttaccttactcattgttgtgaatgttaaatgagataatataagtaaagtgcttagaaaagagttaaatgtaccccataaatacatacaactatcatgtacccaaaattatttttaatttttttaaaaaagagcaatccaatagcaaaagaaaaaaagagttcactcatataagcagtcaataagtgttagattatttttctcttacaactgacaatgccctttttgtctccatcatcatctcatttgagcagctcagggaagtagggaggataaggaatattatcctcaccatatagtttgtgcttttccccaccaccccttaatggccagcctggatggtccctggggatccttaggggatgcccgaataccagagcatctctgcccaacagggactcagacttagctcaacccgtcagtacccagactgaccactgcctctgcctcttcttctccaggcttccgcaacttacacgtggacgaccagatggctgtcattcagtactcctggatggggctcatggtgtttgccatgggctggcgatccttcaccaatgtcaactccaggatgctctacttcgcccctgatctggttttcaatgagtaagtgctcctggggcccagacctcactaaaatacagcagcttggccagacctggttggtggtgatggtgatggggtgacagtgaagcttagctcatttgatctgcagttgtcgcagcggatgccccagccagccaatccagtatgaggcggctttgccctggctttcagccaactggcaggagcccaggaggatggtgctgagaccacccctttcacacccaagaaccaatcctagtcatatttctggtctgctttgcagcttatctcaaaaccacatggaaagattcctccccttcacatataaaagaggcagaaagactctggctttaagggctggagtttcttgggttcttttgctaccaccaaaggctacttctagtcaccatttgctgagcaactagtttgtgccaagactatgctagatactttctaaatcctagctcattgagtcctcatggtgacctgacctcacctttttatagataacactatttttttatggatggggaaaatcaggctcagcaaaataaagtgactcacccaaagtcacagagctagtgcctgttggagacaagattcaaacgtatgtccctgtcgatctcagctcttctgcgtcatggtggtaactgatgggaaggagtacctctaccgctctctggctgtgtgaccttggtactgccattttccttcccttaaacagctttaattaatacctgccctgccaccagctccatataacatcatgaatttggccagtggctcagattttggaattacatttttctccactaaaatctcagttctactattttcttagtcagcatctttgggaaagacctttaacttttccgaccctcaatttcttcatccattaatgataacagaaccttcataagtaatttcttatgataactaaatgggaattgacagatgtggaatgtctggcccatagtaggcaagaaggaaaaaaaaagtccctttctgattcaccctttccctaatagtgatacattttttttccccgagatggggttttgctctgccacccaggctggagggcagtggcgcaatgatctcagcccagtgcaacctccacctccctggttcaagcaattctcctgcctcagcttcccgagtagctgggattatagatgcccgccaccgtgtccatctaatttttgtatttttggtagagacgggatttcaccatgttagccaggctggtctcaaactcctgacctcatgatctgcccgcctcagccgggcatgataatcttttctatgtctgctgtatgaggtccctcgatggcattgtgaatggagctggccagagaaatcttcccaaggaccttgagctagtctcaccacagagaatccttccagtcaggacaggaattgaccttcccccctcttcagccctctaacccagaagagtcttaaaataaaatctacaggccaatggttccttccagtacagcactgcaatgcgagggagagtgagcgtccccagctgccctctcccaaccctgccagcctggtagccaaaagctaagaataaccactaggcttttggcacaaactgctttgtggttttcagatctccgcaaagttgcctatgatgccatcttctggggcaggccttgaaaagccccctaactgttcatctcccatccttaaacccctgctgcccttaagcagttgaatcaactccatgagcacctgctctaccttccccagagccctgagacctttggagctttgaaaagtgataattggttgttctctaaatcctcatttccttctctgcctctaagtaagcatgtggcatcccacctcggcttcctggtccagtcttgttcatcttataaaaaggcctccctacggggtcagaggcctagacccatcaaacccagggctcctgaaacaataggacccctattcctcctgtaggaagccactgtgttagagctctcagggtgtctacaaacatctagataagtgtttctcaacatggattctgttgacatattgggaaaaataattttgtcattatgtagaatatggttaacatacctggcaccagcctactctataccaaataggattccagtcattctgacagcccaaactgctcccacacatttctgacacccactgaagaggcagtactctccagttgagtgcaactaatccctgccagccttcctaaggtgctaatggggagcctcagacccaaagagagagagaagaacttgtccaatgtaggtcaacccatttgctgatctcttcaacaccaagctctattatcagccctgtttttttctttctttctctctttgtagagatcacatgttgtgaggataatgagcttgaaccttagctgtgtgaccttgggcaaattactgaacttctatgtgccgcaaattttatctggagactgctgaagagtattataatagcacctttctatatgtcatttattgaacacctgctatgtgtcaggcactgtgctcagtgttttccaatcttcatttctcctcttattttctctcttgcactcccaccaaccttgttctcttcctaaattccattcctgcctcatttttctaccctccattctcctctctcttccttcctttaactgtctccctagtatttttccccttttccccctttcttttccccttcccccatgaatttcttctctttcctttccccttctctttcctccattccccactttttctgcccctgaggcctgcagcaatgttaaaggaatcctcattccagcattgtgatttcaatggtaaaaagattgcagcattgtcatcaacagaggtgggaaagtacattggagactggagcagagccagacctcagggtcagccaatcttactaaaaaattctctacagtgaaagagcttggagcaacactgttctgctcaattgatttgtgataccatctaaacacttcctctttctagttgggcttcagcctgagttgaataattctacaccatctgccctcttctctctttctccaggacagccaagatctctctgagataggatgctgagcttccacccagacaataccaggcctgctcatcctatggagtaggctagtggcttggaaaccaaaatgtcaaaccatagcctttaggctccatctgggaggtctttgtcctcaccacttaagtgggtgtcaaatttccttccctttctgcacacgctgcacaatcaatttctgtcttacacacacacacacacacacacacacacacgatttttgaagtgctgaaaactggaaggcctactagcatgaggatgctgtgtcttctcttagaggtatgccatggtcagccatggaaccgagaggttgctcttccttgaaaagctggccaagcattggccacttccccatataatttataggtgataatgtggtgatctgttcagaagtgactataataaatgcaactcacatatgtctacagtttccaaactgtggtaaggagcagccagcatatgagggaatgggctccccttcagcaggggacatttaaactagacattcaaaaacactccctggcagatttaacattggaactcgttttgaaagaacaatgtggaatctccttcactgggagtttttgaataagtatgaaatttctagtattccaggccagaggcaaaggggtcaacaggatgaccaaacacttcgggtcatttgcaaatcttgatgtcctgatgttaagagctgactactggggcttctcctaaaaatccttcatgttgagctgcctggaaggcaggttctcattctggctgtagctgagatgttagaactgtagtcagggagaccatgtgcctcccccattgtgttcatttggttaggctttcctgtccctgactcagaaaacagaaggggcacagagacctggaaattccatgtgctaacccatatcctggccagagaagatgagtagttatcagggtgtcaggattttggaaaacagagagagaaaaaaaacaaacaaacagacaaacaaacaaaaaaaccttttcctggtccctggagcaccagcaggagaaacagcaagctcttcttggaaaacctggcgagggatggcaatcagagacattccctctgggcttattgtaaacttcccctcattcctttttcctctgtgtatctccttcccaggtaccgcatgcacaagtcccggatgtacagccagtgtgtccgaatgaggcacctctctcaagagtttggatggctccaaatcaccccccaggaattcctgtgcatgaaagcactgctactcttcagcattagtaagtgcctagaagtgcagggaatgccccctgagggcacagagattcagagaggaccacttttgccattaaaacattattagggaaaagccagctcctggacatttcccttcttcattccccctccccatccccactctactctctctcagcatcattttcctaacaagaaacaatttcatgactagaagccaatttatttgctagaagtcaacctccatcagattccccacctatccccagtctgtctttgggacaaggcctttttgactggttacagcaggtctctgaatttttccatagcttctgctatagaaacagacatgggccaccttgtattctttgcagggcagtagagcaggaggcatttcctcctggaaagatttcctcttctgccaacaggaggagatctatgtaagcaactcagataggatttgtatggcagccaaggaacttttctttaatatcttttctaagagccctctcttagcccctacggagggagaagggcaaaatttgatattcaaagctatgtgttttggttatctaaatcagggttttactgtgaatgacataaaagcttaggtcctaaaaaatgagtatctgagaagagtagaaaaagaaaaggttcaggaaatttgatttacttgactcctttcagatcggatccagctatcctttcccctgagatctccctgacagactgaaggccccaagcacacagacttcaactaacaggaagccaagtagatggttccctgtgggggtgggggtcaagtctgtggtcagaaaacttggtgctttgtctaatgctccttcgtgggcatgcttcccctccccattctgtcttcatcccacatcagttccagtggatgggctgaaaaatcaaaaattctttgatgaacttcgaatgaactacatcaaggaactcgatcgtatcattgcatgcaaaagaaaaaatcccacatcctgctcaagacgcttctaccagctcaccaagctcctggactccgtgcagcctgtaagcaaacgatggagggtgctttatcagggagaacagcctgatagagccaatgataatatgcttctctagagtctggcaccacctgttgggaggtgcttccattcccctctggctttgagtgtggtccaggaagaaaatgtggtgaagaaaagaacacgggtcacagtgtcccagctggatattgtgaaaggggtggaggagttgagaacagagcagttgggactcagggaagggacttgcagcagatgaattctctaggcagacaaaacagacctggatgtttttcccctcttctttgagtcatgttcatgtgagtttgtctgtctgtgtgtgtgtgtgtgtgtgtgtgtgtgtgtgtgtgtgtgtcagagagagagagagagagagagagatggagtgcggaggcttgggtgagagcacaagctggagaagtcttgagtcagagagcttacaatggtataagacatctcttgggagccctcagtgactccatggagaccatttctttctctctctctcgctgtctctctctaacacacacacacacacacacgacctcatgggggaggaccaaggaagtacggggaagggggaggaaacaaaaggctgaaagaccaaaaatcagaggttggggaagaggctagcagaggccacctccttgtcaaccctgtttttctccctcttattgttccctacagattgcgagagagctgcatcagttcacttttgacctgctaatcaagtcacacatggtgagcgtggactttccggaaatgatggcagagatcatctctgtgcaagtgcccaagatcctttctgggaaagtcaagcccatctatttccacacccagtgaagcattggaaaccctatttccccaccccagctcatgccccctttcagatgtcttctgcctgttataactctgcactactcctctgcagtgccttggggaatttcctctattgatgtacagtctgtcatgaacatgttcctgaattctatttgctgggctttttttttctctttctctcctttctttttcttcttccctccctatctaaccctcccatggcaccttcagactttgcttcccattgtggctcctatctgtgttttgaatggtgttgtatgcctttaaatctgtgatgatcctcatatggcccagtgtcaagttgtgcttgtttacagcactactctgtgccagccacacaaacgtttacttatcttatgccacgggaagtttagagagctaagattatctggggaaatcaaaacaaaaacaagcaaacaaaaaaaaaaagcaaaaacaaaacaaaaaataagccaaaaaaccttgctagtgttttttcctcaaaaataaataaataaataaataaatacgtacatacatacacacatacatacaaacatatagaaatccccaaagaggccaatagtgacgagaaggtgaaaattgcaggcccatggggagttactgattttttcatctcctccctccacgggagactttattttctgccaatggctattgccattagagggcagagtgaccccagagctgagttgggcaggggggtggacagagaggagaggacaaggagggcaatggagcatcagtacctgcccacagccttggtccctgggggctagactgctcaactgtggagcaattcattatactgaaaatgtgcttgttgttgaaaatttgtctgcatgttaatgcctcacccccaaacccttttctctctcactctctgcctccaacttcagattgactttcaatagtttttctaagacctttgaactgaatgttctcttcagccaaaacttggcgacttccacagaaaagtctgaccactgagaagaaggagagcagagatttaaccctttgtaaggccccatttggatccaggtctgctttctcatgtgtgagtcagggaggagctggagccagaggagaagaaaatgatagcttggctgttctcctgcttaggacactgactgaatagttaaactctcactgccactaccttttccccacctttaaaagacctgaatgaagttttctgccaaactccgtgaagccacaagcaccttatgtcctcccttcagtgttttgtgggcctgaatttcatcacactgcatttcagccatggtcatcaagcctgtttgcttcttttgggcatgttcacagattctctgttaagagcccccaccaccaagaaggttagcaggccaacagctctgacatctatctgtagatgccagtagtcacaaagatttcttaccaactctcagatcgctggagcccttagacaaactggaaagaaggcatcaaagggatcaggcaagctgggcgtcttgcccttgtcccccagagatgataccctcccagcaagtggagaagttctcacttccttctttagagcagctaaaggggctacccagatcagggttgaagagaaaactcaattaccagggtgggaagaatgaaggcactagaaccagaaaccctgcaaatgctcttcttgtcacccagcatatccacctgcagaagtcatgagaagagagaaggaacaaagaggagactctgactactgaattaaaatcttcagcggcaaagcctaaagccagatggacaccatctggtgagtttactcatcatcctcctctgctgctgattctgggctctgacattgcccatactcactcagattccccacctttgttgctgcctcttagtcagagggaggccaaaccattgagactttctacagaaccatggcttctttcggaaaggtctggttggtgtggctccaatactttgccacccatgaactcagggtgtgccctgggacactggttttatatagtcttttggcacacctgtgttctgttgacttcgttcttcaagcccaagtgcaagggaaaatgtccacctactttctcatcttggcctctgcctccttacttagctcttaatctcatctgttgaactcaagaaatcaagggccagtcatcaagctgcccattttaattgattcactctgtttgttgagaggatagtttctgagtgacatgatatgatccacaagggtttccttccctgatttctgcattgatattaatagccaaacgaacttcaaaacagctttaaataacaagggagaggggaacctaagatgagtaatatgccaatccaagactgctggagaaaactaaagctgacaggttccctttttggggtgggatagacatgttctggttttctttattattacacaatctggctcatgtacaggatcacttttagctgttttaaacagaaaaaaatatccaccactcttttcagttacactaggttacattttaataggtcctttacatctgttttggaatgattttcatcttttgtgatacacagattgaattatatcattttcatatctctccttgtaaatactagaagctctcctttacatttctctatcaaatttttcatctttatgggtttcccaattgtgactcttgtcttcatgaatatatgtttttcatttgcaaaagccaaaaatcagtgaaacagcagtgtaattaaaagcaacaactggattactccaaatttccaaatgacaaaactagggaaaaatagcctacacaagcctttaggcctactctttctgtgcttgggtttgagtgaacaaaggagattttagcttggctctgttctcccatggatgaaaggaggaggattttttttttcttttggccattgatgttctagccaatgtaattgacagaagtctcattttgcatgcgctctgctctacaaacagagttggtatggttggtatactgtactcacctgtgagggactggccactcagacccacttagctggtgagctagaagatgaggatcactcactggaaaagtcacaaggaccatctccaaacaagttggcagtgctcgatgtggacgaagagtgaggaagagaaaaagaaggagcaccagggagaaggctccgtctgtgctgggcagcagacagctgccaggatcacgaactctgtagtcaaagaaaagagtcgtgtggcagtttcagctctcgttcattgggcagctcgcctaggcccagcctctgagctgacatgggagttgttggattctttgtttcatagctttttctatgccataggcaatattgttgttcttggaaagtttattatttttttaactcccttactctgagaaagggatattttgaaggactgtcatatatctttgaaaaaagaaaatctgtaatacatatatttttatgtatgttcactggcactaaaaaatatagagagcttcattctgtcctttgggtagttgctgaggtaattgtccaggttgaaaaataatgtgctgatgctagagtccctctctgtccatactctacttctaaatacatataggcatacatagcaagttttatttgacttgtactttaagagaaaatatgtccaccatccacatgatgcacaaatgagctaacattgagcttcaagtagcttctaagtgtttgtttcattaggcacagcacagatgtggcctttccccccttctctcccttgatatctggcagggcataaaggcccaggccacttcctctgccccttcccagccctgcaccaaagctgcatttcaggagactctctccagacagcccagtaactacccgagcatggcccctgcatagccctggaaaaataagaggctgactgtctacgaattatcttgtgccagttgcccaggtgagagggcactgggccaagggagtggttttcatgtttgacccactacaaggggtcatgggaatcaggaatgccaaagcaccagatcaaatccaaaacttaaagtcaaaataagccattcagcatgttcagtttcttggaaaaggaagtttctacccctgatgcctttgtaggcagatctgttctcaccattaatctttttgaaaatcttttaaagcagtttttaaaaagagagatgaaagcatcacattatataaccaaagattacattgtacctgctaagataccaaaattcataagggcagggggggagcaagcattagtgcctctttgataagctgtccaaagacagactaaaggactctgctggtgactgacttataagagctttgtgggtttttttttccctaataatatacatgtttagaagaattgaaaataatttcgggaaaatgggattatgggtccttcactaagtgattttataagcagaactggctttccttttctctagtagttgctgagcaaattgttgaagctccatcattgcatggttggaaatggagctgttcttagccactgtgtttgctagtgcccatgttagcttatctgaagatgtgaaacccttgctgataagggagcatttaaagtactagattttgcactagagggacagcaggcagaaatccttatttctgcccactttggatggcacaaaaagttatctgcagttgaaggcagaaagttgaaatacattgtaaatgaatatttgtatccatgtttcaaaattgaaatatatatatatatatatatatatatatatatatatatatagtgtgtgtgtgtgttctgatagctttaactttctctgcatctttatatttggttccagatcacacctgatgccatgtacttgtgagagaggatgcagttttgttttggaagctctctcagaacaaacaagacacctggattgatcagttaactaaaagttttctcccctattgggtttgacccacaggtcctgtgaaggagcagagggataaaaagagtagaggacatgatacattgtactttactagttcaagacagatgaatgtggaaagcataaaaactcaatggaactgactgagatttaccacagggaaggcccaaacttggggccaaaagcctacccaagtgattgaccagtggccccctaatgggacctgagctgttggaagaagagaactgttccttggtcttcaccatccttgtgagagaagggcagtttcctgcattggaacctggagcaagcgctctatctttcacacaaattccctcacctgagattgaggtgctcttgttactgggtgtctgtgtgctgtaattctggttttggatatgttctgtaaagattttgacaaatgaaaatgtgtttttctctgttaaaacttgtcagagtactagaagttgtatctctgtaggtgcaggtccatttctgcccacaggtagggtgtttttctttgattaagagattgacacttctgttgcctaggacctcccaactcaaccatttctaggtgaaggcagaaaaatccacattagttactcctcttcagacatttcagctgagataacaaatcttttggaattttttcacccatagaaagagtggtagatatttgaatttagcaggtggagtttcatagtaaaaacagcttttgactcagctttgatttatcctcatttgatttggccagaaagtaggtaatatgcattgattggcttctgattccaattcagtatagcaaggtgctaggttttttcctttccccacctgtctcttagcctggggaattaaatgagaagccttagaatgggtggcccttgtgacctgaaacacttcccacataagctacttaacaagattgtcatggagctgcagattccattgcccaccaaagactagaacacacacatatccatacaccaaaggaaagacaattctgaaatgctgtttctctggtggttccctctctggctgctgcctcacagtatgggaacctgtactctgcagaggtgacaggccagatttgcattatctcacaaccttagcccttggtgctaactgtcctacagtgaagtgcctggggggttgtcctatcccataagccacttggatgctgacagcagccaccatcagaatgacccacgcaaaaaaaagaaaaaaaaaattaaaaagtcccctcacaacccagtgacacctttctgctttcctctagactggaacattgattagggagtgcctcagacatgacattcttgtgctgtccttggaattaatctggcagcaggagggagcagactatgtaaacagagataaaaattaattttcaatattgaaggaaaaaagaaataagaagagagagagaaagaaagcatcacacaaagattttcttaaaagaaacaattttgcttgaaatctctttagatggggctcatttctcacggtggcacttggcctccactgggcagcaggaccagctccaagcgctagtgttctgttctctttttgtaatcttggaatcttttgttgctctaaatacaattaaaaatggcagaaacttgtttgttggactacatgtgtgactttgggtctgtctctgcctctgctttcagaaatgtcatccattgtgtaaaatattggcttactggtctgccagctaaaacttggccacatcccctgttatggctgcaggatcgagttattgttaacaaagagacccaagaaaagctgctaatgtcctcttatcattgttgttaatttgttaaaacataaagaaatctaaaatttca

SEQ ID NO: 4663 - DNA, 151255 bp, human; identical to SEQ ID NO: 4661

SEQ ID NO: 4664 - DNA, 8885 bp, human
gtggccttccaggaggcgggaggcgcccgctgtcgaggcagctgagccccggcaaccgctgctctccgcctctcccctcgcggggccggctcatggagcgcagggaccgggctggctctcgccgagccccgggcctcttttagcctcgtccccagagagggaggagccggtgcccggcacagccccgccggccctagaagctccccacgcgccaccatgcctctgctggacgttttctggtcttgcttcaggaaggtgaaggtaagtgactggccagccccagcccatcccgctgctcaggggggaaggaggcagatgtggaccactgcgcaccagctgggaaaacggaccagacgggcttctgagactacctgaggctctcggagttagaaaggcttgggttcaagtctcacctttgtcacttaaccagttctgtgaccttctgttgcattcccatacaaacaagtctgctagttggctctttttaataaaactcgcctctgttgcttcctggatcttgccacaaaggcaagatacttaacctctctgaacctcagtttcctctcagctttagaatgaggaccatagtaacaccaaccttacggggtgatgaggttggtgttattgtttacatagcaaatgtatgcaaatccaggagataatgtgtgtaagcttcctagcaggatgcctggtgtggagcatccacacaaacaatggtatctattattattattattattaatttctatccatatatataaaagcacatactctgtgctaggcaccactggagctacacaaagacaaaaaagggctggacacagtggctcacgtctgtaatcccagcattctgggaggccgaggtgggaggatcacttgaggccaggggttcaagaccagcttaggcaacataaggagacccccatctccattttttaaaagaagacaaagaaggacatggcttttgtcctcaaagagaatataagaaaagtgacaaatatttaccaggcacctactatatgccagacattgtgctaaatagtcagtttgtcagtaaatatttgttgagtgtctactatatcctggccatgggggatacatgagcacagccgaacccacaagtgtgtgtaaagcatgattccactctcaagaaccaagaaactaatatttatttagtatccactatgtaccagacctaggcacttttaattcattcatgtggcagtgatcctcagcacaacccattgttttcctgcttttatagatagggaaaagacactgtgaatagttaagaaatatttacaaggttgctcagatatgactggcagagctgggatctgagctcctaagtccatgcctttcttgacgctgtgtggtttcccacagtccaacccagtaggaagactttcaaacgactagcctgactgtaagacaggatgaaagaatgctgggacctttgggaaggaaagatccattccaccgggagggacttggagaggtttcacaggaggtcacatttgggctgagcctgaggcttaaaggaagagaagagtttgtcagtccaaaagtgggggaagggcattccaggcatgcctggcagagggaacttcgtgagctagagtttggaggcagtcaaatggtagtgggctgggggaaaggcttctttcgtgatgtggctcaaatgtagggttagagaggataggagcttgagaaagggaagcagagactacttcccaaagggtttggaattaatctgtggattcatggtcctcatctagtaggggtcctgaatgagatttttcaaccatctgtggtggaatgagagaaaagtagggataatgtcgtgcagtgttcataaaactaaattaattcaactcaaaggactattctttatttggagactgttgtgtccttcctgtgggggtggggattcaaatgatctttctcctacaaaatatgagtgagaaattttttaaatgtctgccctcagcaaaattacaaagtttgcgacatgctgattgtttccctatttatttatttaagaacactttcctcatccatgaaatctgaaagtctggtgactactgttttggggaataaggggctgatttcagcataatagggatataattaagtggacggttttagaaaaagcactccagcagtagtgggcagggatggtgtggaagggcccaagtggagatgcagaggccaggaaggaggcagctgcagtggaaataaggatgggagaggaagaaatgatagagagctggatggaatgataatgacgagggaagggaaaattaaagtgcctttgaggtttgacgcccgagaggcacctctgtcccctaccccagttaactgttctaggtgcttggcatggatttaaatctctttgcactcattaccccaacttctcagatgcccagaaaacatgtcctaacccctgtcagcctcttggaaactgttgggctaggttaagagcagtggctcatgcctataattctagcattttgggaggccaatgcgagaggattgattgaggccaggagttccagaccagcctgggcaataatgagaccctttatgaaaaataaaaaaaatttgctgggcacggtgatgcataatggacacctatagtcccagttacttaggagactgaattgggaggattgcttgagcccaggagttcaaggctgcagtgtgctatgattgcaccactacactccagcctggactacagagcaagatcctatagaagaagaagaaggaggaggaggaggaggaggaagaggaggaggggaggaggaggaggggaggaggaggaggaggaggaggaggaggaggaatagtaattataggtatggtgtcacgcctgtaatcccagcactttgggatgccgaggcaggtggatcacttgagtccaggaaatcaagaccagcctgggcagcatagtaagactgtgtctctagaaaaaaaaatttaaaattagtcaggcatggtgatgcatgcctgttttctcagctacttgtggggctgaggcaggaggatggctgcagtgagtcatgatcgcaccactgcactccaacctggccatcagactaaggctatgtctcaaacaaaacaaaacaaaacaaaacaaaacaaaacaaaacaaaacaaaacaaaacaaaactggtgggctaggacagccccaagagaaggttgaggatctctatcatgggtcccagacgtttgcacgcattcacttatgagtgtgtccacagaggacatacacgtgcatttgtgcatattcaaccccacacacatatgcacaggcacaccattcaagtgtgcatacacacatacatagagacgaacacacatataccctggcacaaacaggcaaatgcacatgtacacacagacagtgcacattcctagcatgatgtagactcacacacatatgcatgcatgcatatacagaggtaagcacacaggcacatcagatacataccctcctatgcacaagcatgagggacacacagagacacagccaggcacatctccaaaaagcctgtagacatacaaaagcatgcacacggcgtgaaggtccacgtgcatgcacatgcatatgcacaggtctgtggttgctcatgtccttggcagatgtgaatcaacacatggctggatctcagggctaagaggcagcctgccggatccacacacttggactgcgtgctcccttttccaatgctgctgctttgaggccccagtcagaaaggcaggctctctgggctcgggagctcagtcaagggcacgggctgctgtgagccaccctccctctctgagccaggccccctgagtgcgggagactgaggggtttgaggggtggggaatggccgggacagatcctgtcagagctgaaagggccctctcagatcatcttattcaaacttctcatggtcctgatagggaaaccgagccccttccctcccccaccatatggagcccttcatcagctgaagaggtatgaggaggggtgaagcacacaaacttgggtttcaattccaccccacacccacaggcacacatactagctgtgtgccttcgagcaagtcttctccgagcctcaatttccttgtttgcagaatgacactaatcagtgcccgcctcacagaaatgccacgaacatttggtgggtgggttaagtcttttttttttttttttgaccgagtctcgctctgttgcccaggctggagtgcagtgtctgctcattgcaacctccacctcccgggttcaagcgattctcctgcctcagcctcccgagtagctggaattacaggcgcccgccaccacgcccagctaatttttttttttttttgtatttttagtagagacagggtttcaccgtgttggccaggctggtctcgagctcctaaccctaagtgatcagcccgccttggcttcccaaagtgcgggaattacaggcgtaagtcaccacgctcggcaaggctgtgtctttaaagtgcctgacatggagtaggtggtcaatacacatgatttgttggaagcagcttccgaaactgtgtactagaggcaccacagcaaagaatgagggttattctatatttgaaaattccagggttagggtctcaggtccagtctgctcctttgccacaactcctcagccctctactttgactatgcctgggtctaggaatagaagtgatccatttgggagatgaaggctgacaccccagaagccagggatggtgggaaggtggcaaaaggccaggccagggctcaggattgctttgagctgctcttgtgttaggggcagccaagggacaagacgtttaagtgtgagatgaacccagtataaatagtccaatacgtgtttgctgtgtcttcccctggaggccagtcagggcccggaaggcatccatggccccttggtacaacgaagcatgcatgagtcagtttctcacccgctcccccgcaacacacagccacacaccccacactccacacacatgaaacacacaccacacacacaccacaaacacatcacaccatacacacaccacacaccacacacatacaccacactcccccacacacacaccccacacaccacacacacacacaccacacaccacacacacaccccacacaccccacaccccacacacacccccacacaccacaccacacacacacacacccacaccccacacacacacaccacaccacacacaccacaccacacacacacatcacacacaccacacacacacaccacaccacacacacacaccacacaccacacaccacacacacaccacacaccacacacacaccaccacacacacacaccccacacaccacacacacacatcacacaccacacacaccacacaccacacacacaccacaccacacaccacacacaccacacacacacaccacacaccacacacacaccacacaccacacacaccacaccaaacacacacaccacacacacacaacacagcacacacacatcacacacacaccacaccacacaacatacacaccacaccacacacacacaccacacatacaccacacacaccacacaccacaccacacacacaccacacaccacacacacaccacaccacacaccacacacacacaccccacacaccacacacaccccacacacacccccaaacgcacaccacaccacacacacacaccccacacacaccacacacaccacaccacacacaccacacaccacacatacacctcacaccacacacacacaccccacaccccacacacacaccccacacccctcacacacaccatacacaccacacacaccacacacaccacagcacacacacaccacagcacacatacaccacacacacaccacacacacaccacaccacacaagcacacacaccccaccacacacacacacaccccacacaccacacacacaccatacacgccacatacaccccccaacacaccacaccacacacacaccacaccacacatacaccacacacaccacaccacacacacacaccacacgccacacacacacacaccccacacatcacacataccacaaacacacacaccacatacacacacacacaccacatacatacagaaccatttctttgatgtattcttttgcccccttccagcacttagcatggtgttatgcacataaggggtgcccggaacacaaatcctccctcatgttactccgcttcaggtgggcatatcaggtcctagagggcactggcttgggaggtgggaaatctgcctggagcgccatctcaaccatgacctctggatgaccttgagagggtcaattctctctcctgtccctcagttccctcctcttataggtagataatcatgcaatatcagagatgaaaaggcccttggaggtcatctattcctctttctctgttcctctctccaaactaccagtgaggaaactgaggcccagagaggggagagatgtggccaaggtctcagagggcatcaggacacagcggattccaatgtggtctgtgtaatacaccataatctccctactcgttctgtggcaaaatccaaacacaacttgtctctggtaaaatctaaaagcagtactgggggaatgtctctacacatgccacacacacacatgcatacatgcacgtatgtgttaacaaccctgccgtacctacccacaaggcttctatgggagttaaagcaaatcatggacagacagtcgtgtggactgggaaggctcatagaggtgaacctcccagtcgtgggccaacatgggatcccatgcttttcactaggcaccatactcacatacttaggtcatgcacatgagtgtgtatgtgcacaagggctttcctgagctcgcccaggcacacattctcaagcaccatctcctgtgaatgctctcatccaagtatgcatgagacttccatgtggctgctcttatacatggcttcccaggcacctgttcatatgggtgtgaggtttcacaccccctgtgcaggctcacattcatgcacacacacacacacactcgcaagtgaggtgagcatgcatcctccttatgtgtgcttgcccataccccagcccctctctgcccccaggccagctctcagcttcccaatctgcctaggagcagcctggcaggatatggggtgaacgtgtgacgatgatagggtgattcagcaatttcactcccagcctccaggatgtctctcctttttcattcctttgcccttgtcatcccaagtaagtccaatttgccacatgcagtgtgtatttgttgtggaaggggcagggggagtatagagaattcaggggttcacatgaatgtatacaaactcctggggctggaaagggacctcagagactcctcgatgccatcactacagagttgcctctatcacatcttaccaaaagaatggccagacacttgcacacctccagtgatgtggagctcaccgcttcctcaggacactattgcagatcccttcgtcagtctgatgtgtgtgtgtgtgtgtctgtctgtctgtgagtggaagtactaatgtacatgtgcacatatgagacagtatatacagccagccacgtcttaattacttgttccaaagaaataaattatgacataagactctcaggtcatggtaaaaccacgtagagggggaaaggcaagggcctatactccatagaaggaaggttcactcgcagggccctttctgcagagttccacagcccactcaaataacctgtcagctgggtgataggtattggccccctatatgtgtgaaaaattcagaccgtggattgtccctgacatggttaattgtaagatgcctagatgctggacatatgctgtgtaactttgaggcacaggcccatgggctagagcaaaataataagttgtggtaaggttattggcatagatggagctcaagagagttgtgaggtggcttctgggtgatctaggaagctttctgggaccagtttttgggaccagagtagaaggcagcttagtgttgccaaaggagcactggacacagagtgagactgacctggatattacgtccacctctgccacatctaggctgagtgctcctgggcctgtcacctctcctcagtggataagacttaatggagttgccagcgagatgatgtctgtaaaagcctgttacaaggtagatgctccattgaatctgaatctgaagggatgatctttggaagaaaagggcaaggagtgttttcaaggcagagtgaggttggagacatgtgagggaagagtcatagatccaagggacttgtcctgagtggaggtgttgggaatgaatggaaatgggaagaggaggaagaacaagagactttgaaatttgtctgtgggagtttgaacttcatgttcttgatgcagtgaaaagaccaaaacatctacatggagtcaagcccttcacctatctgagccacaacttgctagctgtgttgaccatgagaaagttacttcgcctttctcaaaagaagacatttatgccgccaaaagacacatgaaaaaatgctcatcatcactggccatcagagaaatgcaaatcaaaaccacagtgagataccatctcacaccagttagaatggcgatcattaaaaagtcaggaaacaacatcaggagagggtgtggagaaataggatcacttttacactgttggtgggactgtaaactagttcagccattgtggaagacagtgtggcgattcctcaaggatctagaagtagaaataccatttgacccagccatcccattactgggtatatacccaaaagattataaatcatgctgctaataaagacacatg

SEQ ID NO: 4665 - DNA, 78068 bp, human
gggaccgggctggctctcgccgagccccgggcctcttttagcctcgtccccagagagggaggagccggtgcccggcacagccccgccggccctagaagctccccacgcgccaccatgcctctgctggacgttttctggtcttgcttcaggaaggtgaaggtaagtgactggccagccccagcccatcccgctgctcaggggggaaggaggcagatgtggaccactgcgcaccagctgggaaaacggaccagacgggcttctgagactacctgaggctctcggagttagaaaggcttgggttcaagtctcacctttgtcacttaaccagttctgtgaccttctgttgcattcccatacaaacaagtctgctagttggctctttttaataaaactcgcctctgttgcttcctggatcttgccacaaaggcaagatacttaacctctctgaacctcagtttcctctcagctttagaatgaggaccatagtaacaccaaccttacggggtgatgaggttggtgttattgtttacatagcaaatgtatgcaaatccaggagataatgtgtgtaagcttcctagcaggatgcctggtgtggagcatccacacaaacaatggtatctattattattattattattaatttctatccatatatataaaagcacatactctgtgctaggcaccactggagctacacaaagacaaaaaagggctggacacagtggctcacgtctgtaatcccagcattctgggaggccgaggtgggaggatcacttgaggccaggggttcaagaccagcttaggcaacataaggagacccccatctccattttttaaaagaagacaaagaaggacatggcttttgtcctcaaagagaatataagaaaagtgacaaatatttaccaggcacctactatatgccagacattgtgctaaatagtcagtttgtcagtaaatatttgttgagtgtctactatatcctggccatgggggatacatgagcacagccgaacccacaagtgtgtgtaaagcatgattccactctcaagaaccaagaaactaatatttatttagtatccactatgtaccagacctaggcacttttaattcattcatgtggcagtgatcctcagcacaacccattgttttcctgcttttatagatagggaaaagacactgtgaatagttaagaaatatttacaaggttgctcagatatgactggcagagctgggatctgagctcctaagtccatgcctttcttgacgctgtgtggtttcccacagtccaacccagtaggaagactttcaaacgactagcctgactgtaagacaggatgaaagaatgctgggacctttgggaaggaaagatccattccaccgggagggacttggagaggtttcacaggaggtcacatttgggctgagcctgaggcttaaaggaagagaagagtttgtcagtccaaaagtgggggaagggcattccaggcatgcctggcagagggaacttcgtgagctagagtttggaggcagtcaaatggtagtgggctgggggaaaggcttctttcgtgatgtggctcaaatgtagggttagagaggataggagcttgagaaagggaagcagagactacttcccaaagggtttggaattaatctgtggattcatggtcctcatctagtaggggtcctgaatgagatttttcaaccatctgtggtggaatgagagaaaagtagggataatgtcgtgcagtgttcataaaactaaattaattcaactcaaaggactattctttatttggagactgttgtgtccttcctgtgggggtggggattcaaatgatctttctcctacaaaatatgagtgagaaattttttaaatgtctgccctcagcaaaattacaaagtttgcgacatgctgattgtttccctatttatttatttaagaacactttcctcatccatgaaatctgaaagtctggtgactactgttttggggaataaggggctgatttcagcataatagggatataattaagtggacggttttagaaaaagcactccagcagtagtgggcagggatggtgtggaagggcccaagtggagatgcagaggccaggaaggaggcagctgcagtggaaataaggatgggagaggaagaaatgatagagagctggatggaatgataatgacgagggaagggaaaattaaagtgcctttgaggtttgacgcccgagaggcacctctgtcccctaccccagttaactgttctaggtgcttggcatggatttaaatctctttgcactcattaccccaacttctcagatgcccagaaaacatgtcctaacccctgtcagcctcttggaaactgttgggctaggttaagagcagtggctcatgcctataattctagcattttgggaggccaatgcgagaggattgattgaggccaggagttccagaccagcctgggcaataatgagaccctttatgaaaaataaaaaaaatttgctgggcacggtgatgcataatggacacctatagtcccagttacttaggagactgaattgggaggattgcttgagcccaggagttcaaggctgcagtgtgctatgattgcaccactacactccagcctggactacagagcaagatcctatagaagaagaagaaggaggaggaggaggaggaggaagaggaggaggggaggaggaggaggggaggaggaggaggaggaggaggaggaggaggaatagtaattataggtatggtgtcacgcctgtaatcccagcactttgggatgccgaggcaggtggatcacttgagtccaggaaatcaagaccagcctgggcagcatagtaagactgtgtctctagaaaaaaaaatttaaaattagtcaggcatggtgatgcatgcctgttttctcagctacttgtggggctgaggcaggaggatggctgcagtgagtcatgatcgcaccactgcactccaacctggccatcagactaaggctatgtctcaaacaaaacaaaacaaaacaaaacaaaacaaaacaaaacaaaacaaaacaaaacaaaactggtgggctaggacagccccaagagaaggttgaggatctctatcatgggtcccagacgtttgcacgcattcacttatgagtgtgtccacagaggacatacacgtgcatttgtgcatattcaaccccacacacatatgcacaggcacaccattcaagtgtgcatacacacatacatagagacgaacacacatataccctggcacaaacaggcaaatgcacatgtacacacagacagtgcacattcctagcatgatgtagactcacacacatatgcatgcatgcatatacagaggtaagcacacaggcacatcagatacataccctcctatgcacaagcatgagggacacacagagacacagccaggcacatctccaaaaagcctgtagacatacaaaagcatgcacacggcgtgaaggtccacgtgcatgcacatgcatatgcacaggtctgtggttgctcatgtccttggcagatgtgaatcaacacatggctggatctcagggctaagaggcagcctgccggatccacacacttggactgcgtgctcccttttccaatgctgctgctttgaggccccagtcagaaaggcaggctctctgggctcgggagctcagtcaagggcacgggctgctgtgagccaccctccctctctgagccaggccccctgagtgcgggagactgaggggtttgaggggtggggaatggccgggacagatcctgtcagagctgaaagggccctctcagatcatcttattcaaacttctcatggtcctgatagggaaaccgagccccttccctcccccaccatatggagcccttcatcagctgaagaggtatgaggaggggtgaagcacacaaacttgggtttcaattccaccccacacccacaggcacacatactagctgtgtgccttcgagcaagtcttctccgagcctcaatttccttgtttgcagaatgacactaatcagtgcccgcctcacagaaatgccacgaacatttggtgggtgggttaagtcttttttttttttttttgaccgagtctcgctctgttgcccaggctggagtgcagtgtctgctcattgcaacctccacctcccgggttcaagcgattctcctgcctcagcctcccgagtagctggaattacaggcgcccgccaccacgcccagctaatttttttttttttttgtatttttagtagagacagggtttcaccgtgttggccaggctggtctcgagctcctaaccctaagtgatcagcccgccttggcttcccaaagtgcgggaattacaggcgtaagtcaccacgctcggcaaggctgtgtctttaaagtgcctgacatggagtaggtggtcaatacacatgatttgttggaagcagcttccgaaactgtgtactagaggcaccacagcaaagaatgagggttattctatatttgaaaattccagggttagggtctcaggtccagtctgctcctttgccacaactcctcagccctctactttgactatgcctgggtctaggaatagaagtgatccatttgggagatgaaggctgacaccccagaagccagggatggtgggaaggtggcaaaaggccaggccagggctcaggattgctttgagctgctcttgtgttaggggcagccaagggacaagacgtttaagtgtgagatgaacccagtataaatagtccaatacgtgtttgctgtgtcttcccctggaggccagtcagggcccggaaggcatccatggccccttggtacaacgaagcatgcatgagtcagtttctcacccgctcccccgcaacacacagccacacaccccacactccacacacatgaaacacacaccacacacacaccacaaacacatcacaccatacacacaccacacaccacacacatacaccacactcccccacacacacaccccacacaccacacacacacacaccacacaccacacacacaccccacacaccccacaccccacacacacccccacacaccacaccacacacacacacacccacaccccacacacacacaccacaccacacacaccacaccacacacacacatcacacacaccacacacacacaccacaccacacacacacaccacacaccacacaccacacacacaccacacaccacacacacaccaccacacacacacaccccacacaccacacacacacatcacacaccacacacaccacacaccacacacacaccacaccacacaccacacacaccacacacacacaccacacaccacacacacaccacacaccacacacaccacaccaaacacacacaccacacacacacaacacagcacacacacatcacacacacaccacaccacacaacatacacaccacaccacacacacacaccacacatacaccacacacaccacacaccacaccacacacacaccacacaccacacacacaccacaccacacaccacacacacacaccccacacaccacacacaccccacacacacccccaaacgcacaccacaccacacacacacaccccacacacaccacacacaccacaccacacacaccacacaccacacatacacctcacaccacacacacacaccccacaccccacacacacaccccacacccctcacacacaccatacacaccacacacaccacacacaccacagcacacacacaccacagcacacatacaccacacacacaccacacacacaccacaccacacaagcacacacaccccaccacacacacacacaccccacacaccacacacacaccatacacgccacatacaccccccaacacaccacaccacacacacaccacaccacacatacaccacacacaccacaccacacacacacaccacacgccacacacacacacaccccacacatcacacataccacaaacacacacaccacatacacacacacacaccacatacatacagaaccatttctttgatgtattcttttgcccccttccagcacttagcatggtgttatgcacataaggggtgcccggaacacaaatcctccctcatgttactccgcttcaggtgggcatatcaggtcctagagggcactggcttgggaggtgggaaatctgcctggagcgccatctcaaccatgacctctggatgaccttgagagggtcaattctctctcctgtccctcagttccctcctcttataggtagataatcatgcaatatcagagatgaaaaggcccttggaggtcatctattcctctttctctgttcctctctccaaactaccagtgaggaaactgaggcccagagaggggagagatgtggccaaggtctcagagggcatcaggacacagcggattccaatgtggtctgtgtaatacaccataatctccctactcgttctgtggcaaaatccaaacacaacttgtctctggtaaaatctaaaagcagtactgggggaatgtctctacacatgccacacacacacatgcatacatgcacgtatgtgttaacaaccctgccgtacctacccacaaggcttctatgggagttaaagcaaatcatggacagacagtcgtgtggactgggaaggctcatagaggtgaacctcccagtcgtgggccaacatgggatcccatgcttttcactaggcaccatactcacatacttaggtcatgcacatgagtgtgtatgtgcacaagggctttcctgagctcgcccaggcacacattctcaagcaccatctcctgtgaatgctctcatccaagtatgcatgagacttccatgtggctgctcttatacatggcttcccaggcacctgttcatatgggtgtgaggtttcacaccccctgtgcaggctcacattcatgcacacacacacacacactcgcaagtgaggtgagcatgcatcctccttatgtgtgcttgcccataccccagcccctctctgcccccaggccagctctcagcttcccaatctgcctaggagcagcctggcaggatatggggtgaacgtgtgacgatgatagggtgattcagcaatttcactcccagcctccaggatgtctctcctttttcattcctttgcccttgtcatcccaagtaagtccaatttgccacatgcagtgtgtatttgttgtggaaggggcagggggagtatagagaattcaggggttcacatgaatgtatacaaactcctggggctggaaagggacctcagagactcctcgatgccatcactacagagttgcctctatcacatcttaccaaaagaatggccagacacttgcacacctccagtgatgtggagctcaccgcttcctcaggacactattgcagatcccttcgtcagtctgatgtgtgtgtgtgtgtgtctgtctgtctgtgagtggaagtactaatgtacatgtgcacatatgagacagtatatacagccagccacgtcttaattacttgttccaaagaaataaattatgacataagactctcaggtcatggtaaaaccacgtagagggggaaaggcaagggcctatactccatagaaggaaggttcactcgcagggccctttctgcagagttccacagcccactcaaataacctgtcagctgggtgataggtattggccccctatatgtgtgaaaaattcagaccgtggattgtccctgacatggttaattgtaagatgcctagatgctggacatatgctgtgtaactttgaggcacaggcccatgggctagagcaaaataataagttgtggtaaggttattggcatagatggagctcaagagagttgtgaggtggcttctgggtgatctaggaagctttctgggaccagtttttgggaccagagtagaaggcagcttagtgttgccaaaggagcactggacacagagtgagactgacctggatattacgtccacctctgccacatctaggctgagtgctcctgggcctgtcacctctcctcagtggataagacttaatggagttgccagcgagatgatgtctgtaaaagcctgttacaaggtagatgctccattgaatctgaatctgaagggatgatctttggaagaaaagggcaaggagtgttttcaaggcagagtgaggttggagacatgtgagggaagagtcatagatccaagggacttgtcctgagtggaggtgttgggaatgaatggaaatgggaagaggaggaagaacaagagactttgaaatttgtctgtgggagtttgaacttcatgttcttgatgcagtgaaaagaccaaaacatctacatggagtcaagcccttcacctatctgagccacaacttgctagctgtgttgaccatgagaaagttacttcgcctttctcaaaagaagacatttatgccgccaaaagacacatgaaaaaatgctcatcatcactggccatcagagaaatgcaaatcaaaaccacagtgagataccatctcacaccagttagaatggcgatcattaaaaagtcaggaaacaacatcaggagagggtgtggagaaataggatcacttttacactgttggtgggactgtaaactagttcagccattgtggaagacagtgtggcgattcctcaaggatctagaagtagaaataccatttgacccagccatcccattactgggtatatacccaaaagattataaatcatgctgctaataaagacacatgcacgcatatgtttattgtggcactattcacaatagcaaagacttggaaccaacccaaatgtccatcaatgatagactggattaagacaatgtggcacctatacacaccatggaatactatgcagccataaaaaaggatgagttcgtgtcctttgtagggacatggatgaagatggaaaccatcattctcagcaaactatctcaaggacaaaaaaccaaacaccgcatgttctcactcatgggtgggaattgaacaatgagaacacctggacacaggaaggggaacatcacagaccggggcctgttgtggggtggaggaggggggagggatagcattaggagatatacctaatgtaaatgatgagttaatgggtgcagcacaccaacatggcacatgtatacatatgtaacaaacctgcacattgtgcacatgtaccctagaacttaaaagtataattaaaaaagaaaaaaagttacttcgcctttctgagccttagtttcttgctccaaaaaatgtagataatagtacccaacttacatggttattatgaagctcaaatgagttaatatgtataaagctcttagaaaaggggcacatagtaagcattgctcatctttattatttgtacactggggagaatgataactcctaccttatagggctgtagtaaggatcaaatgagaatgatcccaaagcctgttgagatgtttatttgttgttatcttggacaaaatgtgtgtgtgtgggggagtttccttaggctgagaatagccttaagtaattcattctttcactagttcaaccaagcaatatttattcagggcctactatgtgccagacactgtgttaggtcttgaggagataggtaatggtgagcaaaactgctgtaggtcctcatctcatgcagcttactgtctagtggatacaaaatgagtttttcacactcaacccccaagtgccctattggtgggcacgattgatttagtccagaaaatttcagtatatgaaactgttcaatgcgttaacagttttagttaatctagaacctgtgattggccatcccacctagtccttaaggcaaagggatagccatgctgaagtgtgagtaattcctgcaacagcaaagtctggaacaatcttaggctcagcctggaaatggggatggggacccctctgccaaatttgcctgatccgaagctcctaacccttgccccatcagcacaactggtgtgatttactcgagtcatgtgagattggataatatttgttctcgggggtggaagagatggggacgagcattgggaaggtgagatggggagtaggaagcaaggcttcaactctgacttaagtctcttcagatacagattcttactttgcttttagcttctttgatgccaaaaggtgtacaagtgggaggtcccggcggggtggaggatatacttcctatggctatggtggaggttgggggaggcaaaaatgagttggaagaggctgcagattggcaataccagacttctcttttacccctaaagactagagaaagttagaactaatactagctaatatttgcacttgatcttagccaagaggtcaggaagtgatactagctaatatttgtagagcacatactatgtggtgtacactgttcgaaaccctccacatatattaactcatttcaccatcacaataatcctgcaaggcaagctatcattgtcatcatcctcattttactgaaacacagaaaggtttagaaatttatccaagattacacagctattaagtggtgaattggggatttttaacccaggtaatctagtttcaaagtccactatgttcatgtaatctgtgctgcatttctccacctataaaatgaggaggctggattggtttatctctgagtctttccagctctgacagtctcattatatttcacatatacttctatgaacttccaggccaaatgaaaaaaaaatgctgctcccaaatgtcagtgatttccactaaagtccctcgggaggagagtggggagcccaggctcagggaaaagagccgacactggagcttggtcttcccagcagcctctagggcctgagaacagctggggacctgggaagctctgggagccagggcccggcctgcatttccaagtcacttgtaacaataacaaggagcagcagctcaggcagcctctgctgggatttggggtcagaggtttcacagtgggtggaggaacagacctcctcaactccatccctctgggcagcccttgagctgttgctgctgctgctgtcagggcccttagagtccaggtcaatcagcagttccaaggctgaggctgccaaggggcaggggaaaggaagtcctgcacttggggaatgggagttgaggccctggaaatggatgcaggctgactttccctggccctttcctctaccttgggttggttgccttctgggagctggagagaagaatgtagtatgaagatataatgtcatagatggaaataggacactgatctaacagccctggttctgcctcctcttctcttctctaagcctcagtttccttacctacaacatgaggagaatattccccacttcataattgattgtgatgatgacctatgtgaaaaggcctgccacacaatgggtgctcagtaaatatgagttgaatgtaaagatagttgattgattgctctaggtgaccctgggcccatagcttggactctgttttttcatctataaaatgaggaaacatttttacctgccattcccttcattccctggctgaggagagcctagaattggggacatcctgtggaagtgaaaggacagtagaaaacacagatgcgactaccctcagggtcaggaagtgggttgtttaagcaatttcctcattccttctattcccgcccctgctcccacccctggtcagactagtttagagtctggaaaagaagctccatcccacactggaatccccgtgtctctctcctccagccccttcctacactcacccttatagggcgcctctcccggaaagactctgcagttctgggcaggaaggagggtccctgttgactggtgagaaagtcaagtctttgggatattacattcctgagattatccagagaacccctgggggttgcagctgctgctgactctcctccctggccctactcttggcctgctgtggacatgaggactgtagggcccaaggcaggagaaagattgggggaaaggctcaaaggcaaagagtcaggcctggagcagccctgcaggccaggtgaggagtcaggatggggcaggaggaaaggatgtcctggcagcactggcaggaaggaattaaggggaaaagcgtccgagggagtaggaatttttgccaaggggagacttataaaaccatcagcattccttaggctataggttgggggcccttttcgggggtggatgagtaggtattagatcacagtcatcctggtggatagagatggaaagtcaggctttctgagaggccttctgtgaggcccacatactccaagccagtgtgggacagcttgcacccttggggggagacagaggggaggtaggtgttctgggggttcctcaggaggctgtcccagattctgagttctataaaagccttctagaatttattgcttccattgctctttcccagctgggattgttcctcatcctctcctttgtgatagaagactaagaattgtcaggcacctacctctcatttggtaacaagtctgaagcccagcaaagaattggtcaaaggtacagggtcaagcgcagaatgtgtcagtcagtccttcttgaaaccagctctcctctgcccttttcagggacaagattggcatcctccagggctgtagcaccccatccccagcagacatcacatcccgaacatgagcatatgtctccaggtcattgacatggggtttaaaagtggcaccgtgacaccagtgctccaacttaggacctggtggcaggctcaattgagcttcagcccacataccatcctccatctctactcagctgtctctgaactgtgagctgctctaagaaaccagcctgtgtctaattgacccctgtgtcctgcgacaacctggctcaaaacagcccctattctaggcctagcctagagaaagtttgccaagtgcatagaacacacatggactcccatgtacgtacaagtggccaaagccactgcacccaccttccagctgagagaccccaagacagaggagtcagctccagagggctcatgagagcctgctttccacagtggccatggtctgtgctggcaaaactcaggataggcctgggggcggtgagagcccactctggaagaagggagggccaagctgtgaatagggctctgtgtggcccggctgagaaggctgggggaggctggaatgtgaagaacgtgctctcatgactgtggtcctaggcctgggtctatggcacaggactggctaggagtgaggggtggggatgttggaggtggttagagaaggaagggagaggtggggcagagaaaccaggcaaggcaaggaaaaaaagtctctccagacatctcctcagataccagggcaagggctggtcctagagcctggaggctgagcgaagaggatgctggggagagtgagctccatcccagccacttgtggctgaggatggcccggttctggacaaagcttgtccatagcctttgcagcttgtctccaaactacacctctcagacctccctacttctcacccagcaaccatcgttctgtttttatcctccttttggctctggctttcgcatttgcactctttcaacgtgtttcccttttctctgaaaaaactcatgatctgccttttatttttgcctggcaactgtatctcccactagactgagagctcctccagggcaggaatcacatctgcttttgttcatgtttgcatctgcaggtctaccccagtgcctagtggactgctcagagcagatgctccacagacttttttgaattcaacaggtctaaggggaaattcattacaacaggaagatttccccccgtatacccccaaataactttttcctctgttcctgacttcagttaatagcaccaccatccacccagttgccaggccagaaacattggggtcatccttgactcctcgcttatcttcccacatcctatcatttactttggttctaccatgtaaattgtctatatattggtccccttcttcctaccctaaggaccactgcccaacccagaaccttaccactaactctggtctccctttgtttttccttctttctttcttttccttccttccttccttccttccttccttccttccttccttccttccttccctccctccctccttcctctctctctctctctctctctctctctttctttctttctttctttctttctttctttctttctttctttctttctttctttttggagtttcgctcttgttgcccaggctggagtgccatggcgtgatctcagctcactgcaacctccgcctcccaggttcaagtgattctcctgcctcagcctcctgagtagctgggattgtaggcatgtgccaccacgcccagctaattttttgtatttttagtagagacagggtttttctatgttggtcaggctggtctcgaactcccgacctcaggggatccacccgccttggactcccaaagtgctgggaggccactgtgccgggcctctggtctccccttctctagttttgcctaggccccccattcccaatccatccttcactcaacagttagagtaacattccgaaacataaatctgactacgttacctctctgtttaggccccctcaatggctctccattgggctctagataaagtctcaagttcttaagatgacctataaggcccttcgtgatctggcccctaacctgctgcttcagattcatttcccactctctgtctggcactctgctctccagctagaccaaggtcctaaatgtgacagttctgggaaatgagatgaacagacgggtgggacaaaccacaggctttgatacatcctcatccttttctattctctcccttctacctgccaggctctttgcccccttgtcttcttgatgaacaactgcttagctttcaagacctgttctaaacactacttccttcatgagggtccttatgacaatgtgcccccactcccagcaacaaattactccctctgctcagttccacaaggctttatactttccaatagcactcacattgaattgtgatgatttgtgcatgtaatcgactccccctctgagctgagagttcatcaagggcagggaatatgtctgatctatatgaatccctgagtacctagcacaggacttagctctgaggaggtacctaatgaatgagtgaataaataaaggaatatatgaatgaatgacccactggatgagaagattgtcaccactaatcctggtcttcttctagagtggctgtctttataacttttggattcttggcctctgggttcagaacctccaaatcagagggatatgttctacaacaaggaaacaaaaagggccttcactttgtagcagaaatctttgatgcaaaagttcatatgctatcttcccctgtaagtctttcagctaccaaaatagcatcaagattaaggtcaaaagcagagtgggactcatgggcctgatccaatccaggttattctggacctcagagagaaaaaaatagagtgccataaaattgggagccctattgatctcaagcacagacttggttctgacatttaccttgaccttgagcaaatcatttcacttctgtgccccatttgccttatgtgtcacatgaagataataaaatctaccatgcaagatggttgtaatggccaaagaaggtcactcatttgcaacctataaatccctaaatttaaggcctacttatctcctgaactatctgtaattctgttaaaactatgatgggttaggctggtggagtgggggagtaggagatttaataggactagagcatagagtacagtctgtcccacccatcagttcatctcttaatttccaagaactgtcacatttaagacctcacaggggcctgctttgtccttctcttctactctctcatcctttctcattcttctttcctccccctttgtctacactgagaattatattgacttgcttaatcatagttccactttgtagctttgtagcaaactttcatatctgtcgctattggtctttctcctctggtcacgccgatctcattctagaactttttatctccttcacactaacatccctcaagggtcctgccagtgaacactcgggaggacatcccccatccctcctctctcctgtggccaattgtgggctacgagggtggatcagacctttagtcattttagggtaatctaaggctgagacaaatcttttaggattaggaagcattgtggtcaagtgtctgcacctggtatggcagtcattgtgcagagggtaagagatagacacatactatggcaactattttcctgataaccacttggttggtttagaggctggctgtgtgaaaggagaacaggcaagaagacccttctacctctaagaggtacccttctttccttccttctttcttttctctcctccttaactattgaatgaatgtctctacaactaccattttagcccaagccactgacattgtttgcctgaactactgcaaaagcctcctaacagatctccccacttccaccctggctctacaatccacttcctacccagcagccagagtgaccttttgaaggtagaaatcagatcttgtcattctcctgctctatatccaccaatggctgcctactgtaatttgaatcaaagtccaaatccttaccctggccttagcctctcataatttggccttcgtttctctcttcaccatccgcctgaaatgctcttcacctagctcttcacattgctgacaacttcttgccatctgggtctctgctcaaagttcagctctttagagagacccctcaggccacctctctatccccccactcaatcactctctacctcatcctgtctttaaaagtttctccttcttggttcttagtgatgactgaaatttccttatttctttgtttacttatttattgtttgtctcttcctactaagagttcagctgcgtaaggatctcatctgtctagatcactgctatatccttagcatctagcatagtgctctgaagggcactggtattgtataaatatttgttgaatgcatgaatttatagagtgcttaatcattttaaaaagtgcctttatgtacgttaatttgtcacaaagcctgtgaagtcgggattattgctttcctagtcttatgaatgcagatgctgaggctaaagaggttatgagtgatgttcaatgtcacataatcagtaagcaggggaaggtgaccctgaacttgggttctccaattctgaatactgcccttgccaccaacacatcctgtttctagccttgttgatgctataccaaggatggtatgtgccaagcaaatgttgacttattctttaataatctttcttatcaggcctcggaacagtactgtgagctgtggcagagtgtctccaatcccctgacctgggggccttctccattcagggagagtgaagtgaaccagcaggatcagccatggggtagcagaaagtacagttgtatggagtgggcagccaggagtctgggtctgggctccactttgctccttacttcattttccttttctttggacctccatgtgtctttctgtaaaatgggtaatgggtagatcgaacttgctaactttaagatcgctttcagttcagatattgcatctctgcaatgccttgacttcttctctgtttcttttgcagtgcttcccattgctgcaggtgaagaagaacgctggtaagtacacgaggtgggcattgcaagtggcatacaaagagactgagcttctcagtagtcctcatggggcaaccgatcaggtccctgggcagcagagccaacggccgagatgcaaaagccggagacatcctctctgtctccctccactgggcatttgctgtcctcctcgggccctgctttttggctcacgtgcagagcctctttatttctcagccggaggttttgctcttgtcagagagccaggggaggacttccctccagagctttcagcaagtggcagccacccatatacttcccttgttctcaaatgccttctttccactgggaagtgtattaggggtgagagatgcctcaggagagaaaacaggtaagtggagggtaaaggaaggagacttggaatttggggttcagtgtctgttatattcccagcacttgctttatctagaaggcttccaacaggaggtaggctttggagttcattagactgaggtgatatatatagccttttccttttgctctctcacaagtttctgtgagcccaacttcccatcttcctggtgcctctggtgtcctacttgggtgtggataagtggatggcatactgggagcaactaccttccattgagaaggatacagttgtctagagagggataacagctttgtggaggaagagaaagaaggctactggccagggaagagtttggtgctggagcctgaactcctggtatcagctgggctttgctaaggtcatcgaggccatcgtcctggctctagcctgacttcagccattcccattggctccaatttttcatcaggatgagctcatgacttgaatgagcatagcttctaggagacagttaggattggggttgccaaaacagaaaggcatctattaacaagtggcatgctaagggcctgtgcaaggcatcttgggaagacgttggaagagacaaccagaacccttactaataagaaccttccaaagtagttggagctggtttgggcgaatcacgccaggatgcagagagaggattctagtgacttcccaaggacgtttccatcttacggctctgagtttttgggtggtggctgctacaaaacaagaactgataggtgaggggtttatttgcattgccatgacagcagagaagagaggatttattttgaaacaggaacactgctttgatcagcatacagcatacatctgcttctccacttccccaccctgcctttccccgtcatcatcattccaaggcgtcttgctgcgcagtttctgctttgcaacagagacttctgagggcacaaggtctgtgcactgcccatactaggggaaggacacacttctccatttcagagacaccagcttcaaaggctaaaagaaacccctcaggccctgaaatagtgacccccttagatgaatgcacccacagctgccaagttacttctttagaatatctgtgccaggcagaggtgccagcactgagctctgggagggtggcttccagaggagccaggactatcttttactgggtagggtcaggcagaggaggttgccacctacaaagctgagatgggactggtctttctgctatttcttaggttaaagtttgaaaatgtctatttaaaggcaaatgggaacacattgtttcaggctgattcaaaaacaatctgacataaattatgagtttatgtggatgtggaaatggtagcagcaaggcactgggaatcaaagcacctggattttagcccaaatttcattatagattcactgtgtgagcccaggaaagtagcttcctctgtctgggctggcatctacatctacaaaatggagcttattgcatgggactcttgtatggatcacaatagacagcgcattaaaaatgtcaaagtactgaacaaatgtgattgtttctgaaatttaggtcagggggtgagcagaacgcttcatctgttttattacgtattatttgagaaataggtaataccttcacaggtttcaaaattcaagaggtacaaaaatacaaagtctcttctcaccccaagtccccaaccacccagcagtcctcttagaggtgatcagtgttagcagcttcttggccctcgatgagtttagaaggtctgaatcaagtgagctgtgctagatgggactgcgatgggggctggcactgcctgactggcctgggggtggggctgaggggagctgcagaaagggtcatggagcaggaatctcggggcaggaaatatggggtggtagaatcagcattcttttgggacccagtcttgactgtgccactcgtggtggaatgataacaagtaagaggcttcccctctccgaacctcaatgttctcatctgtacattgagcctgccccattctcctaagccatttctcccaagtgtgaccagagcagaacagaagtggtagaggagaggaccagccagggactttttagtgacaaaaaagccaaaatactgactctgggctgacagttgtatataataatttccctctttctctctctttcttttctttctttctttctttctttctttctttctttctttctttctttctttctttctgtctttctttctttctttctctttcttttctttctttcttctttctccttctctttctccttccttcctacctacccttccttccttccttccctcctccttcttctttctcttttttctcctctttctttctttctttctttctttctttctttctttctctttctttctttctttctttctttcttctttttttctttccttccttccttccttcctttttttttctatgagacacggtctctgtcactcaggctgaagcgcagtggtgcagcatagctcactgcggccttaatcttctgggcttaagggatcctctcacttcagcctccttcctcaatagctgggactacaggggtgcatcgccacgcccagctcatcttccttctattaggatgaatcaagcaaagatttatctgacacatcattgcttttgttctagtggtcccactgacagaggaaaccttgtaagggctgtcacaggatcacttggtaccaccttataggagagcattaggaatgtccaactggcttcaacacatgtggtgctgcccaggcccaaaagaatgacctgaattacctttgaagtccctgctatcacagtccaagaagccactagcacagtgtttcccaaatgtcacttatttgtgaaccaacttcagaatttttgccatcacatcatccatgccattaagtacttaatatttttctttaaatcaacctgattttaaataataacctcaccctaagccataatatctatgaaattaggttttgaggcactagttacatttttcctaatatgtagtaaattaaatatatatcatgatgcagatgccaatgtaccaccccaaatcatcctatgccaacatatatatcaaacactgagaaacacagagctagcggtagtaaaaccagcagctcaggaggaggttcaggccttagggactcactccaagacatgctacatgctctcaggctcccagcatcacttcatatttcttccagacccacacaccctgttgcttgagcacaaattgctcctaagatggaaaggtcctggagcctaaaaggaacccgcttcctccaaataaaacccacaattcaaaactgcctcttaagtgctgaagtgagaatacttgattggggccggaagctccaggttccagttttggctgtgacctttgccagctgtgtgtccttgggcctctcgctttccctctctgggccttagtgtctctaactataaaatgaatagcttgctttaaatgacctctaaggtatcttgctgttctgaaattcaatgactccttgacttacaaaccccacactccgcggagctcattagctcgcttaccagcagcccacagaggtgaggaggctgctgaccttccctcccaccgcctttgcaccaaatcttccccaaggccccctgctcccagtgcacaaagctccttttgttgcctggagccattcggggcttcactccaggctcctgctgaagtggctgaggtggcctggtggggtaatagtttgcctgtaacaagagcccctgctcgcaacccaactggctccagtctggctgcaggcttggcctcagcatcagactcatccatcagctgccccagacccctcccccaagctctgagggggcggggagacagatttgaacagtagaaaatggaaacaaatacatttatttaacatgctattgggtgtctgtcacctccaaggctcacaagggcagtagacaaaaatactaagcatatgaaagtcatcagaataataataattcaatccacatcctttcttttgaaaatgaccaaatcatttttataacggagtcttgacagatctggtcatttaacatttgttattttacaaagaacatttgcagggcatggcttatctaacatttgacagatattttacccagcaacttggaatagtataaagatctacttagttagggagcatctggaatttattatcatttgagacaggaaatcttttaaccatgatccacagtgaattcagccaaggtaaaaatgctgggatgtgacttgagagacctaggatctagtctcgtctccatcattaactccttctgcgaccttgagttagtcacctctgccccatgggcctcagtttccttgtctgcaaaatgagaatgttgaactagagggtctcaagattttgattttgcactctgaccccctctcctccagaagtcaggctgaaaggaaggggaggtgggggtagggtcagtggaaagggcaatttcaaggtgttctttgggatggggggaaggatttccaggcctgtggaggagtgtaagggcttcttttgtggcctaaggggctgggaagcccaggttctcagttgctgttttcaagagtgcaagacagaattaggtctaggtttagagagtcaggtcaggtacatctccctaggtatagcctagatgaccattttcacagtgtaggccactccaaatcaggagctggagagggcatgggaacttcaggtggaaagacaggtctgaaaaggacctgggaagtgctactggacacttccaccagaaggtcctgtggatccttcaaactcaacactaaagatcataattctttatcatttctctggaaacctcctctttctccagaatccgctttcttggttaaagcagccccatgcacccagccactccagcaagagtcacgggcgttacctggactccatttttctaatttgctgccatttagttgtgtgcatgggacctcttcataaggcttcctaaatctaccgccttttcttgtcactcacactagcatagccctccatctgggccctagcagctctggccttgatggttgcaaccgctacctaactggtcttcctgccaccatgctcgcccttccagttcaccctccatgctgctgccaaagttctctctttaaaagaaaaacttaggcatcctcaaaaatctttggtcatttcctacctttggtcaaagtccaacttctttgctctggcattcaaggtctctcaagcttagacagcctatctttcttgcttcctttcccacctcgttcctatatttctgagccccatgggacaacttgctatttcctagacagacagtgaattctcatattggactctccactgagtgtgttgttgccagcccccttcttggcctgtcaagccacactctggcctccctttccatcttgtccatagctattacattataaaacatcacactgttctgcattggcctcttttctttcctgtctctcccatagaccatgagctcttggtgtacaatggctatatctgactgacccctggattcccagaactaagcataaggtctcacataaacaatgagtctgccaagaactggcttttatttttgatggcatagcaaaagaacttctggtaatcagactggtgacttcttcctttcagcagactttcttccctatcatttcagctctgaactagctattacagatcaacatagagccccactggctccagatgacaaaacctcttgagacagggccttaaggatccagtggttccagccaatggtgcagatccgtgtaaaacacattttcaccaaactcttgaaatttggaggtcgcccacatctcaaggcaggaagggcacttaaggactatattaacccatgcttttgaaactgagtactgaggagccctagtgtcccctagtgtcttaggggacatgaaaggaagacagagttatgggatatctcattcctgcttcattcaactaaacctatttgactttttgaagtttccatgaacatttcatttggagactggagttggcggcattaaagtttcatttggagactgtagttggctgcattaaatgttggcgatcatagctcgaatctggtgttcaattttcccttttttacctttcctgctacatgcccaacttgagctttgaccaaactcctcaggtatggtgaagcatcctttttcattctatactgttaaaagttctttatattgagccagaatctgccttacaacaacttccacccagtggtcctattttcaccccttggaagtagtgtgttccttcttccttaaggccaatctgctgtcatttagaatctcccaaagtctaaggtaggagagatcttatagctcatacagtccaatgttctcgttgcagctggggaatgaagcccagagaaactaagtgatctgcacaacagcatagagctagttggcagcaaaactgagactagaacccaagtctctactcatctataatgcgctccccagaatctgtcctttcctagctcctaaaatcgtttctcacagtcctgatcactcttcactacacgtactcctgactgacagtgaccaatggctgaagatcagcagctgagcttgtgaaagctccatggctcccaagccttggtctgcctggggagaaggcagagacaaagcagaacaaactggtgtcagaagcagagccgttccctcaccacagcctgaaagtcattctcctcatccttctcttctttccataaaactaaattccattcaaacagcgccccaccccccatggcagggcagccaaggggcagctttcagaggccccttctgacctgtttgctaaagggttcctgctgtgtgaccttccacatcccaagcccagaaacaggaagagttagtttggtttgctttttgggaagaaaaatgaaaacataggaagtagggctcctgagaacagaggcttccaactctgtgttcatttgtccctggagcaggatatttcagggaatacattccacaggggaagggaacagcctcccttattaaaaacaaaacacaaaacccttcaaggtttggaaaaagaaaaaggccaaaaggagacttttaaggaggggaggggcaattgttttataatctccagcccttcacccccttggccacttggagctgtcatactttgatctcactaccattatcagcacatctgttgcccagagatgtcctgctccctttaacctatggcccaagaaagagtccaagtctcctttcttgtttccctgaggatgaccgaagtaggctggcactcagaatcttcaattaaaaccaagaaaaaacagacagtaattaattacacaatgcacaaacagcagaacaacattcaggccttgccaagtacatgctttttgttttaagaagcccagcaaaagcagggaagtgctttgtcagtccccaaatatctcccaggataactatttcatcgtcccagatacgctgccataagtttgcctggctttttcctccctcagctgtcagtcactgggaggcagatgccatcttgtttccctactactgttgctagaagggcaatgcaacaggtcttttaccaaaaacaacaacaacaacaacaaaacaaccttccagaacccctactgttcttttcagttctagtttctgggctgaggaacatggttagttcacagatagttgccagggtaaaagtgtggatcattttggggtgccaaagaaacatatagccctggaaggaaaccagctctgcctacaatctggagcttctacaggtacacatgtacatgtgtcacatgtgtagtgtgcaaacacacacatagtctatttaccaaaattttagtttcatggaataacaaggccttcaccatacaaaaacataccattgtctcccctgaggttatgggtaagcagaacctcttcctagaagatgcttccaagagcatctgcctagaatggcttgtttttttccaaaaagatctggaggcaaaattttcatattaaaacaagcatataattgttgtggaatagcataaaaaattcacatgaattacctgggcatgatggctcacacctgtaatcccagcactttgggaggccaaggcgggtggatcacctgaagtcaggagttcgagaccagcctgaccaacatggtgaaaccccgtctctactaaaaatacaaaaattagctaagtgtggtggtgggtgcctgtaatcccagctactcgggaggctgaggcgggagaatcgcttgaacacagaggcggaggttgcagtgagccgagatcgcaccattgccctgcagcctgggcgacaagagcaaaactccgtctcaaaaaaaaaaaaaaaaaaaaattcacatgaattcataagataaaagtggagacttgaaaaaaaattctcacttgtggttggctgtgtgagattctcctccagctcctcgggcctctgtggggaataaattctttctgttcattggaggtactttggggatgcaaaagtctgagagccacaaagtaaaacagtaggctccttgagggtagaaacgtctcatttttctctgtatcctcacatctgaaacagagccagccacagagtgcttgggaactatttgctccattcatgcatccatccatccatccattcatctatctatccatccttaccaagaaacaagcaaaaaaggtagccttagagtggtggaaagaatacagtttctggaaaattcataaacctctgggtctgaattctgactctgtcacttattagcctcagttttcatcacgtctctaagcctcagttttctcaggtttttttttttgttgttgttgttgttgttttgagatggagtcttgctctgttgcccaggctggagtgcagtggtgcaatcttggctccctgcaacctccacctcctgggtttagttgattctcccaccttagcctcccaagtagctgggattacaggcacgcaccaccatgcccggctaatttttgtattttttttttttttttgagatggagtttcgctcttgttgcccaggctggagtgcaatgatgagatctcggctcactgcaacctccgcctcccgggttcaagcgattctcctgcctcagcctccccgagtagctaggattacacacatgcaccaccatgcctggctaatttttgtatttttagttgagacggggtttcaccatgttggccaggctgatctcgaactcttgacctcaggtgatccgcctgcctcggcctcccaaagcgctgggattacaggcgtgaggcactgctcccagcctaatttttgtatttttagtagagacagcgttttgccatgttggccaggctggtctcgaactcctgacctcaggtgatccacccgtctcagcttcccaaagtgcttggattgcagggatgagccaccatgccttgccctagttttctcagttttaaaataagaatccaaatacccaactcctgagttgatgtgggaccttaagtgtgataatgggagtgggagtgctctataagatcccagacaatacagaaattatagttatttcatgactatcaaattaccaccatgactagcccagacagtagtggggtggggggaggggaagatgttttctccagccagaagtctgatttgagaataagaaagcaggagctgagacctcaggaatgagcccccgggcctctgggatggagagggcagatgttgaatcctagctccagctccacctccactccaggaaggcagtacgcaggccagaggggaacttggggtggagtgatggaaggatcagatgtgcctcatacacttcaggtctccaaagaccagatgtgctttccttctcacgtctgccaataagcccctttgaggcccggtttgcagcaagggtcattcatcactggggctgaaatacaaccaggcatagtgtgttgacttggctgctaacagactctgcctccttgggtaagtcctttttcctctctgggccccaatttccctatcattaaaatgaaaggattggatcgggttgtccctcaggtcctttgagctcctacacgctgtatttaagacttttttgggccttgattttctaaaaatgtgaacaatgtgatttgccaaaaatataattggtctgatcatctgatagttggacactgaatcatggatgggtgaaaaagttcaaagcaattgtggggcaggagacgggcctggctggggccctcttctgtttttaagtctgctggttcctgtggctccttctgtacgtgtctgtgtctggccaaactggcccggctcgcctgaaaatctcagagcaagccaaggttgtagcccaggtagatggcttgtggatacagcaggtgtttcccaagccctgggatccggctcaggtacctcacaagataaaatgaggaaaggaaagaaaacaggaaatcctacccactatatgcaactaattgtttaggaagaattccttctaggcaagcccgttgtctcagaagtcagcaacagctgctgggttggaatggctaacttgtgcaatctctgagattcttaggctccccccaaaccccgtctcaacctgtttagccctctgccattctctgaagctcagctcaaatactgttccctcccactttcaaatccccatcatactgtatatctgtcttatagcatgaatcatgccttgtgttttgagctatttcctttcacctatggattaaaaataaaatacatgttctgagtgaaaattccaacctataatctttcactctcactttccagagttagccgctctgaaaaggttgttgttttttgtttgtttgtttgtttgttttatttgtttttcctttccagaaatcttctattgccaaagctattgaaaatgtgaggttgggcttggtgacttatgcctgtaatcccagcaatttgggaggccaaggtgggaggatcatttgtgtccaggagtttgagaccagcctgggcaacatagggagaccccgcccctaccaaaaaaaaaaaaattagccaggtgtggtggtacatgcctgtagtcccaggtactcaggaagctgaggtgggaggatggcttgagcctgggaggttgaggctgcagtgggccgtgatcgtggcactgcactccagcctgggtgacagagtgagaccctgtctcaaaaaaattaaaaaaaaaagttttgaacagagcgttggctctggagtctaagcacttagatttaagtctcagctctctgcttgttggtcagatcagcttcagcaaattctatcacccctttgaccctcagttgtctgctctgtaaatgggatagacatgtcctcttctcctgtctcacagggttggtgtaagggccaaataagaaaagagattgaaagcaccttggaaactgtaaggggggccctatttatctccatgcttgtcactgcaacttgactgtaagcatctttgaaacagaaacttggcccctcgagggctgtgtccccattgcctcttgttccagtttgtccagaatgggaaggtggtgatgccgggggtatggaactgaatccccagagtcgtgctacacctggagatgctgatgctctgctcctgccctggttctgggtacacagctacttgaccttcctttgaagccaaacccagctgagaggaccatttttctaaagttacttggcttgcaaaatgctgctcctccaccaagtgggcactggcccagcctcactgccccagtgtgctttcattactttgaaaattctgcaactcttgtttcaccccctctacctccttcagctcctagttcctcagattctggctccaagtaatgatttcaaagttccccatgccccccacccacccccccaatgtatgatacatatatatagagagagaggaagtagaaagatgtggccaagaaaattcaattttctgaatggatcagatgtaaaactgttggaaattacagctagaaagctctgcagatagcatttagtccaacctgcatcactccccttcaacctttgacagaagggaaactgagacccagaaaagggaagggacttatgcagggaatttgcggctctgacctccaagtaaaggtgggaaggggcgagactctgcaatttaccaatgcaccgctgaaagggttaaagtcaaggaaactagcctggggaaggtgggtggggtcaaagaagagatgagtgtggccagagaagggaggatcaatcaggagaaacagtcaggaccagctgcaaaattcccctggaaagtggaaatagaagaaatatgagggttgtggtttagcaagttattatgagccttgctgggcaaagagagggaagagagaggaagagaaaagtagagggggcccaaagaggagtaaaaagggaaggaggaaggccaaaccagacgaatggaggagtttgagagtgatagggtcagtgagtgcttaaacacagcaaatcagtagagtcctgtcccatgtggggcatccagctaccttataagttaccactagctctgctgcctggtttcttcttctaggctctgagcacatgagccagtccttactttcttagcaaactcagcccttttccactgtccactgtttggagaggcagttccagactgtaggctttttacttcagtagagttggcacaccaacacaagggcactgtgcagcctggcctggctgccagagcaggctctagatcccccactccacagtcatgatctgattttagtcacacagtcatactatgagttgaactcagcccattttacagatgagaggtgcaataattttcaaatgaaaacaacaacaataagaataaacctaagtatatactgggaaacaatacacgtactgattaagaatgagagtgctggagacaaacggcctgtattcagatccccattttgcccctcattagttgtgtgatcttggacaggttgccaaatttctctgtgcaggtttggaaggatcaaatgagttgatccaagtatacaacctttgaacaatgcctggcacatagtcggtgctcaataaatggcgactattcttgccattgtcattagtatgtgccagatgctgttttaagtgttttatctgtattatgtcatgcaatcatcactcacaaggtaactgaggctcaagtgcaagaagaatatatctggttcattggcttttaaaacttcgttagatgcagacttctaccccccaaaattgaatcctatgtgacaccccaatatataaaacaaaacaaataaaaacagcatggctctgattgaagcaaggtggggtaggggtgggacttggagactcctggctcagtgttccctgttctcccctcccccagcctccctatgataggctttgaggctcttccccacccactgatctagtccatctaaactttttatgctcagataaagacattgtaactctgagagagcaaataacatgcccaaggttaaacaacaagtcaaaggcagagtggggtaccaggcatgaagggacaatcacttggtcaaagagaacagcccccttggttaaactagaacacagaacatcccaagcttgggcaaagaagagctaggaaaggagagtgagcaggagggaagggggatccccgatgtgagcagccccactgactattcatatgctgctggggccatgcagacgtcaagatgagacaaagccctatccacatggggcctctcattgcacagggtttggggttctgttgtgacaagggatgtagcctcctctctcttaggtgtctgttctgtgggatgcagctgactggggccaaatcccaccatctaggccttccgattgggctcctggcctgagctggcattaccacaactccccttctcctccagggttctgggatggcagcttgacttccaacccattgttgttggggtgggggaggtaagaggggtagacttgacgctccgcccttttcacagcttccatgtatgtgcacccctatctgttcaaggcatgccactgccaacactgtttatctaagaaactgtgcgtcgccaacttttgtctctaggactttggcatgggttacctggggacaccgccctgaggagaaattataggataaatttttccagagaacttcttcgagaactcaggacttccctggaatcccttctgacctgatctcgtgagctactcaggctccgtgcaagccttggaagacaatctgcagggccgagcaggggaggggcaaatgctggaagacaaagctcaagtgcaaggccctgagttccttgcctctgtttggatgggcttcaggatctccatctgtcccacgtggggcaggcatggatcagatgctctctgaggacccaccagctccaggctgggcttgtgtggaagccctgaccactcggtgctctctcaggcactggcctagaatccgagggggacacaccaagtgatggaaacaaacagggcccctggctagtcacaagagggcaaggatgaggacacaggaggcagagtactgacctccaaactgcaaaacgctcctctgacaccaaagcagcttttctttctggcaaggccagtttgcatgaatggacagagccctggaatcctgagccagactgcaaggcatgtgttactgtgtgttggtgctgtgccctgccaggtgacaggaagaggaaaaggggcttatgcaagctctgactgaggggaaggtgtgtgtactaaggccaggaagtgggggtgggggccgctgtaggtgggcactgtgactacttcccagataaaggcagaaggaattagtgagcatcagacctgagtggcctacgtgatacaagggcaagaagaaagcagcgaggcagggtgaaggggtaagtggtgacttttctgttgacaaacacttctttccacctaatagttcagggaggtaggtgttactgtctccatttaacaagtgaggaaactgaggctcagaggagttctatgacatgtcatctagtaagtgttgaagctgatgttcacatctaaggctgttttgagagttgcagttcttaggggccccttctctagagctggtaaaatgtgcacacatatacactgtttctgccatccagcaacccttctaagacttggccgcaaagggctaggaattatccttcccattttactaaagcccagaaaaggtgaatgattgggccttagtcatccatagcaaggtagagacaggcaaaaggctgagactggggggccttctgatggaaagctgccgtacgctgctagaagtagcactcccactgtggttccacctgtgtctggtcattttccacttacgaagtgctctcaaatccattatcttgaggtttacagggcagaaaaaaaaatcttccattttctaggtgaagaaactgagcatcagttacttgccaaaggttacacagctactgaatggcagagtcaggacttgagaccagagttgtgtccaaactcccctttacttttctgccaagtgcatgtggccagcaacggaaggacagagtaagttcactgaaacataatgtttgagaccaaaagcaacaaaccccaactccctggggagatatctaagcccttctcttttttccatatgaacctctgaattgcagaggcaggcttgcagcctttgaaggggaaacagagaagccaatgagctcagttctccacagcagactccaagagctgctggctttcatggctaactagatgcctcatcggcccaatggctttgtggtcagggtgccagggttggtccagccacaccaatggtgggactgggggaaggtcttctctctcttcccctctcaccacctgtggttgcatttcatgcttggtcattgagtcatttttatgctcttttcctcagtaacatgggggaaagaaaacctcaaatctctcagccaccatttggtttggtcaaggttgctcctgggctttccactcacccacccacctactcacttactcttcaattttttttttttttttcagacagagtctcgctctgtcacccaggctggagtgcagtggcatgatctcagctcactgcaacctccgcctcccggtttcaagtgattctcctgcctcagactcccgagtagctgggactacaggcgcacaccaccacgcctggctaatttttgtatttttaatagagatggggtttcaccatgttggccaggctggtctcaaactcctgacctcaagtgatccgcccaccttggcctcccaaagtgctgggattacaggcgtgaagcactgcgcccagtgcattcaatcttttaatgaatatcctctcaagtgctaatgctgcgccaaatcccttcctgagcaatggatatgccattaataataaaatacagcccctggctgagagaattcaaacccttattgggcaggaagacatggataattaaactcgatatagaatgattgctgatgtaactgagctgtggagtcacccagaaagggaacaccttatgctattcataggagatactgtactaaactggtatgttggactttaccaagtataggagatagggcaaataatttaacctcttcatgtcttcatttccttatctgtaaaatgggataatagtacctacagggtttctgtaaggactttatgagttaaaatgtgcaaagagctgaggatagagtcaggcacattgaaagcaccatataaatgtttgtgaaataagtaaaggaaataaggatgagcattcttgtgagagagaagtgcacatgtaacacatttggtgggttaaggaggtgtgttctgggaatgccacctgcgttaactgggcagtcttgtgggtgctttgaatgccagtcttagaagtgtggacttgtccctgtaggtgatgggcaaccatttctaaagctagatctttgccacagagtgtggcagaggactcctgtgtgaaatgctagtgctgtatccaccagctcaacaggtgctaggcccaagagactgccaccagccaggaaacagtcagttgccaaatctgaacgctggaccagccctgtgcatggctcagccccaggattagcatcgatatagggaaaggggcagcagggagcccccttgtcactgccctcaaggagctgatcttctaattggaataaggcctgcttctgccaataatcaaatcaatcatcctggtgggaagtggtggaggtaggtaggtaagagaaactccatgtggcctgagaggcagtatgtacagtggttactagctaaagctgacagtccaaactgtatgaccttgggcaaattatttaacctctctatgctacagttttcccattgaaaatggtagcaataataattcagcttatcatagagttatatatgatgattaaatcatatatagaaagtgcttagaatgctggctcacatgacaaacactccataaaccttagctattctcagtgactaagggcctatcttttactgaaccaggtgcctgctacccctggggtacaaggccatggcctggaggcatatgaaggtattagaccggtatgtctcctcttcctggagtgtacattttcctcaaaggcttaaggaaggaaaagatgaattttaataagaaaacaaggatgcatactagagttaactgaaaattcaagtggatgtttaagataaaagctggacttcaaagacattcccacttggagccaacacttcaggtttacatcatcagccccccaaggtttcatcacattcttccctctcagcccttaggggtacttgaatacaaaagttacagtaaaacaaacacttgtgaattcaagtaactctcaagggggtccaatcattctctgggggtaaggatgattaccaccgttatatatgggtgaagatggaggctcgaggtcccaatcctgccactgccacttatgagcaatttggattacctttgctgcttctgagtttctccaactgtaaactggggtaatgatgatgatatatatacttcagagcattgtggtaagaattaaataagcacttagaacaatgtctggtatagcttgtgctcaatccacatcagcttttattagatccattcttgcatctcctctcacagcaccattgtcagctatgtgtcatattatgtccattatctggaggagaaacttgaagctgtggaggttcagtaaggtgccccctctcctcctctttgctaacagcaggcattcctgcctggagtggggaggtggtgggaataaataacctcgaaggtccttcccagcaacagggctctgtgactcaagtgaatcttcggagctctttcatatcactgttctggctggagctgaagcagcagaactcaggaaataggggtgggactggacagggcgggagatgccttagcagggtgggaagtgactgctgccgcccttccttctaggccgctgccactgccgggggctatgtcccacactcccgcccaaccggagagcaaaagggaaactcctctgcttggaggaagctgactgaggcctccttttccgcgggcggcgtgggggagggggctgcccctgtgagaggcgcagtgcagggactactcgaaactcaggagtcaacggggtggcagcagaaagctgggcccagagaggggcatcccagtggctgtttgtcctgcctgggctagtccagaatggggactgctgataggccagagggtgctgggagagacgggcttcccattgatttatggtcatttgaagggaaaaggaaaataattccatgaagtagaaatggcctagtggaaggaggagcagagtcagatctgccttggttctgaaacaaactcactgtgtgaccttggacaagtcctcttccccacatgaagaatgcattcattcagttagtaaatattttgtgaacacctgctatgtgccaccattgccctggggaaaagggatgcatggcatgaagatcaacatgttaacctctaatttccttctagctctgacactgagttcatgaaaagtgggtgcaaatatcatgcaaataagcacatatcaactggaaactgcacttcctttttctagcttatccctcacaaatggagtagcttagctctagattccaggaacaaggtatggagacagtaggggggaggggctgtgaccttcacccatgtacccctttatcgttcacaaagcacattcattattcccatcgtgtcataggaatattaccctcattttacagatgaggaaactgagtctcagagaggagaaatcacccaggttatgccacagttagagcagaggccctattaggatgttggtccctttactggccaccaacagaagtagaatggaaatgacctggtctgagagctgttggtaacttttggccttatctccattgaaaacaaatttaaccaggaccccccaccatccccaagtcaggtaatgcaagtttgcttgcggtggtggggattgcgtattagaaaaaacggttatgtaccttagagtcctagtccaggctttttttgtggtacacgccaggggctaaactctttgaaaataaaagctaatctttcttaatgaagtctatactccgtgccaggcaccatgatcagtccttcagatccttacaacagtcctgcaacatagagataactgccccggcctagatgatggccaagtcatttgcattcttgggcctcagttttccatctgtaacataagggagtctataaggactgattccacttcaggatattctggtactagaaagatttcaaagtgtcgttggtggaacccagctggtcggttgctcaggccagccagtcagagaatgtggttgcagggaggagtgaaaagcagggggcggtaaagggaggccgaggagtgagtcagtctgtcaagatggccagagccattgtttccttctccatctggctgttgcacaaggccttcctccatgtcacatggttggtgagatttgggggcagacaggaggtggaggggctgaccccataactaggaagacacccccactatcttgcaccgaggtatgagaacagaaaggagaggaatcagtggagggaaaactcgcagatgggggccaagttggaaaagtctggaaagaaggtgactccaacctggaagaaggcttcctatggtgatggggaggcggaatagttgagtagatgactggaggctagagaagggggagttcctgctcaaggtgggggcgtggaactttctaattgcgactgagggggcggggaaacacagccatcatccgctcagcccctccctccccgggctccccgcggattcgctcagtcccggggcaaaactacccgaggcgccagcactccggctcgccagctcgctcttgggctgcttagccgcctggcaccgcgcggcgcccgcggacacatggcccaggcgcggggctggggtccggcgttgcggttcccgaagccacggacgtggactccgtggggtgtggagggcacccggtggtacgcgccgcgctgggatccaggtgaactgagagccaggcagccccaggcggggaggtcagggctgagctgcgcttcgcggagagcttcccgcaccggctcttcgaagctccctgctccctctgcctccttgtttggttccagcccggttttcatcgttgagtcctatgtccatttgtctaaaacctcacccctggccggcagtgcccccttttgaggctttccaccccgcacgccttctttcttctaattcttaggcagctcttgccccgccctatgggtgccccatcctcttatcccagcagtctatccggcttcgtccccacccacctctgtctacatcctccgctcaaaaagaacaccactttggttactaacacgtggtaggcgttcagtaaacagtatgtccctttacacccattcctccagcaccttcttcgtctctgcctttggtgtctgcttgttcaccctcctgtcttcctgtcccactatatgtctaaacctcaacctgtattttttccttgtcattgagttgtccgtctgtcctttcatccttttatttttatttatttatttattttttggtctccagatcgttaagtgttatcacctacacagtagctccctacatccccctatcactccaagggcctcttaccttcccactctgtaccccaggtgcaggacacagcccagcaaccctggtagcacctttataatcaactcgcattgcctgggagctccaaaccaaggaatgggtctctgagggatctcccaaagtctctggcattttgtctttttaaaaattgaaaaaaaagttttggggtacttatatttccaggctactacttctgagtaattgttatactcactcactctctctcgagactcgaacttctgagctcaaacaaccctccctcctcagtctccaaagtagctgggattattgcacccagctctaattcgctcttgattccacttaaagggcagggaggaaatagcaaactgggttgggtttctcaccatagatttaacatggaattgaacacgctgaaacacaggatccttggagattctgagaacagactctctgattgtacttatggggacactgagagccagagagggcaagactctcagccaggtcacacagttcctccgtggtagaaacaaagtagaagccagagtgacagttgcctggccctgacccaggagccttgggtgttgggggccaggatcatttccttgggggcctgtccatatagagtcatcaggtcccatccaccccggaagcctggctgcccctccctccctgtcctctgggaactgacctggctacccacctgcctgggatgggcgttctctgtcaggggctgccattgcctcccccactgacatgggagctccaggaaggcaggtacccaggctgtgggcctgcccgccccactctctgaccctgtcccttgcccagtgcccggcacagacaaggtctgggtaaccatgttatgggaatggctgatgcatgtgtgtggggaagttccagccctggctgagggcaaatcagaactcctgcttagtaagtgtgtatgtatggaggggaaaggggggagctgtgcttgaggaaaggcctgttgagagggtagacgagctccaaggccaagttgagcccagagccctttgctgagtggccctcaaccaaccaaacacatcccatgccctctccgatgtcatcctggggcctctgagggctgcccttcaaggtcaggagacaggggggtggttggccagggacaggctcagccagcctgaattgacattgtcaagccctagagacccctcttcacagggctgggctgggccaggctgggggcagggcgtataaaagccacacaccactccacaagcagccctccagcttccagggcgccacgtctggtggcagtgtggggtcaggccgtggcagctgacgatggaacctgtgaatgggaaggaagagcctctctttctgcttccccggctcctcctcgccttcccaggttttttctttgggagctgcagccctggagggacactggaaaggatcccagacaaggaggtaggatcctgagggctgttcaaggactctggatacccatagccccaaggtgagctgggagcaacgctgggggcaaagaccagggctccaggagtggggcagcttagcctcagccctccccttccctgcctttcccccaggctccccacccttcctttttctcactttcctcccctggccccaggtaccccccatcctcagaggaccatcatgccacccccacccccgtgctctgcagaagccctgtgcatgctggacttgcagatgccccacccccatgggaacacacagagcagctcacagaagcagagcgttctggaaggaagggaccctagaaccagggcccaccccattttttccagatgaggaaagtgggcctagccagggagaagcaagctccagggctgaggactgagactaagctgggcagaggggagcactcctgtcctcgcctgttgtgtgtggggtgtggggctgtgtcagaggcaggcttgcctttgctcatctcctctctgcatgttgtgacctttggaatctggagggcaggaatggggtggggcaccggggtggacatcctgctctgggcgtctgtgccactacggtcaccaagtgctctgtccacggtgaccccatctatttgttagggctgggcaggcagacctccccgaggcgttagtggggtgctccatctgcctgcagcagaaaacctctggggaccctttgagatgggccagtaaggtcagtccggagacccatcctgggtgtcaaatggtacctgtggcactgtcatggcccggggggtctactgagtggatgctggggcccagccttccatcaggctggcacattgactggtgttggttgaggagagatgacaggtccccgcgtatctgggaaagagccagggctgggttatccagctccacctgcccagtccaagtgcctggaggcagtcatgagccgccccacacctgtatgtctgagcttagggagggcaagggcagagaggttaggtgacccctgaatctcccctggcctgggcctggctgggcctgtgctccagagtccctcactgccagcccagggctctgagctcagcacagagctcctccttccagggtgctctggggtgaggctggaggcaaccgtgatagtcccctaggctgtgggctgagagggggtgctccttccaggatgtagctttctgtcctctgtccacacttggcaatgtatagacagtgaggtgtttgtgtggccctcaccttttcaaacccctccccaccactgtattccctctgtccacatctgcctctgcttgggctgtcttcttagtgcaaatctccctcctatggccatggctcctcaggaagttttgttttgttttgttttgttttgttttgtttgtttgtttgttttaatgaaccatgactatcctctgttttgggacctgatcaatagccccctttcatgaggctgggcgggggccccaagccaccagggagcaggcttcgttgaggcatgcgggaatgtgcgtacaagtgtcagagcctgtgtgtgaggccaccggtactcatgtacttggtggggctggtctgagtgtaattcattttcccctcactgctcctaccccttttctaaaaacttcccagctgaattccctgaagtgatttgctgcggtttctttagctcctatggaaaagagtagtagaagagtctatctggttccttttggatattaacctagccattccagagtgggggcatgggtctgccagcagcagctcgagcaactcccattcccaggcaggcagggcggggggactgttgggagtcctcaggtaggcccttattgggacccaagggtctcagagtgaggctcaggggaatggtatatggaactgctctttgccacagcgtaggagaaaagggctgataggtcccccaaaggttagctctatagcaccttcagtgtcatcctgccacctgccacagtcctttacagtatactttcacatttattgtctctactctacccagtgggtattatactctagtcttgttatttataggtgaaaaaactgatggctggggtggcacaatgacttgtcctgggtggcataacaagaaagtggtagaactggggccagcatttagctctactaattcctaatccagggctcattctactattgctcagtgcttctcaccatatctgacgcttataagcacttactatgtgccagccatcactcttaagtgtttacttagcctagtggatctgctctgcagccattgaaggtcagggttgtgatgatcatctacactttccagatgaggaaactgaggcagagtcacacagctagtaagtagcagaggccatttgtacccaggccatcttgctccagtgttcattatactccctcttgtggggcttacgtggtctgtgggcatggtagaatgaggaaagccccatgcctcgggcacagaaacacacacacacacgcacacacacacacgcacaaacatacacacagagactttttcttttgccaggccttggcctgcttcaagcactctacattcccctgcctgatgactgagctggcatccaaggtagcaacagcaatggtactataggacacacaggcaagagtgagggcttgaggaaaaggggaagtcaagaacctaaagcctccagttacctccacagccactcaggctgcaacctagaaatgggcctgtgaaaagatactctttctcatccattccaggcactattaatccatgcaagactcaggggcagggagcaggggttggcaggggtattgaaggggatgagctatctttgccctgctgaacaggctgagctctcctggccagaataaaagagggagatcaaaaaagaccaaaagaaatagccctgatatcgcttgggccatttcaaaatgtcacaatgtgcatggcaaatatcatgattgtagcttaccctgacaattgtgttcactgtcattcgacaagcatttttattgaacatctactctatgccaggcactgcgaagttctccttctaagtatttatagcagtgccccattttttggtagttttcatactataccctcctccttttttgtttcctggtttgatggcttttaaaaaaatacagctggtgtctcagaacccatgatatctgattcagttaaatgtatctactaaaagataagttgactttgctcattagtcatatgattgtcatttatttttggttgtgctttgaatatctttcaacatttgttcattcattaacaaacaatagtgaggaaagtactgtaagcactgtgcttggtttcctggagtggatggaattggctttgacaaggtttcttgcccttagggaaatgataaaatcattgcaggaccccactttttgtcctttttagcactgtgcacaggcaagatgcctttggcttcaactcagagccttaaggatgcttacaattgttaaagcccagcctcaggaaggaggtcatatcccttcccacccaccagaaggattttgcttctgggagtaacttctggtgtgcaggcctcatccatagacccacagggacttggcgcaccttgaacaaattgctagaggatacgaggggcagtcctgccatcaagaggaaaagagggatacatgggacacacagtggtggtagtgtcactttatcattgctcctctgactctcatcagggccagcagggaaggaatgtgggagaatttcagtttggcctagtgaactgaaagctagacaggagaggggcacttggggctgggttaggtctggctctgtctttccctgggtgaccttgataaagttgctgccctcagagacagatatttttgctctcatctgtatcagatactctaacaagcaagttagatggatgcagttcctgccttctaggaatggtgtggagaaaataaccagtgtacaggtattgaccctgccatggatttgctgagtaaatcatttgaggccaggagtgtgagaccagcctgggcaacatagcaagacttcagctctacaaaaaatgtaaaaattagctgagcatggtggcacacacctgttatcctagctactcaggaagttgaggcaggagattttcttgaccacaggagttccaggctgggtagctttaagtgagtcatgcttaaagtctgctcagtttctgtctttgtaaatgtgagggatagcagttgaactgcatgaggtcctggatactctcagacctgactaataggagtcctcaattcaacaatgaaatcaaggttgtgaacttgtgttggacccttgtgatgaaaggccagagagaaatcaaagccgaaggctcttgtttcttactgaatttgaatggactttctggtggtgcttactatcagaactcctggaagccctcccctgccacgattaatgttcgtgccccaaattttccatgcatttctctgcggaggtagagttcagacttggggtaggggacagaagcctggggtattggggaagttgcagagccactggggcctgagcaacgtagggatggcagcttcctgctcaaattcctaattatctggttttcccctaccaattggagatttcactgaagttgtgtcttctggacatcccataaattatccgagcaagtcactgaaccctcccgggcacatagcatatgtgtttaaatcccccaaacagtgccggactcattcagaactcaataaatattagcctgtgtgcctggccaagtcactgcttgagcctcagtctttgggcttgcacctcctccctggcagcggtgtgaccggagggaaaggcagcggcgagggccttggaggacctgcaggcagtgccccgcccacccagatttgggtgactttctggcgagtccggtgggccagactgcgcccccattggccgaggggaggtgggcggggcgtccctacagccctactcgccgacgctccctccccacttgagctgagtggactcgggttgacaacggctaagcagccgcggcagctgctcttctggctggcaccgtcacccctgcccgaccccaggccccgcgtgtgtcccggacggagcagtccctcctgggctcgcctcctgcccgctcgctctgtgtcagcgcccgaacccaaaggggtggacgcggcctccaggtaggagtctgggcgacggcagggggagatccagacaaacgggggcgcctggggctccctctccccgctttgcctctctggcgcgctccggctcggcccttctcctagcggttccgccgggcggcgtacgcaagagacagggaggaagcgagccgagccacccccgcccctgggattggggggtcagaatcgccgaaattgggggacccccgagcgcgccagccgcgcgtcttccagcgaagcctcgcgagtggggcggtggaaggcagctgtccgcctgttaccgccgggcccgtgggtctcgcagccgtcgctctggggctttggaggggcgttgcagctggccgggggcggcagagcttcaggctctgttgccgggtcgcgccagatctcctgccctctcctttctctgctttcgagggcatttccaggaagcccccgtccggctgtatgggttttcccgtcggccactgcctcattgctttctctcctgagaaatgcccaggacttcttggtattaagatagctgcggggaccaagcgaaaacgtttggacacgtctcatcttcataggcctcattttcccataaagtccaaaatgggtttggattagaggaaaggcttttagtggaagtttttggaatttccaaattaggtagtgtggggttctctccacgttcctcctgacacttgtgaaagttgcgcgctgaattacgactcaggaaactggggttcagccagtccatgtgaccttaggcgagtcatactactgtgtgggccatagtgttttcagccacacctcaggtggcagcttgatttcagtatctaaagggcccggtctctttcaccctgacatttgtttacttggtacctggggtcaggctcctaactggcaggtaaaaggttgtctctgagacgctcggggtggcagcagctatgcacacggagagctttgtggtgattatgcagctaagccagctggaaaactagagtgtgcgtggaggggtgggcgacagcagccagaccaaggtagggagaggtgggagttttcttccagagcctggggccccagaggttgggggcctcagagattgggctggcttggagcctatgcttacccccaagtcccagggcctggcttctctcccagtcagagcctaagcggggaggaggggttaatgaatcacacccagggctattttcaaaccctgactcctcctgtgcgacctgctccctccccactctagggtttgccgcccccccgccccccacacctgtattattgccctctgagttttcctctcattttcatcctcctggaatgaaagggggacaaatcttgtctgcggatgcgatgggaaggtgggcagcccaaaggcatggagaagaaggctgcaggtgatttctgggtggctttcgcagtgggaagagtgtgatgggaagggtggtgttttgctgtaagggcataggggtcggtagtgaaactctttcactctaaaggtacagctgccatctagctggacattctgggctggttttcattttagggacgtggccttttgttaatgtgttggactttggattttggatttctgctccctagacctctatatttagtgctaggaaacaccacactggacactgcctctcctgtttttggagaattatgctaaacctctctgtgcatctacagctcccctcccccacctagagaggagaagctgcctacagatgatatctggaggtgtttagagcaagaagggctgaactgaaggtgtgcaaagcaaaggggctgtgtgcgctgtgtgcttgcttgagacagggcttgcagtgagtcatgtggggaggatggcagagccttccttattcaaacacaatacctcctgagttccagcagagaagcaaagaaagtggcaccaagaagactcgaatgttgtccctctctgtcctcttaaagttttaaaattccattattgggactacagattggagagggagcagaagacccctgtgtctaggtttagaggatagcaacagggacacaaaggcaagaaggtcccaaaggaaggaggggatggagtctccaattgggaagctgtcacagctgcagctgctttgctgctaggagactcctggagctccttatttgagccatggaaagttcaggttcaacagatggcaggtttatcacgtgcaggctgtgccctcacctcttttctggctagaagaaagggttgcctctgccttgaaaagaagagaaggaccttttgccttaggctcccagtttggttaggatcaggtgtcatggccctgggccttgggaaagctgttcagcagataaaatagggacagcagatttcaaagatacaagggctttagggtgggaagtgtgagctcccggagatctaggtgagttttacattcttccccaccccacaacagggtagttgggcactgggttgggcacacagttgctggtgtcaggtgtttattaaggggtcttggtttgtgtgtgcgcacgtgtgcatgggcatgcattcgggaagggtcctggtagataggaatcagtggactggaggccacagcctgggcccttgtcacaagtctgaagtgctgtgtttgtgggtggagtttccttttccccagccctgcaggttggtaacttgcatgctaaacagttgctgttcctgtttacctcgaccacacacaggaattttagaactgaatgttaagttccctaggagttcagggtggtgtggagcaaagaacaggggattgggagttgaacatggggagctttaactccaggctctgccgcccccctcaaattctccgactctgggtttctcctcattttttccacttcactggattaaactaggggatccatagctaagtgctttgtaaactaccatgtgctgtataaattattagtcattaagtttaggcttggtgctaggtcttgtggaggacacagagtaaaaacccccagttccagggaatgtaccatctagtttgggggttagtggcataaataatacatgccactaattatttatgtattaaataataataccttggtgaggacttcaaaaaaattattgtgaataatttcaaacatatataaaaatagagataattagtgtactaagaccccatgtacccatcacccagtttcaacagccatttgcccatggccaatcctgccctgtccatactcttatctacatcatgcccttgttattttgaaacaaatcccagaaaccttatcagttcatctatacatatttcaatacgtatttctaaaagataaggattcataaaaacaaccattatcacacctaaaatagtttcttaatattatcaaataaccggtaagtgttcatatttccaattgttgagaaggacttatttgccctggacgtccattctgccctgggaaatccattccagggagtgattgcttttgactgaggggaaggtgacggacagaggcagtggcatttgagctgaaccttggaagagaggcccaggaaaggtcccagcccagatgttagccgcctctagggctccagatctggaggctgacccatggaggcttcttgcggagacttcctgcctttgtttctctagcagtaaatgacagttctcactctcacacttgcttccccagtccagggcacccaggagtttggggtacgcaggtctgggagaattctgggaggctgctctccacctaggcccctcccctgcgcctggcccctgaggccagttcagagcaaaacaggatgcattcaggatgaacgtctttcccagcttgtcatctaatcaccaaggcccagcttggagcttcctctctcattcatgataaaaaccctcactgtctctcttttcccttccgccccagtaagggtgtgctgacttcctccatatccgggccagccctctacccccatgtggggctgagggagagattccctcagtgcaggcctctgcccccacccacctcaccacagcctgtcagagagggagagaaagaccccaggaatgttctccctgactgcaggctcctgctcttgggctgtctttgggaaaagagcagcctccttccaacaagcctggggtcctgccactgcttggttaatcattgagccacataataaccaccttggaaagtcatctctaggggatggtcattaactaactccctgtccacctcaggccttaaagagaccatatcctgaaccctcaccttcccccaagggaacattgacaaacattcactcacgggaacttctggggccagtgaaaagtctgcccctccatcctttacttggcaaacggaagcagttattcacaccatttgaaggacatgggttcagcttggatggtattgagaaggggagcggagtgaattgatggggatttggatgggcagtggggtccagcatcagagttaaaaaggggtaggggggtgtttctaggagtagttgatcgcctcatctcaatttgaaagtctaaaagagcaagaaatgcccacccaaagggtctgccgatgctgggtatggggtgaggctgtgtgaatgtgtgtctgttttcagtacagctgtgggtccctccacaccaggctgcagtggaaatggggacagccaaccacatgattgctgctgagaggctgaggacctctgtaagtggaggaggatgccttcctccgggagcctgtatctggacaagcagtggcacttggtaagggtcgggccaggacccagacccagacccagacccagacccagacccagacccagacccaatttagaaagctccagaccatatgcagtttcctgcagtttcagtaggaagagaaggaaccaccccgtgggcctactacagagttgggaaacggcttctggttctgccccctctatagctttctctcggtgagtgatttttgctttctctgggcctcaatttccacaactataaagtgggtagggcagttggcaggcagactcagtggtctgtgagccttcctttcagctatgcaagtatgcctccccactcaagacccttttcttatctaccaggcaatggtgagctggcttcaaattcaatcaggcccagacactgaatgttctcagctggctgggtcagttggagctggccaagccctgaattgccacagcttgggttctccttgtgcttgggcatttctgcagtttgctctctggcccctccccaagcctgtgtctgtccctagtggccagccactctctgacccattcagccacaagttaatgagtgaactgctccccctgggtcgtaccagcccaaggtgctcctgggatcctaggtccctgtgggaagcagccaagggcctagccagctccagtcacctttatgctctctcccacaacccctctagaggtaggtatgcaggcagagctcagggcagaaggacctttagagggcactaggtccaactttccttctgaagcttggggcttcccgacaggtacttgtgcagttcctgctcactcatgttcaatacctgggaatgtgatatgtttcaagcaagttgctttcgtctttggaatgtgtgaaagttttctcttatgttgaacttaactgtgcctccctgaggcttctaaccctgggttccgagtgtgccctctgggaccacctggaccctgtctgctctctctgaccttcagggatctgaggatggaacccaagtgcacctgtgtcttctctaggccaaacaaccttcaagcgtctgcgctccttctcagacctggagcagcccccttcccagcctcatcactgtcctctgtcctccctacatgctactgtttatggcccccttaacatgtgggggcaggaaatggggcactggaaacccctcactccccttagtttatttatagtctgaacttgttcagatgacttttccataatccttttctggttaccacaacaggtagactcctaacccccagaatcttgggtgcaaataccttagacaacactgatttgtttatggttcaggtccagccagctctcacgattggagagcccttggaaggtagggccttcttattggtgcccccatagtggaggacaagcctggtgttagtaggtgttccccttgttgagttaaatacaatgtaatatgtggggggcttccagcgtaccctgctttcctgccactcggttttatctttggagttggtcaggggtgggtggagggaaggggatattttagggagtactgaagccggaaatgagtatgagccatgcccacagtggggcctagaagagtgaatcagacagtgagaaataccaacgtagccattccttcccctggcagttgatgatgatgactatgagtcctcccatttcttcagttgccaaggcactttcacttccatgattccattgtgttcttagagcagccctgtaaagtagatggtatgatttccccagaatgatctgtggtggtctccacctgaggcccagggaagggaagaacagtctccagtgagggaggatttggagcccaggtctcctgaccctcagccctccctgttttccccaaaccacacccagcagccatggcagccggggctgactcggcagcttccccaccacagaggaacccctgccctggctgcaactctgttcctgtgagagagtgagctccaagggacgtggcctaggatttcctgtcctttatctgggctggccaaaggctggcctgtctgaggtgtgagataggcacctgcagccagcctttctgctccaggctgaggtcaagtcaggctgtggcagaggcagtgagcttgtgggaagagcttgtccccaaacatctgtcctgagcagtgcccacaccagcagggccttctaaatgggaaaaacagagaggggaatgtggaaaaggggtcagagtggagcagaagtaaaatacgtcctgagctgtacacaagctctcatgttcacagtgctgggagactttgggcaaattacttaacttctctgagccttcattttgtcagctctaaaatggagatatgtacccacctcatggagttgttgaatattaaatccaacaatataaataaaattattgccattattgttgcttggtagtaccttctgcagtcctgtcatttggttgtttttcactgacctgggggtgggcagttctcaaacctgccacctcgtgggcattcggtctggactttgcagtcatttcagagtccaccttacccagaaaagctccctttggccatgcccacccacagggctcccttcctctggccttctttagtggcattcgcgacactcaacaggctatagtagtgatggtgacaccaataataatagtgaactcttctaaattcttggcaaattttaacttctttagcattcatggcaattccataaggtaggtactgctatctttgtctctcttttatttaataaacttgcccaaggtcacatatccggggagtgatggagctgggatcaggacccaggtggtctgactccacctcctgacatctttaatgactgggccatgcctctctccagatgcctggccaggaggcaagagctgaggttcgggtctccttccccacctgagtgctcatcacacgcaccagtgatcagtcacttctggacaggcagtccccaggtccttgcctgtctgctctgtgcacttcttctcaccctccatcaccaaggtggacagatggatagagggaagacatggaggagtgggtattcatgctctaaaacagagctgcattggggtggggagggagtgcaggagggagttgggcagtgggggtggcagtgtgggcagtgggggtggcagtgtggttctgacatcagcaccaggcctgcctgattagcaccttctagtactgggggtggagaacagggtgctgggtggcatcagggaggaagagacatttgaatatgctctcttgacaaccaggttgcattatttagaaggcatgggtggttaggggctggcaggaggctggctggattagctcttatgatcactagctggcgtgtcccatgctagaattgggtgggaggaggttgtccagaagctgtagccctccccgaagtgcttccatctcagggtcttgggggctgcaagcttccttccctcaggctgtactagctgccagctccattgcttcagggcttattcccctttatcttgcctccgaagcaagctccagggagtgctacgaaggccagtccatggtagcctgtctccctgagaaggatgggcctggcagcagctctggccgagtgctgcaggagaattcagtttttgttctgttttcagaccttagtacccagcatagggcttggcaccaagtaggtgcttgggtattattagttgaataaattcacagtccatggggagtggattctaaagggagagccgagggaggctgaaatgggaacaggtcaacaggagggctgtggttatttaggtaggcttctggcccaatctgtagtccaacagaagctacatgacctattgcagcctcagttttcccatttgtaccataggcattacctgctttggaggagttcttgtggggaccaagtgacatacaggatgatcaagtgctttcctggctgataggaagttaaattcaggctaaccactcttactacaaaaaccctggtagatgattttgtgtctgctgtgtgccaggccccagcctagacaatttcttttctttaatgaggaagattctaacttggtagctctgactctagagccaaactgcctggatttgcatcttggctcacctcttcttagctgctgaccttgggcaagttactccatatctctgggcctcagtttcctcctctgtaaaatagagatattattggagcacttagctcacaggtttgttgtgaagattcaatgacataatacacattaaaaaaaaaaacttaaagaaatgtctgggatataataatggctcagtacaaagtccatggctcagggcacatagtaagtactgtataactattagtgtctgctatattttattaataattacattcagtatcttaaatattgctgtcattaatgagtaagaagtatagagccaggaccaggggcggtggtggctcacaccagcaatttggaaggctgaggcagaaggattgcctgagccaaggagtttgagaccagcctgggcaatatagggagacacctatctctacaaaatataaaaaatacaaaaattagctggacatggtggtgcacgcctgtagtcccagctactctggaggctgaggtgggaggattgcttgagcccgggaggtcgaggctgcagtgagctgtgattgtgctactacactccagccctggtgacagagtgaggcctcattttaaaaaaagaaaaggaagaggtacagagaggtgacaaataggctacgtcttcaggtggctagcctgttaactcttcccactgtaccctgtaacttctacgcccataggccctacagagctgtaagaccaccatttggggttctccttcccttggccctaccatggcctgagcatgcacgtcatcacccttgcccccagagccctaggctccgccccttgctatgtgctcagcatcacagccctccctctggctctccttggggctgggggaggggtcgtgtctgctcccttcccggggaggccacttctctcaggcccatttcctttctatcagagataattttctctggatctcagggtggggccaggctccttcaaggcatttcctgcccaggagtttatatttggcctgagcaaaaggaaagggaagtaggcaagggggtgggatgcagacgtggtggcacagggtcaaaacagacaagtgccaagactttccagaccaagagagggaggcaggaggtaggcatgccccttctctcaagtgaacgtgggtgccctcccctgagcttggcagagtgaagtgctccttcaggtcataatgcctccaccatcaagcagagttcattttctgttcgcacatctctgagccttggttcctggctatgtggtttctgtcctagggcaaggctttgaggtgaagacatgtgctcaattccatttctagtgctgtggtgataccagacaagggagcagagtcagaggcctctatactgtgtagtgggaagtagggcttcctgtctgtgtgttgccagaacattcggtagcccttaacacactgcagcggcaacacaaagaccaaaagtacccagtgcagagaagcccccagttgaatgggggatagactcacatgctgctgagatgatcatggaaatgtgttaggggactgcttcattgaactgagccactgggtgttagggggttggtgagaggtcaggggaggcttcgcgggagtgggtgtttgacctccagcttgatgaagaaatagcagtttgaagcttcaaatcaggccatgtctagattgtgcagagccttgaatgccagggagcagtcaagactatctgccccaggctgtgggagctctttaggttgtagagtaggggagcggccaggttagagctgggctcttggaagaagcagctggcaggatggccccttgaaaggagaggctggaggctgggaacttggagggctgaagtaatccaggcaggagaacctagagcacagttgggcaggaaaaaacccaaccatttgatggaaaagttggtagaatttggtgcctaaatacatgtggccagaagagagcaaggatgacttgaggtttaagcctaggcagtgggcgtattgggaggcaggaacatatagagagctggtttgtggggaaagatgggtttggtttgcgttgccactgaggttcctcgcttgggtcctcagaagagaatgtgaaggaaggaagctccccgcactgagacagccactacgcatcacacacacctctgctgcagctctagattttggggaacggccattaggagatgtggaaactgaggttcagacagaggtaatggcttgcctgaggttatgcaagttgctcatggagctaaggccagaaggtagttcacctgaccgttagtccaatactttccactcaaaccacagtggagagcagtcaccgctggcctaatatctgccccagactggtttggctggcatcatttatctctaggccagggactggagatggtggagtagcacatggctcattaaaacaactctctctttcctaggcaccatgaccttgtcagagcacctgggactgggttgggggcaggagccccttgggggcaagaaaactaatggagcaactgcagcagagcaggtggcagctttgaccttccttgtcatagggaaacccagtgccaggcaggaatgttagctgtctactttggtcctgccataccaagctcaagcccaggagcccacaggctgggctgcctctggacccaaattctccagcagcctcagtgggcctgaggtctggtttaacctcagggtgctcgtgactctccctcatttacagctgcacacaggagctcaggccactgcttcacggagaggagcggggaaccacagttgggggtttcttgtgtaacttccatttttaaataaaatgccaaaccagaattgccacctcttcctggccgatcctgcaaggtgtccacggtgtgcaaaggctagggaccaccactgaatgttgcacccattcttcacttcagcccccaggacatcctggggggagggtgggctgcccagaggggccggaggccccagataaggcagaggccaaccctcaggatctcgtgcttcagatctggagtcaaccttcctttgtctggggctgtctggtgtggtgtatgatgtttagcaacatccctggcctctactgagtagatgctagcagcatttactccttgacccccaccaattgagatgaccaaaaacgtctccagacattgccaaatgtcccctgggggaaaaattgtccctggttgagaatccctgtggtagagactagaagttttttctggggtgtgcagtgttgagagagggatgttatacagaaggtagaaccacacacctgaacctaccactggccagctaaaagattcagtggcttgtttttcctgccaccctgtcctaggggcccctcctgggctgtttgctttggtggtgcctcatttgtgacagggaggctccagaagtgttgctcgcatgggcctggaacttggcatccagctgtagccccggccaagaccgaggctggcatctgaacaggtgcagcagggccctgagttctgcccggtgacctaacaagccagaggccagccagggtccagcactgccaacctaggctgggtgaaatacagaggcccttcctgcggtgcccctcctgtgaggtttggaatgtaggatgagagctattttggtcctgtctcctttcctccctgtgcctccctctgtaagaatcaagttagagttgtgattccagtgaagagcagcaggagcagagagaggcaccagtgaactggaccgccccatagatagggcactgcagacccccttgcatgtctgcttcaaggtcaggagggaaagtcttggtggccctgtaatccctgacagctcttagtacaggtcctcatgaaggtccctttcccactgtcccccagggagagaggtggcatagccagtcagccacccattacagcacttcttctaggggcactgccaacctagagggtagctttgtgcaaattcaaatgaaacagtgcccctgagggatgcagccctgtgccagggctcaagccttggtgggcaagcttattttggcctgggtcccttagtgtttccttaggggagggtaaaagaagctgctcagagcagttggggccacatgctgaggatggtagcttctgagatacaagccctctgccaaaaggccagcaccttctccttaagaggggtccctctctagggttggagagcgggcaaaggaaatgggccttgtagcaaccaaaagaaatgatctgagaagcagtttgccagggcctagcatttctgagcagcagtagcagggcctgcagtggtaggcgactccttgcctgcctcctagccctgccttgagggaccagcctcacagagcctgccttgggaactggggttgtcacatagatagtggcatcacaggtctttctccgccgctcaggacactggcttttcctcctgcactcactgaaggtgggagagacaaacatggagaccagaccctgttttggaggcccccatcctctggcgagggccacggaggagatgcttttccaaataggaagctaagtcaggtaaaggaggccaccacgtgtttaaagtcaccttaaggagcaggtcagctaactcaatgaccttcacaaacaccgactgcctgccttccctcagccatcatagacattcacactgatgctggtcactctccctgctcctgcactcaggtctagagagaacgtgggcctatgaatagaacaggcctgtgactggtctctgggtagaattttccagggacctatatctgtggctttctagcaggccttttctgtttagggcggtggtctttatctcaggctgtactttagaagaaccgggagagctctcaaaaacaaacaaacaaaaatgaaccctatccccagagagtttaatttaactagtcatgggtggggcccattagtaaaagctccccaggagattttaatgtgcagccagatttgagaggtgagggaggaatgggacgggacacccaagagctccagcagtaataaaggatgctttcatctatgtccctgtgacatccatccattgcttgtcttgagtcctgtatcttcccgcctggtccccatgcctgatactgtctttatgggtaggcatgagcaggctgaacccaggaccgggcagctctcttataacccactgagtgaccagaaggtacaaggactagggttgcctagtagtggtgtgaagagggggtacccagcccaagagtggggttggtgatactggctggctgaggccttacttcctgtagtctagattagatgcctgttgccttctctcttcctcctggctctcttctctcacctcttttcaactggtacacaatctgaactgtgtcttaaagactagatgggtacaaaattcagctcatcttaacaaaaatagccttcattaatgataacttttatatagccactttcaaaaccagcaaaagcccgatcaaatctataaggtaaccacagtggtagacaggaaagtcgttagtctccactgtataaatttggaaaccaaagcttagagaatgacacgagttgtctcagatgacttagtggcaagcatggaagctggcttgattagaaaaaagctttttttccaacttagtgatcatctttgggcattattgcatctcccagtgagaaatgttgctgcctctttcctgggtgcataagccctatgcttgagtgtttctcaagaccagaaggcctgcttttttcctggttgcatccttctcagcatagaaaactgctctgtgctgtctctgggacgtggcctgtgtaaatgtaggtgcagatactgtcattgacctcagaaagcatgtgctgctgctcagcctttccttctttgatgctccctccaggagacctgtgggtttggctctgaggcctgattggactctggagctttctagtatgccctctcccctgactctcccagcctgggtcatctgggcccctcccccaggggcttaagtctcagtggaatccagtttgtgccagctgactgctgttactgacctatcctggcacatcacctaagctttggccagagcatgcactgcctgcagaatatagcctttaaaactgctggcagccatgccttggaatctgcatatctggatacagaggtagggcaaggggccacagacattcctacctcactcacctcagcctgcccgttgtcactctccccaccagatacataagcccatcctcagtccgggccacctgggcttcagccccaggtgaatcgagtctactgggggtgggggtggggtcgctcctggcctcagcctgggtaggctgagacgagtgggagggacaaggcagagcacctcagttcagcctttaatcaccaagacatatgtctctgactgatccatctgggagggagcctcggggcctcccagccctccatgagatggtgtattgtggggagccaatgtccctgacatcctgtttggtaataacccattacattctctagattcctgttaaggagggctggtggggaattcagtctgtagccctactccaaactcctttgctcctttgtctttggagcaattgcagcctctttgaaggctccttacctcacttcccccagccatttggctgcaattctgacagtggtctgggcaaagccattgtccggacccacaggggaacgcagcagctgggcttctttctctaatttcctctttttctttgggacccttcagagtcagagttggggtggaacacatttgttgagtgcttggtattatgtgccaggggcttttactttctgtagtattttatttaatgctctcagtagctataagatgtggatgctggctgggtgtggtggctcacacctgtaatcctagcactttgggaggctgagacagggagacaggaggatcactggaggccaggagatggatatcagcctgggcaatatagtaagaccctgtctctacaaaaaataaaaagaaaattaaccaggtgtggtgtggtggatgctattgtagtcctagctactcaggaggctgagatgggaggatcacacaaacccaggagtttgagcctgcagtgagctgtgatagcgccactgcactccagcttggttgacagagtgaaaccctgtctcaaaaagaaaaaaaaaacccataaacatgaaaaataaaataaaaatagaaaaaagatgtggatgccatggctcctattttaccaagaaggaaacagaaacctggagaggttatacaactcgcccaaagtcaaagagctagtgactgacagcatcaggatttgaaccctgggttgtgactccactagaccagaaggagcaggaaaacagcctggggggctggggttggttcctttgagtctgagctccttgcttggctggcatgagggcaggtggcataatgcaatggcaaagagcactgaacatggagtgaaaagatcagggttatagtctcagctgtgacactttaccctgtatgaccttggaaaagtctcttgggcctcagtaggccttatactgtaacttttaaaaaataccaatgtggagagtcctaccgcagatcaattaagccagccttctggggaaggggccctgggcactggtattttttaaaataacacttcctagctgattcttatgtgcatccaggggtgagaatcactgagcaatgtgatttagaccaagacttttcaaactttaatgtgtttgcccaagggtcttcttaaatatagtggttctgggtgtggggcttgggattctgcatttctaacaagctcccaggtgatgttgatgctgctagtctgggactacactttgagtagcaaggggctacagggctctaggtagtcatgaaagaacttggcattgacctgagtgagatggtccccttctgccaacccccagctagggccaatgcctagcatcaggggagggaggtgcctctcctaccctctccattagccatgagtaactgagggctgcagtgggattttaagggtgtgttcctggcatgcaggcctaccctagagatttgctccctttcctggggtggccatacttgtgaccctttaggggccactgtctgctcctgcgcctgcctctctggaagtcctaacctggtccattttctggcacctcccttttgtcctaataacaggaaagcagagctggctgccaggatgcgtgctaagatggggaaagggtctcatcccaggggcatgacaggaacagggacagggaagtggctgtggcagccagctcagctgtcctagcagcagaaccatgttcctcacaggctccctgggcagctccctttggactggtcttacatcacctagactaccactggcctggagcacaggatcctttttcaggcttgcattgccccctgccagacaggtggaggtactgctagcagggctctgtcagacactttccagggacccctcagaggtcctggcgattcctagatctctatcttaggttaggaagttgcagtaacataaaacatacatgtatgcatgcacacacacacacacacacacacacacggagagaaagagacgagagagagagagagacagagagacagagagagaaagagaggcagatgcatgcacagactgaggtgcctgtgggtatatacaggtgcatggtcccacagtgatcctcatgagtcatggacatgagcagatttggctacagctacatgtagagacagatgctgtggtgggcactgacctgttgcattcactcacagaaatgcagagatgttcatccttgcccttacccccatttgcccccaaaacctgcaggggctccaggggctgcagagccctctcttctttccctcaaatcctcatcagtgtgtgacccttgaggagcccattactttttctgactgacttctgacttcccccactcttccctccactgtctactcacctagcatctctgaaatactgttttgtccttcatcttatctgtcccagccactaggatttcatcctgggtttccttgtgagtgagcactgggaagagagagctcttcctgtcttggaaaaacctcaccagcctccttagagtcctctggtcaggggggccaggcgagactgtggccacaggtgctgaggaaatggaggatgtgttgggggcaggactccatggcaggatcagctctgctgaagccagctgacttccccaaccaacccggtgatgccaggtcccatggtcccagccccattcatcttggcatcacctgggtgggaagcaaataaccgcccaggcaggtgcagggctttgctgctggtatttggcctaccctgactaggagcgcctcctctgtggctttagtccagctgcacatctctgctggtgctggcaggggtgctcagctctgtgccagaactcccagagcagaggcgacaggctgacctagccatggccccccaagaccccgacaggccagtactgtgtcttcatgacactcagcactgcactatgacacaaataggccaagagggctggggcagtactgggaagctccctgaggagggaggactataatgagcatgggggtgctgctgtcagactcagctgggattccaaccctggcactgctgctttgtccactgtgagaccataggctgagcctgtttgtttgtctgtaaaatggggatagcaaagccatcaccagttattgtgtgtgtgaaatgagagttggctgtcaaagtgctgaagaatgttagatgcgatgatgagaaagagaatgataggaatggttgaacatttctacttcctgcctgggctaaggtggtctacccagggccttggaagggggtgagtccctcagaaaggctcgggggtggacacagctgtggcttcttatcccagcaggcctccttgaccccagatgatcctggttcctgggcagggggtgggagagtgggaggggtttggaacaggcagggaatgagactcaagaaagccagggccaggatgcccagacagtagggcttggggagcagagggcctcctggctggctatgacttggagcaaatgtgctaggacctctggccttctcttgccattgctagatcaccagaatgagacatgtctgcctgctggggttgggcagcatgcacctagggccctggtgtcagcaccctcctaaccccatttctttgcctgtttctttcccttgttctgttttagaagccgaggccaaaagagcatgtgagtggcttcaagcaacaggattccctcagtatgtgcagctttttgaaggtaaggccactcaactgtttaccctcccatacttcccctagccctcagtttttcatctgttagatggggcaagtcagattctctttccaactacacacaagcagtgtctcctggccctgctccgatttttttcagggactttgctcctgcagttgcacctttctctcctgcatcatctctaagggattgctctcacaactgccacaagctctgctgttgcccatgcctttaaagtaccttgtcttgaccagggtcatcacgtggtaccaatcctgaggatgccatgtaggtacacacggtgtgaagaatgccgcctggagttgtacaccctggtggcccaggcttggcctcacttgccccacagtgatggcctcatttctctgttttccttcatttctctttcgggtttttctagagttcttcgcacttgctgtttcccttccccttttctccccacacccctactgcaccctggcttcacctccacctcgcctggtcaacttgcctggtcaattcaccagtgacctccatgtggtcacactcagtggtcacttcccagtcctcatcttgctccatctctcagcagcattcggtgccactggccactccttccttcggcttctggaatgcccccctttcctggctgcctctctggctgggttctgtctccttagctgactctgcttcctctaactgatatctaaagtttaggatatcccagggctctgtccggggccctcttctctctcaacatttctttctcatgagatctttgtctaagtactatccatattctgatgacttccaaatgtccagacctcatccccaagctccagattcatatattcacagctgccaattcaatctctctactcagatgtctgattggtgtctcggattaaacaggtctgaaaccaactcatgatggtaccaccatttacccacttgctcaagccccatacccaggagtcatccttaatttaattcctccttgttcccatctcctatctctaacccttcagcaagacctttttccctccagaacgtatcttgaatcaatccactgcttactacctccactgccacagcctggtgtgacccagtgtcacagctcacctgggctagtgcagcagcttcctgtgctcttgcactctcatctctacactgcagctggagggctctttttggccataggtctgactgtcactcctgctccaaaccctccgatggcctcccagcacactcagaatgtaatacacacagacactctgctctggcctgtcagactgcattctccaacttccattgattactcttacctttgttcacagggctcctctctacacttgctcacaccaagctctttccctcttcagagccttgatgctgatgttcctcctgcctggaactctctctgcagtttccttgcacagctggctgcttctcatctttcaggactcagctcggatgtcactgctttcagaaagctctctgctgaccacctctctacaagcagcctccacccctaccagcctccctttacactatcatgctggctgatgtcttccatgactgcaccatcttggttttaagtactgttgcttatctttttcctttaagagtgtaaactccaagaaggcaggaaccgtttttgttgtgttcactgttgtatgctgtatggtttgctcaagtgtctggcacaaagtaaatgctcaattggatactcattagttgaatgagtaaaggaacaaatgggcttgcttcaccagtaaggtagagagctgtgagacttctcagattctctcttccattcccccaactcctttctttcccctctcccctccctaagtcccagggagtgtgctctgggccacagggggatgcaaggtattgtttggctactgtgctgtcctgtcccttctgtccttgctcccaccctactcccccaagttcaccttgggccaaggagaagtttccctgcctgagcagcccaggattcaaaggggaatgggggagcccgtgttgggctcttggcagccacccggggtcttgggcctgctatctcccatggacctgccttactgactgacagagttctttgggtccagctcagccctctaggcctctcccagacctttccctgaactccctgggcaccctcctttattcctgactttttttccttctgctttgcctcttgtcttcctgctccccctccttcctggccgttcccttccagcccaagggctgctgaggctgagtttgtgatataccactgcactcatctttgcttctctctgccatacagaaggttcgtttcccctggatattggctctgtgaagaaaaaccacggttttctggacgaggactctttgggggccctgtgtaggtaggtgggctgagggccaggcctgggaagccaaaggcctggcttgaagcttcctcgtggaaaaaaacatcccttgtaccctctaacagaggaggagcccagcttactaacaaagctcatcttctgtggtcacattgctcattctgttctttgtgtttgtgataccctcaaccacccagtcactctagctagaaagccaagatctggccttgtttcttttctcctaaagttatagcccccaaatattcctctgcttcagtccctctctacttacaccagcttggcccttgtttgaggccaaaccatggcttctccttggatcgatcacaaggcttcagcctaactggctttagtcttgatagcccatctctcccctcccctctccctcttccctcaccctactcccagatcgatctagatccaccagcgtcgcattgtaacagctccaaatggttgttctttctgcttaaaatgtgtcactgcctaaggataaaaatgcaaagactttttagcataccacccaaagccctttgcgagctggctcattagccttagccccattggtctcatgcccacactggtctgtttgctgactgtatacctacagtgtcctgtgtaagcttgggtaagagtccctgtttctctcaccttcaaaatcccatttgcatcctccaggaagccttctctgactgcatccctccttcatggaagttgcttgtctctccctgtgtttgtctgctgtgccttctgtctgctctgtctttgaacacgccccatttctgtagggtttatttccactctctttgtaagctcctggagggcagaggccataatcttcccagcattgtgtctggttcttaaaccttcacgaatattggagcttgcgagaagttttgatggcttgggcatgtgaagtggcaggtgcatcttggtaggctctgccaggctttggggatggggacccttggttggacacttccattttgttacaggaggctgatgaccttgaataattgtgcctcgatgaaactggaggttcattttcaaagcaagcaggtgagtcatggcaaagcgtgggtctgtggtcttgtggtgccataaggaaacccagggcatacgtaaaccatttgtaaaactagctccagtatcccaggagtctgagatgtccagagcagtgcctttccccagctaggggtagagatggaggagatctaggaccccattctttcctgggaacttgctttcttgcttttttttttctggggctttctataccagaggcctgtagtcaggtggggcagccaagtgaccaaagccctgggctgtgagacaggaggcccatggggcctggtctcagctctaccactgattactgagggacctcagggaaacctcttcccttctgggcctcagtttccccattttgcaaagaaggagatgaactagaaaatctccaattccgtccagctctgttgtgattctaatctaagactacagcctagagcttgggaaggtctgtcactgacttaatgtatatcattgaccttgggcaagtggcttctggtttgtaggtttgttttcctatctgtaaaattggaaggggggttagattaattagttgaccattaccattaccatacatctgggctctgtctgtgactgctggcttcctctggcactcccagagctagctctccccacctaggccatgttctcagccagaaagcagggcccttcacctcagagtcccccaagagtttggaagcagagagtggagtacaagcaaggacttgtggcctgggcttctctgacctgatcctgcagtgcctttcccagaatgaagactcagaagaggaagagcagtgtaccatcagtagccactgggccttccagcaggaaagtaagtgctggtctcctatggggtcctctgatctgttggccccaccgagccctggcctgccagcgacctcaagctgtgagagcgtcctcaccgagcttagtgccacctctctgccagtcatcaccgtgagcctaccacccgagccagcagacttgcccttgccaggccgtgcccccagctcgagtgaccggcccctcctcagccccacccagggccaggagggtccccaggacaaagccaagaagcgccatcgtaaccgtagcttcctcaagcaccttgaatctctgaggcggaaggaaaagagtggcagccagcaagcagagcccaagcatagtccagccacctcagagaaggtctccaaagcctcatctttccgcagttgtcgtggcttcctctcagctggattttacagggccaagaactgggccgccacctcagccggtggcagtggtgccaatactcggaaggcctgggaggcctggcctgtggcctcgttccggcatcctcagtggacacaccggggtgattgcctggtgcacgttcctggggaccacaaaccaggcacattccctcgctccctgtccattgagagcctgtgtcctgaggatggacaccgcctggcagactggcagccaggtaggcggtggggctgtgaggggcgccggggctcctgtggctcaacgggcagccatgccagcacgtatgacaacttgcctgagctgtacccagctgagcctgtaatggttggggctgaggctgaagatgaagatgatgaggagagtgggggcagctatgctcacctagacgacatcctccagcacgtgtgggggctacagcaacgagtagagctgtggtctcgggccatgtacccagacctggggcctggagatgaggaagaggaggaggccacttcatcagtagaaatagccacagttgaggtcaaatgccaagctgaggctctcagccagatggaggttccggcccatggagagtccccagcctgggcccaggctgaagtccagccagcagtcctggctccggctcaggctccagctgaggctgaaccagtggcacaggaagaggctgaggccccggccccagccccggccccggccccagcccaggacagtgagcaggaggcacattcaggcggggaacccacctttgcctctagcctgtctgtggaagaaggacactccatttctgacactgtggcctcctccagcgaacttgacagtagtgggaactccatgaatgaggctgaggctgcggggcccctggctggactccaggcatcaatgccccgtgaacggcgcgattcaggtgttggggcctcacttaccagaccctgcaggtgagagtttgggttgggatggggcggacgcagggtctcctgttctctctctgtctctgaagctgatttctcagtcatgaggcccagggctaagtgcttggcggctgcgttatcccctcacagccagctcaggagagagagtacaggacttgggaatccagaaagttaggtccagaacctgcctgtgctgtggccttgaggaaatgatgctctcctctctgggcctcagtttcctcatctgtaaagtgagggaggatgctagaggagatggtctctggtccccagctttgcccattcagggtttcttggagcagcccctccacagtagtcttgggatgggcaggggtcttcactgcttattggcactagatgggcctgagctctgtgccaccctccccaagaacttcttggcccctaagaagctgagtccaagctttttccaccctggggcctcagcagcagcactagaaagtgttcccagctccctgcattttttctttggggagaaaaaaggggaccacaataacaccttttctaaggtttagccaaacctgctcctctgggcttctccacccctctcaccgccccccaccaggaagctccgttggcatagcttccagaactcccatcgtcccagcctcaactcagagtcgctggagatcaaccggcagtttgcaggccagatcaacctcctgcacaagggctcactgctgcggcttaccgcgttcatggagaagtacactgtgccccacaagcagggctgggtctggtgagtggctcctgggccatggagggtggggaactgctgactcaggtccacgtccccaggcagggtcagcccaggaggtgggtgcaggcaggcagggcccacaggccaggggagcggtgagatatgccaggaggctggaggggcttggtgaggctgggtatggggcagaggacctgaggtcctccagctgtatcttctccatcccaatctctgtgctgcaactagtgagattgtcctaaaatgcagctgtggttgtcactctccagataaacacttttctctggctccccattgtccagattccctcccaccatgactccttcctgttctggtcccgctccatccttctggctctttagcctaccgctcctaagcaaccccaccttacagaccagtgggaccagtcatccttccgtgaacgtgctatgatctttttcctgcctctttgcctttgtttgtgctgtgctctctgcctggaatgcattttccccatttctcctctgggacaatgccttcctatccctcaagagcctgctgagttaccacgtcctctccgaagccttccctaactcactaggtacagttcccctccctcaatgggtcttcccctaagttcttggcctcctactggccacatgagttgttactgcctattgacacagttatctccttggccagactgagagctctctgtgttcctctgtgactccctggggctgggcccaaaacaggtgctcaatgagtgttgactctggggcagtggtgtgtgccttacccccctcaccccacctgatcctctgagactgcaggcagagtctccaaactgtgttccccctatctgatcacttgtcattctcccaaacaggtcaatgcccaagttcatgaggaggaacaagaccccagattaccggggacagcacgtatttggggtgccacccctcatccacgtgcagcgcacgggccagccactgccacagagcattcagcaagccatgcgctacttgcgcagccagtgcctggaccaagtgagccctcgtggggcagcctgccgggagatggtgcaggggtggggtggtggtgggcattgggctgaaggctgaggagctggggagaggaactgctctggccttccccctcacttgggctggtccaccagaggcctttgctgttctcagcaaggaccagcaaggatgaaactcctttctactccttatgcccagctctgtgctaccttctttctggcccaggctctgtagtccttatcttctgggagcctgaatttgcctagatccacctttttctactcatctccacaaaagcatcttttttcttttgtcctgaagctgtaaaaatccttctctttggttttcccatttgtctcctaccctgcccctcaggaggcctgataagctttgaagtctctggggtggcctaggctcctgacacccagtctagggctggcctcacagtctgcctcctactcatgcatgttttcctcactccctccctcccctgcatggagtaggtaggcatcttccgcaagtctggggtcaagtccaggatccagaacctgcgtcaaatgaatgagacctcgcctgacaatgtctgctacgagggccagtcagcctacgacgtggctgacctgctaaagcagtatttccgggacctgcctgagcccatcttcaccagcaagctcaccaccactttcctccagatctaccagcgtgagtcgcccactcctatccccaacaacctgtcccattctcaacctccctgaatcccagaacttgtggaagataaacctggtgcaggcaaatgtagctggacctgtgagctgattggaacagttactatctggagttggaatggcccttgcagagagaccattctgcttccccaaacccattatatggaaaggtagactgaggccctgagggaagaactacataaggttacactgtatgttagtaataaagctagatcaagcacccagagacctcacagaactgacattttcccttccctctcaccgctccccttgggactgctgtgccttttgcccccttggaaacaggaggctggctgctaaggcctctggggaagtaaggaaggctcttcttccattgcttcctcacagtcctccccaaggatcagtggttggcagcagcacaagccgccaccttgctgctccccgatgagaaccgagaggtgctacagaccctgctctacttcttaagtgacattgcctctgccgaggaaaaccagatgacagcaggcaacctggcagtgtgcctggcgccctccatcttccacctcaatgtctctaagaaggatagcccctctcccaggtgaaatggtgcacggcatgtcagggccgggctgggtccagacaatttgggccccactggacttttggcttttgatggctggcactgctgtgtctcagcctcaccacaaggagtgagcctgactcctcaggggccctgggctggtgggatgctgtggagcagggccttccaaaaggcagcaggttgttttgtggccaggtttggcaaagtggcttcctggcagctagaaggcagcctgtctgccatcttgtcttgtgctcttgtgccatctctcctctcaccacctcctgctccatctaggatcaagagcaaacgcagcctcattggcaggccaggccctagggacctgagtgacaacatggcagccacccagggcctgtcgcacatgatcagtgactgcaagaaacttttccaggtgagtaaccccaggccatgacacctacttaccagacctgggggaaccatcaggcctgacctcggtgccccaagtcagggataggacccaatttgacacatacccctcaagcttatacccccaactcttcccccacaatgtttctcatctaccttgctgtggtagctgcacctctccactgcccttaacgtgaacctgacagaccccatggggtctcctgctctctggagctgcagcccattgtgtgtgtgccctctcaggtgccccaggacatggtgctgcagctgtgcagctcctacagcgcagctgagctcagccctcccggcccagccctggctgagctgcgtcaggcccaagctgcaggggtaagcctgagcctctacatggaagagaatatccaggacctgctgcgtgatgctgctgagcgcttcaagggctggatgagcgtgccagggccccagcacacggagctggcttgcaggaaggtgagtgccacaccacgggtggctgctatggggctgggagagcatggtgcaggcaagggtagtcagagaacccaaaggaaggagccggggaggagctgccgcctgagtctcgctgtgcctcggcctggtccttggagaatgtcagagagtcaagaaagtaccttaaggaatcaagaaccaaatgagaccaagggaactctctcaggaaccacctgccagaatgaccttccaaaagccccgttccagatacgatgctgctttgatagcctcaactcccatctctccctgccccgcagtccagctgaatccttgcatttgcacctttgtgcggtcctgctgcctggactgccctgaccccaagcattacgtctcccgagtcacctttagcgacaacggaatgtgttcctcctccattcagaaccttctgtcatgccccaggatggaggggatttctctctgttcccctctgggcactggtcatgctctttcttggacgtggattctgagtaagattgcaagcctgaagtgtcctgtgtaaaaaaatggtcataacaaaaccttccatgtaggatcagggtgagtgtgaatgcctggtacatactaaaggttctgtaagtggcagcttttgttgtgcatgtgttttactgcctgtgctagatggcaagctccttgacaatcaccatcttcctgcacctccaagcactgtgcccatcatggtagggcctgagaggcctctgagaatgtgtgccccgtcatctctttatgctgtctaacagactgaaaagcagacatccagaaaagagagagagagggcagggagcatgggagcactgtctcagtctggccagcgctagcagaggagctctgcagcctaccctattaagcctcaggccctgcagtttgaggcctggacttagggctggagtcagagttctccagccctgacagctgcccccatccccactcctgtggctcacaggcaccggatgggcaccccctgcggctatggaaggcatccacagaggtggcagcccccccagctgtggtgctgcatcgtgttctccgggagcgggccctctgggatgaggatctgctgcgggcccaggtgctggaagccctgatgccgggtgtggagctgtaccactatgtcaccgacagcatggcaccccatccctgccgcgactttgtggtgcttcggtgaggggctgcagctgctacccttctgtgcttggggggccggagaagtggggtggaaaccagcactaggaatctgagcctacgtgtcccttctccaataggatgtggcgctctgacctgcctcgtgggggttgcctgcttgtctcccagtccctggatccggaacaacctgtgccagagtcgggtgtgcgagccctcatgctcacatcccagtacctcatggagccttgcggcttgggccgctctcggctcacacacatctgccgggctgacctcaggtatcaggcctgggacagcctgctcgacccccttggccttgaccccctcccctgcctctgcccctactttctgccccatgctattgatccctggggctggggacaagtcctttcttccttctccctggtgagggctctggggaaaaatccattgctcatgcctggtttcttctgcttccctaggggccgttctcctgactggtacaacaaagtctttggacacctgtgtgccatggaagtggcaaagatccgggactccttccccaccctgcaggcagcgggccctgagacaaagctgtgagccttgggctggtcccagggtggcaccacccaggccccctgggcaccaagggagcgagggggaataagagcagggcagccccctgggtgccgctgtcaggagcagagccaggcccaggtggctccagctgcctgtcctgtcccctttcctaaagctcctctgcacatagaggggagaaaaagagaatttaggcaactccactcccccttcacccccaaccctgtattctactctcccgaaaagagaagagaatcgcatgagtagcaagactgctgccaccagccacctgcttgtgaggccgccacttggcatgaagcctccacagctccccgcctgcaggggcaaagaggtcgacagcaatgtgtgatcccagctctctgccagactgagagggcaagccgtcttgtttgctgcaaggatgcttttgaggttggacaggaggttctggtcctgcctttggggccaacgctggctctgaagtgtctttttcagaggaattggactggagtgaatgggcacaggggtggagcgcagggcagccccagtcaccacgagctgtttcatttgtgtaaatacgatgctgaattttatgaggctgagttaagagtgggcactgacgggcccctaatatgtgacatgacgatttggcatagatagggatgtgagagtggagtaccttcctttctcaagtctcgagatgccagtgaaaccagtattccctgacttgggtttcacactttatcgaccaccccatggggtcctgtgtagcctttggccacgcactgacactgcccaggccaagcaaaagcagagtgtggttaagagacaagggtctatgtcatcatcccttttgcttatggtagtgggctaacataacagcccctttctcaagcagagacctggcccctgggccagccagatggaagggcctatcttagccagctggagcttaagccaaacctgttctgtcccactggccagccatctttgctcacatggaaattcaaatgccattcaaaggccactggtgctttatttttctatctgctgagtaaactgaaatgagatgggtcccaaccaccactgtaattttcaagcctattttatttgtacctgtaaatactgtacagctaatatatatatatatatatatatatgtgtgtgtgtgtgtgtgtgtatatgtgtttatagagatacacacacatatatatgtgtgtatatatatacacatacatatatatacacacacgcatttgcacagacacacacatatatcaattctcatgagtgtattataatctctggtgggggcaagtgtctggaaggcctgaggggcacttcagatgagaatggagaggtagggagccaggtgcagcaggatccctcaaatcaataaagcattaccagagatgca

SEQ ID NO: 4666 - DNA, 78173 bp, human
gccttccaggaggcgggaggcgcccgctgtcgaggcagctgagccccggcaaccgctgctctccgcctctcccctcgcggggccggctcatggagcgcagggaccgggctggctctcgccgagccccgggcctcttttagcctcgtccccagagagggaggagccggtgcccggcacagccccgccggccctagaagctccccacgcgccaccatgcctctgctggacgttttctggtcttgcttcaggaaggtgaaggtaagtgactggccagccccagcccatcccgctgctcaggggggaaggaggcagatgtggaccactgcgcaccagctgggaaaacggaccagacgggcttctgagactacctgaggctctcggagttagaaaggcttgggttcaagtctcacctttgtcacttaaccagttctgtgaccttctgttgcattcccatacaaacaagtctgctagttggctctttttaataaaactcgcctctgttgcttcctggatcttgccacaaaggcaagatacttaacctctctgaacctcagtttcctctcagctttagaatgaggaccatagtaacaccaaccttacggggtgatgaggttggtgttattgtttacatagcaaatgtatgcaaatccaggagataatgtgtgtaagcttcctagcaggatgcctggtgtggagcatccacacaaacaatggtatctattattattattattattaatttctatccatatatataaaagcacatactctgtgctaggcaccactggagctacacaaagacaaaaaagggctggacacagtggctcacgtctgtaatcccagcattctgggaggccgaggtgggaggatcacttgaggccaggggttcaagaccagcttaggcaacataaggagacccccatctccattttttaaaagaagacaaagaaggacatggcttttgtcctcaaagagaatataagaaaagtgacaaatatttaccaggcacctactatatgccagacattgtgctaaatagtcagtttgtcagtaaatatttgttgagtgtctactatatcctggccatgggggatacatgagcacagccgaacccacaagtgtgtgtaaagcatgattccactctcaagaaccaagaaactaatatttatttagtatccactatgtaccagacctaggcacttttaattcattcatgtggcagtgatcctcagcacaacccattgttttcctgcttttatagatagggaaaagacactgtgaatagttaagaaatatttacaaggttgctcagatatgactggcagagctgggatctgagctcctaagtccatgcctttcttgacgctgtgtggtttcccacagtccaacccagtaggaagactttcaaacgactagcctgactgtaagacaggatgaaagaatgctgggacctttgggaaggaaagatccattccaccgggagggacttggagaggtttcacaggaggtcacatttgggctgagcctgaggcttaaaggaagagaagagtttgtcagtccaaaagtgggggaagggcattccaggcatgcctggcagagggaacttcgtgagctagagtttggaggcagtcaaatggtagtgggctgggggaaaggcttctttcgtgatgtggctcaaatgtagggttagagaggataggagcttgagaaagggaagcagagactacttcccaaagggtttggaattaatctgtggattcatggtcctcatctagtaggggtcctgaatgagatttttcaaccatctgtggtggaatgagagaaaagtagggataatgtcgtgcagtgttcataaaactaaattaattcaactcaaaggactattctttatttggagactgttgtgtccttcctgtgggggtggggattcaaatgatctttctcctacaaaatatgagtgagaaattttttaaatgtctgccctcagcaaaattacaaagtttgcgacatgctgattgtttccctatttatttatttaagaacactttcctcatccatgaaatctgaaagtctggtgactactgttttggggaataaggggctgatttcagcataatagggatataattaagtggacggttttagaaaaagcactccagcagtagtgggcagggatggtgtggaagggcccaagtggagatgcagaggccaggaaggaggcagctgcagtggaaataaggatgggagaggaagaaatgatagagagctggatggaatgataatgacgagggaagggaaaattaaagtgcctttgaggtttgacgcccgagaggcacctctgtcccctaccccagttaactgttctaggtgcttggcatggatttaaatctctttgcactcattaccccaacttctcagatgcccagaaaacatgtcctaacccctgtcagcctcttggaaactgttgggctaggttaagagcagtggctcatgcctataattctagcattttgggaggccaatgcgagaggattgattgaggccaggagttccagaccagcctgggcaataatgagaccctttatgaaaaataaaaaaaatttgctgggcacggtgatgcataatggacacctatagtcccagttacttaggagactgaattgggaggattgcttgagcccaggagttcaaggctgcagtgtgctatgattgcaccactacactccagcctggactacagagcaagatcctatagaagaagaagaaggaggaggaggaggaggaggaagaggaggaggggaggaggaggaggggaggaggaggaggaggaggaggaggaggaggaatagtaattataggtatggtgtcacgcctgtaatcccagcactttgggatgccgaggcaggtggatcacttgagtccaggaaatcaagaccagcctgggcagcatagtaagactgtgtctctagaaaaaaaaatttaaaattagtcaggcatggtgatgcatgcctgttttctcagctacttgtggggctgaggcaggaggatggctgcagtgagtcatgatcgcaccactgcactccaacctggccatcagactaaggctatgtctcaaacaaaacaaaacaaaacaaaacaaaacaaaacaaaacaaaacaaaacaaaacaaaactggtgggctaggacagccccaagagaaggttgaggatctctatcatgggtcccagacgtttgcacgcattcacttatgagtgtgtccacagaggacatacacgtgcatttgtgcatattcaaccccacacacatatgcacaggcacaccattcaagtgtgcatacacacatacatagagacgaacacacatataccctggcacaaacaggcaaatgcacatgtacacacagacagtgcacattcctagcatgatgtagactcacacacatatgcatgcatgcatatacagaggtaagcacacaggcacatcagatacataccctcctatgcacaagcatgagggacacacagagacacagccaggcacatctccaaaaagcctgtagacatacaaaagcatgcacacggcgtgaaggtccacgtgcatgcacatgcatatgcacaggtctgtggttgctcatgtccttggcagatgtgaatcaacacatggctggatctcagggctaagaggcagcctgccggatccacacacttggactgcgtgctcccttttccaatgctgctgctttgaggccccagtcagaaaggcaggctctctgggctcgggagctcagtcaagggcacgggctgctgtgagccaccctccctctctgagccaggccccctgagtgcgggagactgaggggtttgaggggtggggaatggccgggacagatcctgtcagagctgaaagggccctctcagatcatcttattcaaacttctcatggtcctgatagggaaaccgagccccttccctcccccaccatatggagcccttcatcagctgaagaggtatgaggaggggtgaagcacacaaacttgggtttcaattccaccccacacccacaggcacacatactagctgtgtgccttcgagcaagtcttctccgagcctcaatttccttgtttgcagaatgacactaatcagtgcccgcctcacagaaatgccacgaacatttggtgggtgggttaagtcttttttttttttttttgaccgagtctcgctctgttgcccaggctggagtgcagtgtctgctcattgcaacctccacctcccgggttcaagcgattctcctgcctcagcctcccgagtagctggaattacaggcgcccgccaccacgcccagctaatttttttttttttttgtatttttagtagagacagggtttcaccgtgttggccaggctggtctcgagctcctaaccctaagtgatcagcccgccttggcttcccaaagtgcgggaattacaggcgtaagtcaccacgctcggcaaggctgtgtctttaaagtgcctgacatggagtaggtggtcaatacacatgatttgttggaagcagcttccgaaactgtgtactagaggcaccacagcaaagaatgagggttattctatatttgaaaattccagggttagggtctcaggtccagtctgctcctttgccacaactcctcagccctctactttgactatgcctgggtctaggaatagaagtgatccatttgggagatgaaggctgacaccccagaagccagggatggtgggaaggtggcaaaaggccaggccagggctcaggattgctttgagctgctcttgtgttaggggcagccaagggacaagacgtttaagtgtgagatgaacccagtataaatagtccaatacgtgtttgctgtgtcttcccctggaggccagtcagggcccggaaggcatccatggccccttggtacaacgaagcatgcatgagtcagtttctcacccgctcccccgcaacacacagccacacaccccacactccacacacatgaaacacacaccacacacacaccacaaacacatcacaccatacacacaccacacaccacacacatacaccacactcccccacacacacaccccacacaccacacacacacacaccacacaccacacacacaccccacacaccccacaccccacacacacccccacacaccacaccacacacacacacacccacaccccacacacacacaccacaccacacacaccacaccacacacacacatcacacacaccacacacacacaccacaccacacacacacaccacacaccacacaccacacacacaccacacaccacacacacaccaccacacacacacaccccacacaccacacacacacatcacacaccacacacaccacacaccacacacacaccacaccacacaccacacacaccacacacacacaccacacaccacacacacaccacacaccacacacaccacaccaaacacacacaccacacacacacaacacagcacacacacatcacacacacaccacaccacacaacatacacaccacaccacacacacacaccacacatacaccacacacaccacacaccacaccacacacacaccacacaccacacacacaccacaccacacaccacacacacacaccccacacaccacacacaccccacacacacccccaaacgcacaccacaccacacacacacaccccacacacaccacacacaccacaccacacacaccacacaccacacatacacctcacaccacacacacacaccccacaccccacacacacaccccacacccctcacacacaccatacacaccacacacaccacacacaccacagcacacacacaccacagcacacatacaccacacacacaccacacacacaccacaccacacaagcacacacaccccaccacacacacacacaccccacacaccacacacacaccatacacgccacatacaccccccaacacaccacaccacacacacaccacaccacacatacaccacacacaccacaccacacacacacaccacacgccacacacacacacaccccacacatcacacataccacaaacacacacaccacatacacacacacacaccacatacatacagaaccatttctttgatgtattcttttgcccccttccagcacttagcatggtgttatgcacataaggggtgcccggaacacaaatcctccctcatgttactccgcttcaggtgggcatatcaggtcctagagggcactggcttgggaggtgggaaatctgcctggagcgccatctcaaccatgacctctggatgaccttgagagggtcaattctctctcctgtccctcagttccctcctcttataggtagataatcatgcaatatcagagatgaaaaggcccttggaggtcatctattcctctttctctgttcctctctccaaactaccagtgaggaaactgaggcccagagaggggagagatgtggccaaggtctcagagggcatcaggacacagcggattccaatgtggtctgtgtaatacaccataatctccctactcgttctgtggcaaaatccaaacacaacttgtctctggtaaaatctaaaagcagtactgggggaatgtctctacacatgccacacacacacatgcatacatgcacgtatgtgttaacaaccctgccgtacctacccacaaggcttctatgggagttaaagcaaatcatggacagacagtcgtgtggactgggaaggctcatagaggtgaacctcccagtcgtgggccaacatgggatcccatgcttttcactaggcaccatactcacatacttaggtcatgcacatgagtgtgtatgtgcacaagggctttcctgagctcgcccaggcacacattctcaagcaccatctcctgtgaatgctctcatccaagtatgcatgagacttccatgtggctgctcttatacatggcttcccaggcacctgttcatatgggtgtgaggtttcacaccccctgtgcaggctcacattcatgcacacacacacacacactcgcaagtgaggtgagcatgcatcctccttatgtgtgcttgcccataccccagcccctctctgcccccaggccagctctcagcttcccaatctgcctaggagcagcctggcaggatatggggtgaacgtgtgacgatgatagggtgattcagcaatttcactcccagcctccaggatgtctctcctttttcattcctttgcccttgtcatcccaagtaagtccaatttgccacatgcagtgtgtatttgttgtggaaggggcagggggagtatagagaattcaggggttcacatgaatgtatacaaactcctggggctggaaagggacctcagagactcctcgatgccatcactacagagttgcctctatcacatcttaccaaaagaatggccagacacttgcacacctccagtgatgtggagctcaccgcttcctcaggacactattgcagatcccttcgtcagtctgatgtgtgtgtgtgtgtgtctgtctgtctgtgagtggaagtactaatgtacatgtgcacatatgagacagtatatacagccagccacgtcttaattacttgttccaaagaaataaattatgacataagactctcaggtcatggtaaaaccacgtagagggggaaaggcaagggcctatactccatagaaggaaggttcactcgcagggccctttctgcagagttccacagcccactcaaataacctgtcagctgggtgataggtattggccccctatatgtgtgaaaaattcagaccgtggattgtccctgacatggttaattgtaagatgcctagatgctggacatatgctgtgtaactttgaggcacaggcccatgggctagagcaaaataataagttgtggtaaggttattggcatagatggagctcaagagagttgtgaggtggcttctgggtgatctaggaagctttctgggaccagtttttgggaccagagtagaaggcagcttagtgttgccaaaggagcactggacacagagtgagactgacctggatattacgtccacctctgccacatctaggctgagtgctcctgggcctgtcacctctcctcagtggataagacttaatggagttgccagcgagatgatgtctgtaaaagcctgttacaaggtagatgctccattgaatctgaatctgaagggatgatctttggaagaaaagggcaaggagtgttttcaaggcagagtgaggttggagacatgtgagggaagagtcatagatccaagggacttgtcctgagtggaggtgttgggaatgaatggaaatgggaagaggaggaagaacaagagactttgaaatttgtctgtgggagtttgaacttcatgttcttgatgcagtgaaaagaccaaaacatctacatggagtcaagcccttcacctatctgagccacaacttgctagctgtgttgaccatgagaaagttacttcgcctttctcaaaagaagacatttatgccgccaaaagacacatgaaaaaatgctcatcatcactggccatcagagaaatgcaaatcaaaaccacagtgagataccatctcacaccagttagaatggcgatcattaaaaagtcaggaaacaacatcaggagagggtgtggagaaataggatcacttttacactgttggtgggactgtaaactagttcagccattgtggaagacagtgtggcgattcctcaaggatctagaagtagaaataccatttgacccagccatcccattactgggtatatacccaaaagattataaatcatgctgctaataaagacacatgcacgcatatgtttattgtggcactattcacaatagcaaagacttggaaccaacccaaatgtccatcaatgatagactggattaagacaatgtggcacctatacacaccatggaatactatgcagccataaaaaaggatgagttcgtgtcctttgtagggacatggatgaagatggaaaccatcattctcagcaaactatctcaaggacaaaaaaccaaacaccgcatgttctcactcatgggtgggaattgaacaatgagaacacctggacacaggaaggggaacatcacagaccggggcctgttgtggggtggaggaggggggagggatagcattaggagatatacctaatgtaaatgatgagttaatgggtgcagcacaccaacatggcacatgtatacatatgtaacaaacctgcacattgtgcacatgtaccctagaacttaaaagtataattaaaaaagaaaaaaagttacttcgcctttctgagccttagtttcttgctccaaaaaatgtagataatagtacccaacttacatggttattatgaagctcaaatgagttaatatgtataaagctcttagaaaaggggcacatagtaagcattgctcatctttattatttgtacactggggagaatgataactcctaccttatagggctgtagtaaggatcaaatgagaatgatcccaaagcctgttgagatgtttatttgttgttatcttggacaaaatgtgtgtgtgtgggggagtttccttaggctgagaatagccttaagtaattcattctttcactagttcaaccaagcaatatttattcagggcctactatgtgccagacactgtgttaggtcttgaggagataggtaatggtgagcaaaactgctgtaggtcctcatctcatgcagcttactgtctagtggatacaaaatgagtttttcacactcaacccccaagtgccctattggtgggcacgattgatttagtccagaaaatttcagtatatgaaactgttcaatgcgttaacagttttagttaatctagaacctgtgattggccatcccacctagtccttaaggcaaagggatagccatgctgaagtgtgagtaattcctgcaacagcaaagtctggaacaatcttaggctcagcctggaaatggggatggggacccctctgccaaatttgcctgatccgaagctcctaacccttgccccatcagcacaactggtgtgatttactcgagtcatgtgagattggataatatttgttctcgggggtggaagagatggggacgagcattgggaaggtgagatggggagtaggaagcaaggcttcaactctgacttaagtctcttcagatacagattcttactttgcttttagcttctttgatgccaaaaggtgtacaagtgggaggtcccggcggggtggaggatatacttcctatggctatggtggaggttgggggaggcaaaaatgagttggaagaggctgcagattggcaataccagacttctcttttacccctaaagactagagaaagttagaactaatactagctaatatttgcacttgatcttagccaagaggtcaggaagtgatactagctaatatttgtagagcacatactatgtggtgtacactgttcgaaaccctccacatatattaactcatttcaccatcacaataatcctgcaaggcaagctatcattgtcatcatcctcattttactgaaacacagaaaggtttagaaatttatccaagattacacagctattaagtggtgaattggggatttttaacccaggtaatctagtttcaaagtccactatgttcatgtaatctgtgctgcatttctccacctataaaatgaggaggctggattggtttatctctgagtctttccagctctgacagtctcattatatttcacatatacttctatgaacttccaggccaaatgaaaaaaaaatgctgctcccaaatgtcagtgatttccactaaagtccctcgggaggagagtggggagcccaggctcagggaaaagagccgacactggagcttggtcttcccagcagcctctagggcctgagaacagctggggacctgggaagctctgggagccagggcccggcctgcatttccaagtcacttgtaacaataacaaggagcagcagctcaggcagcctctgctgggatttggggtcagaggtttcacagtgggtggaggaacagacctcctcaactccatccctctgggcagcccttgagctgttgctgctgctgctgtcagggcccttagagtccaggtcaatcagcagttccaaggctgaggctgccaaggggcaggggaaaggaagtcctgcacttggggaatgggagttgaggccctggaaatggatgcaggctgactttccctggccctttcctctaccttgggttggttgccttctgggagctggagagaagaatgtagtatgaagatataatgtcatagatggaaataggacactgatctaacagccctggttctgcctcctcttctcttctctaagcctcagtttccttacctacaacatgaggagaatattccccacttcataattgattgtgatgatgacctatgtgaaaaggcctgccacacaatgggtgctcagtaaatatgagttgaatgtaaagatagttgattgattgctctaggtgaccctgggcccatagcttggactctgttttttcatctataaaatgaggaaacatttttacctgccattcccttcattccctggctgaggagagcctagaattggggacatcctgtggaagtgaaaggacagtagaaaacacagatgcgactaccctcagggtcaggaagtgggttgtttaagcaatttcctcattccttctattcccgcccctgctcccacccctggtcagactagtttagagtctggaaaagaagctccatcccacactggaatccccgtgtctctctcctccagccccttcctacactcacccttatagggcgcctctcccggaaagactctgcagttctgggcaggaaggagggtccctgttgactggtgagaaagtcaagtctttgggatattacattcctgagattatccagagaacccctgggggttgcagctgctgctgactctcctccctggccctactcttggcctgctgtggacatgaggactgtagggcccaaggcaggagaaagattgggggaaaggctcaaaggcaaagagtcaggcctggagcagccctgcaggccaggtgaggagtcaggatggggcaggaggaaaggatgtcctggcagcactggcaggaaggaattaaggggaaaagcgtccgagggagtaggaatttttgccaaggggagacttataaaaccatcagcattccttaggctataggttgggggcccttttcgggggtggatgagtaggtattagatcacagtcatcctggtggatagagatggaaagtcaggctttctgagaggccttctgtgaggcccacatactccaagccagtgtgggacagcttgcacccttggggggagacagaggggaggtaggtgttctgggggttcctcaggaggctgtcccagattctgagttctataaaagccttctagaatttattgcttccattgctctttcccagctgggattgttcctcatcctctcctttgtgatagaagactaagaattgtcaggcacctacctctcatttggtaacaagtctgaagcccagcaaagaattggtcaaaggtacagggtcaagcgcagaatgtgtcagtcagtccttcttgaaaccagctctcctctgcccttttcagggacaagattggcatcctccagggctgtagcaccccatccccagcagacatcacatcccgaacatgagcatatgtctccaggtcattgacatggggtttaaaagtggcaccgtgacaccagtgctccaacttaggacctggtggcaggctcaattgagcttcagcccacataccatcctccatctctactcagctgtctctgaactgtgagctgctctaagaaaccagcctgtgtctaattgacccctgtgtcctgcgacaacctggctcaaaacagcccctattctaggcctagcctagagaaagtttgccaagtgcatagaacacacatggactcccatgtacgtacaagtggccaaagccactgcacccaccttccagctgagagaccccaagacagaggagtcagctccagagggctcatgagagcctgctttccacagtggccatggtctgtgctggcaaaactcaggataggcctgggggcggtgagagcccactctggaagaagggagggccaagctgtgaatagggctctgtgtggcccggctgagaaggctgggggaggctggaatgtgaagaacgtgctctcatgactgtggtcctaggcctgggtctatggcacaggactggctaggagtgaggggtggggatgttggaggtggttagagaaggaagggagaggtggggcagagaaaccaggcaaggcaaggaaaaaaagtctctccagacatctcctcagataccagggcaagggctggtcctagagcctggaggctgagcgaagaggatgctggggagagtgagctccatcccagccacttgtggctgaggatggcccggttctggacaaagcttgtccatagcctttgcagcttgtctccaaactacacctctcagacctccctacttctcacccagcaaccatcgttctgtttttatcctccttttggctctggctttcgcatttgcactctttcaacgtgtttcccttttctctgaaaaaactcatgatctgccttttatttttgcctggcaactgtatctcccactagactgagagctcctccagggcaggaatcacatctgcttttgttcatgtttgcatctgcaggtctaccccagtgcctagtggactgctcagagcagatgctccacagacttttttgaattcaacaggtctaaggggaaattcattacaacaggaagatttccccccgtatacccccaaataactttttcctctgttcctgacttcagttaatagcaccaccatccacccagttgccaggccagaaacattggggtcatccttgactcctcgcttatcttcccacatcctatcatttactttggttctaccatgtaaattgtctatatattggtccccttcttcctaccctaaggaccactgcccaacccagaaccttaccactaactctggtctccctttgtttttccttctttctttcttttccttccttccttccttccttccttccttccttccttccttccttccttccctccctccctccttcctctctctctctctctctctctctctctttctttctttctttctttctttctttctttctttctttctttctttctttctttttggagtttcgctcttgttgcccaggctggagtgccatggcgtgatctcagctcactgcaacctccgcctcccaggttcaagtgattctcctgcctcagcctcctgagtagctgggattgtaggcatgtgccaccacgcccagctaattttttgtatttttagtagagacagggtttttctatgttggtcaggctggtctcgaactcccgacctcaggggatccacccgccttggactcccaaagtgctgggaggccactgtgccgggcctctggtctccccttctctagttttgcctaggccccccattcccaatccatccttcactcaacagttagagtaacattccgaaacataaatctgactacgttacctctctgtttaggccccctcaatggctctccattgggctctagataaagtctcaagttcttaagatgacctataaggcccttcgtgatctggcccctaacctgctgcttcagattcatttcccactctctgtctggcactctgctctccagctagaccaaggtcctaaatgtgacagttctgggaaatgagatgaacagacgggtgggacaaaccacaggctttgatacatcctcatccttttctattctctcccttctacctgccaggctctttgcccccttgtcttcttgatgaacaactgcttagctttcaagacctgttctaaacactacttccttcatgagggtccttatgacaatgtgcccccactcccagcaacaaattactccctctgctcagttccacaaggctttatactttccaatagcactcacattgaattgtgatgatttgtgcatgtaatcgactccccctctgagctgagagttcatcaagggcagggaatatgtctgatctatatgaatccctgagtacctagcacaggacttagctctgaggaggtacctaatgaatgagtgaataaataaaggaatatatgaatgaatgacccactggatgagaagattgtcaccactaatcctggtcttcttctagagtggctgtctttataacttttggattcttggcctctgggttcagaacctccaaatcagagggatatgttctacaacaaggaaacaaaaagggccttcactttgtagcagaaatctttgatgcaaaagttcatatgctatcttcccctgtaagtctttcagctaccaaaatagcatcaagattaaggtcaaaagcagagtgggactcatgggcctgatccaatccaggttattctggacctcagagagaaaaaaatagagtgccataaaattgggagccctattgatctcaagcacagacttggttctgacatttaccttgaccttgagcaaatcatttcacttctgtgccccatttgccttatgtgtcacatgaagataataaaatctaccatgcaagatggttgtaatggccaaagaaggtcactcatttgcaacctataaatccctaaatttaaggcctacttatctcctgaactatctgtaattctgttaaaactatgatgggttaggctggtggagtgggggagtaggagatttaataggactagagcatagagtacagtctgtcccacccatcagttcatctcttaatttccaagaactgtcacatttaagacctcacaggggcctgctttgtccttctcttctactctctcatcctttctcattcttctttcctccccctttgtctacactgagaattatattgacttgcttaatcatagttccactttgtagctttgtagcaaactttcatatctgtcgctattggtctttctcctctggtcacgccgatctcattctagaactttttatctccttcacactaacatccctcaagggtcctgccagtgaacactcgggaggacatcccccatccctcctctctcctgtggccaattgtgggctacgagggtggatcagacctttagtcattttagggtaatctaaggctgagacaaatcttttaggattaggaagcattgtggtcaagtgtctgcacctggtatggcagtcattgtgcagagggtaagagatagacacatactatggcaactattttcctgataaccacttggttggtttagaggctggctgtgtgaaaggagaacaggcaagaagacccttctacctctaagaggtacccttctttccttccttctttcttttctctcctccttaactattgaatgaatgtctctacaactaccattttagcccaagccactgacattgtttgcctgaactactgcaaaagcctcctaacagatctccccacttccaccctggctctacaatccacttcctacccagcagccagagtgaccttttgaaggtagaaatcagatcttgtcattctcctgctctatatccaccaatggctgcctactgtaatttgaatcaaagtccaaatccttaccctggccttagcctctcataatttggccttcgtttctctcttcaccatccgcctgaaatgctcttcacctagctcttcacattgctgacaacttcttgccatctgggtctctgctcaaagttcagctctttagagagacccctcaggccacctctctatccccccactcaatcactctctacctcatcctgtctttaaaagtttctccttcttggttcttagtgatgactgaaatttccttatttctttgtttacttatttattgtttgtctcttcctactaagagttcagctgcgtaaggatctcatctgtctagatcactgctatatccttagcatctagcatagtgctctgaagggcactggtattgtataaatatttgttgaatgcatgaatttatagagtgcttaatcattttaaaaagtgcctttatgtacgttaatttgtcacaaagcctgtgaagtcgggattattgctttcctagtcttatgaatgcagatgctgaggctaaagaggttatgagtgatgttcaatgtcacataatcagtaagcaggggaaggtgaccctgaacttgggttctccaattctgaatactgcccttgccaccaacacatcctgtttctagccttgttgatgctataccaaggatggtatgtgccaagcaaatgttgacttattctttaataatctttcttatcaggcctcggaacagtactgtgagctgtggcagagtgtctccaatcccctgacctgggggccttctccattcagggagagtgaagtgaaccagcaggatcagccatggggtagcagaaagtacagttgtatggagtgggcagccaggagtctgggtctgggctccactttgctccttacttcattttccttttctttggacctccatgtgtctttctgtaaaatgggtaatgggtagatcgaacttgctaactttaagatcgctttcagttcagatattgcatctctgcaatgccttgacttcttctctgtttcttttgcagtgcttcccattgctgcaggtgaagaagaacgctggtaagtacacgaggtgggcattgcaagtggcatacaaagagactgagcttctcagtagtcctcatggggcaaccgatcaggtccctgggcagcagagccaacggccgagatgcaaaagccggagacatcctctctgtctccctccactgggcatttgctgtcctcctcgggccctgctttttggctcacgtgcagagcctctttatttctcagccggaggttttgctcttgtcagagagccaggggaggacttccctccagagctttcagcaagtggcagccacccatatacttcccttgttctcaaatgccttctttccactgggaagtgtattaggggtgagagatgcctcaggagagaaaacaggtaagtggagggtaaaggaaggagacttggaatttggggttcagtgtctgttatattcccagcacttgctttatctagaaggcttccaacaggaggtaggctttggagttcattagactgaggtgatatatatagccttttccttttgctctctcacaagtttctgtgagcccaacttcccatcttcctggtgcctctggtgtcctacttgggtgtggataagtggatggcatactgggagcaactaccttccattgagaaggatacagttgtctagagagggataacagctttgtggaggaagagaaagaaggctactggccagggaagagtttggtgctggagcctgaactcctggtatcagctgggctttgctaaggtcatcgaggccatcgtcctggctctagcctgacttcagccattcccattggctccaatttttcatcaggatgagctcatgacttgaatgagcatagcttctaggagacagttaggattggggttgccaaaacagaaaggcatctattaacaagtggcatgctaagggcctgtgcaaggcatcttgggaagacgttggaagagacaaccagaacccttactaataagaaccttccaaagtagttggagctggtttgggcgaatcacgccaggatgcagagagaggattctagtgacttcccaaggacgtttccatcttacggctctgagtttttgggtggtggctgctacaaaacaagaactgataggtgaggggtttatttgcattgccatgacagcagagaagagaggatttattttgaaacaggaacactgctttgatcagcatacagcatacatctgcttctccacttccccaccctgcctttccccgtcatcatcattccaaggcgtcttgctgcgcagtttctgctttgcaacagagacttctgagggcacaaggtctgtgcactgcccatactaggggaaggacacacttctccatttcagagacaccagcttcaaaggctaaaagaaacccctcaggccctgaaatagtgacccccttagatgaatgcacccacagctgccaagttacttctttagaatatctgtgccaggcagaggtgccagcactgagctctgggagggtggcttccagaggagccaggactatcttttactgggtagggtcaggcagaggaggttgccacctacaaagctgagatgggactggtctttctgctatttcttaggttaaagtttgaaaatgtctatttaaaggcaaatgggaacacattgtttcaggctgattcaaaaacaatctgacataaattatgagtttatgtggatgtggaaatggtagcagcaaggcactgggaatcaaagcacctggattttagcccaaatttcattatagattcactgtgtgagcccaggaaagtagcttcctctgtctgggctggcatctacatctacaaaatggagcttattgcatgggactcttgtatggatcacaatagacagcgcattaaaaatgtcaaagtactgaacaaatgtgattgtttctgaaatttaggtcagggggtgagcagaacgcttcatctgttttattacgtattatttgagaaataggtaataccttcacaggtttcaaaattcaagaggtacaaaaatacaaagtctcttctcaccccaagtccccaaccacccagcagtcctcttagaggtgatcagtgttagcagcttcttggccctcgatgagtttagaaggtctgaatcaagtgagctgtgctagatgggactgcgatgggggctggcactgcctgactggcctgggggtggggctgaggggagctgcagaaagggtcatggagcaggaatctcggggcaggaaatatggggtggtagaatcagcattcttttgggacccagtcttgactgtgccactcgtggtggaatgataacaagtaagaggcttcccctctccgaacctcaatgttctcatctgtacattgagcctgccccattctcctaagccatttctcccaagtgtgaccagagcagaacagaagtggtagaggagaggaccagccagggactttttagtgacaaaaaagccaaaatactgactctgggctgacagttgtatataataatttccctctttctctctctttcttttctttctttctttctttctttctttctttctttctttctttctttctttctttctgtctttctttctttctttctctttcttttctttctttcttctttctccttctctttctccttccttcctacctacccttccttccttccttccctcctccttcttctttctcttttttctcctctttctttctttctttctttctttctttctttctttctctttctttctttctttctttctttcttctttttttctttccttccttccttccttcctttttttttctatgagacacggtctctgtcactcaggctgaagcgcagtggtgcagcatagctcactgcggccttaatcttctgggcttaagggatcctctcacttcagcctccttcctcaatagctgggactacaggggtgcatcgccacgcccagctcatcttccttctattaggatgaatcaagcaaagatttatctgacacatcattgcttttgttctagtggtcccactgacagaggaaaccttgtaagggctgtcacaggatcacttggtaccaccttataggagagcattaggaatgtccaactggcttcaacacatgtggtgctgcccaggcccaaaagaatgacctgaattacctttgaagtccctgctatcacagtccaagaagccactagcacagtgtttcccaaatgtcacttatttgtgaaccaacttcagaatttttgccatcacatcatccatgccattaagtacttaatatttttctttaaatcaacctgattttaaataataacctcaccctaagccataatatctatgaaattaggttttgaggcactagttacatttttcctaatatgtagtaaattaaatatatatcatgatgcagatgccaatgtaccaccccaaatcatcctatgccaacatatatatcaaacactgagaaacacagagctagcggtagtaaaaccagcagctcaggaggaggttcaggccttagggactcactccaagacatgctacatgctctcaggctcccagcatcacttcatatttcttccagacccacacaccctgttgcttgagcacaaattgctcctaagatggaaaggtcctggagcctaaaaggaacccgcttcctccaaataaaacccacaattcaaaactgcctcttaagtgctgaagtgagaatacttgattggggccggaagctccaggttccagttttggctgtgacctttgccagctgtgtgtccttgggcctctcgctttccctctctgggccttagtgtctctaactataaaatgaatagcttgctttaaatgacctctaaggtatcttgctgttctgaaattcaatgactccttgacttacaaaccccacactccgcggagctcattagctcgcttaccagcagcccacagaggtgaggaggctgctgaccttccctcccaccgcctttgcaccaaatcttccccaaggccccctgctcccagtgcacaaagctccttttgttgcctggagccattcggggcttcactccaggctcctgctgaagtggctgaggtggcctggtggggtaatagtttgcctgtaacaagagcccctgctcgcaacccaactggctccagtctggctgcaggcttggcctcagcatcagactcatccatcagctgccccagacccctcccccaagctctgagggggcggggagacagatttgaacagtagaaaatggaaacaaatacatttatttaacatgctattgggtgtctgtcacctccaaggctcacaagggcagtagacaaaaatactaagcatatgaaagtcatcagaataataataattcaatccacatcctttcttttgaaaatgaccaaatcatttttataacggagtcttgacagatctggtcatttaacatttgttattttacaaagaacatttgcagggcatggcttatctaacatttgacagatattttacccagcaacttggaatagtataaagatctacttagttagggagcatctggaatttattatcatttgagacaggaaatcttttaaccatgatccacagtgaattcagccaaggtaaaaatgctgggatgtgacttgagagacctaggatctagtctcgtctccatcattaactccttctgcgaccttgagttagtcacctctgccccatgggcctcagtttccttgtctgcaaaatgagaatgttgaactagagggtctcaagattttgattttgcactctgaccccctctcctccagaagtcaggctgaaaggaaggggaggtgggggtagggtcagtggaaagggcaatttcaaggtgttctttgggatggggggaaggatttccaggcctgtggaggagtgtaagggcttcttttgtggcctaaggggctgggaagcccaggttctcagttgctgttttcaagagtgcaagacagaattaggtctaggtttagagagtcaggtcaggtacatctccctaggtatagcctagatgaccattttcacagtgtaggccactccaaatcaggagctggagagggcatgggaacttcaggtggaaagacaggtctgaaaaggacctgggaagtgctactggacacttccaccagaaggtcctgtggatccttcaaactcaacactaaagatcataattctttatcatttctctggaaacctcctctttctccagaatccgctttcttggttaaagcagccccatgcacccagccactccagcaagagtcacgggcgttacctggactccatttttctaatttgctgccatttagttgtgtgcatgggacctcttcataaggcttcctaaatctaccgccttttcttgtcactcacactagcatagccctccatctgggccctagcagctctggccttgatggttgcaaccgctacctaactggtcttcctgccaccatgctcgcccttccagttcaccctccatgctgctgccaaagttctctctttaaaagaaaaacttaggcatcctcaaaaatctttggtcatttcctacctttggtcaaagtccaacttctttgctctggcattcaaggtctctcaagcttagacagcctatctttcttgcttcctttcccacctcgttcctatatttctgagccccatgggacaacttgctatttcctagacagacagtgaattctcatattggactctccactgagtgtgttgttgccagcccccttcttggcctgtcaagccacactctggcctccctttccatcttgtccatagctattacattataaaacatcacactgttctgcattggcctcttttctttcctgtctctcccatagaccatgagctcttggtgtacaatggctatatctgactgacccctggattcccagaactaagcataaggtctcacataaacaatgagtctgccaagaactggcttttatttttgatggcatagcaaaagaacttctggtaatcagactggtgacttcttcctttcagcagactttcttccctatcatttcagctctgaactagctattacagatcaacatagagccccactggctccagatgacaaaacctcttgagacagggccttaaggatccagtggttccagccaatggtgcagatccgtgtaaaacacattttcaccaaactcttgaaatttggaggtcgcccacatctcaaggcaggaagggcacttaaggactatattaacccatgcttttgaaactgagtactgaggagccctagtgtcccctagtgtcttaggggacatgaaaggaagacagagttatgggatatctcattcctgcttcattcaactaaacctatttgactttttgaagtttccatgaacatttcatttggagactggagttggcggcattaaagtttcatttggagactgtagttggctgcattaaatgttggcgatcatagctcgaatctggtgttcaattttcccttttttacctttcctgctacatgcccaacttgagctttgaccaaactcctcaggtatggtgaagcatcctttttcattctatactgttaaaagttctttatattgagccagaatctgccttacaacaacttccacccagtggtcctattttcaccccttggaagtagtgtgttccttcttccttaaggccaatctgctgtcatttagaatctcccaaagtctaaggtaggagagatcttatagctcatacagtccaatgttctcgttgcagctggggaatgaagcccagagaaactaagtgatctgcacaacagcatagagctagttggcagcaaaactgagactagaacccaagtctctactcatctataatgcgctccccagaatctgtcctttcctagctcctaaaatcgtttctcacagtcctgatcactcttcactacacgtactcctgactgacagtgaccaatggctgaagatcagcagctgagcttgtgaaagctccatggctcccaagccttggtctgcctggggagaaggcagagacaaagcagaacaaactggtgtcagaagcagagccgttccctcaccacagcctgaaagtcattctcctcatccttctcttctttccataaaactaaattccattcaaacagcgccccaccccccatggcagggcagccaaggggcagctttcagaggccccttctgacctgtttgctaaagggttcctgctgtgtgaccttccacatcccaagcccagaaacaggaagagttagtttggtttgctttttgggaagaaaaatgaaaacataggaagtagggctcctgagaacagaggcttccaactctgtgttcatttgtccctggagcaggatatttcagggaatacattccacaggggaagggaacagcctcccttattaaaaacaaaacacaaaacccttcaaggtttggaaaaagaaaaaggccaaaaggagacttttaaggaggggaggggcaattgttttataatctccagcccttcacccccttggccacttggagctgtcatactttgatctcactaccattatcagcacatctgttgcccagagatgtcctgctccctttaacctatggcccaagaaagagtccaagtctcctttcttgtttccctgaggatgaccgaagtaggctggcactcagaatcttcaattaaaaccaagaaaaaacagacagtaattaattacacaatgcacaaacagcagaacaacattcaggccttgccaagtacatgctttttgttttaagaagcccagcaaaagcagggaagtgctttgtcagtccccaaatatctcccaggataactatttcatcgtcccagatacgctgccataagtttgcctggctttttcctccctcagctgtcagtcactgggaggcagatgccatcttgtttccctactactgttgctagaagggcaatgcaacaggtcttttaccaaaaacaacaacaacaacaacaaaacaaccttccagaacccctactgttcttttcagttctagtttctgggctgaggaacatggttagttcacagatagttgccagggtaaaagtgtggatcattttggggtgccaaagaaacatatagccctggaaggaaaccagctctgcctacaatctggagcttctacaggtacacatgtacatgtgtcacatgtgtagtgtgcaaacacacacatagtctatttaccaaaattttagtttcatggaataacaaggccttcaccatacaaaaacataccattgtctcccctgaggttatgggtaagcagaacctcttcctagaagatgcttccaagagcatctgcctagaatggcttgtttttttccaaaaagatctggaggcaaaattttcatattaaaacaagcatataattgttgtggaatagcataaaaaattcacatgaattacctgggcatgatggctcacacctgtaatcccagcactttgggaggccaaggcgggtggatcacctgaagtcaggagttcgagaccagcctgaccaacatggtgaaaccccgtctctactaaaaatacaaaaattagctaagtgtggtggtgggtgcctgtaatcccagctactcgggaggctgaggcgggagaatcgcttgaacacagaggcggaggttgcagtgagccgagatcgcaccattgccctgcagcctgggcgacaagagcaaaactccgtctcaaaaaaaaaaaaaaaaaaaaattcacatgaattcataagataaaagtggagacttgaaaaaaaattctcacttgtggttggctgtgtgagattctcctccagctcctcgggcctctgtggggaataaattctttctgttcattggaggtactttggggatgcaaaagtctgagagccacaaagtaaaacagtaggctccttgagggtagaaacgtctcatttttctctgtatcctcacatctgaaacagagccagccacagagtgcttgggaactatttgctccattcatgcatccatccatccatccattcatctatctatccatccttaccaagaaacaagcaaaaaaggtagccttagagtggtggaaagaatacagtttctggaaaattcataaacctctgggtctgaattctgactctgtcacttattagcctcagttttcatcacgtctctaagcctcagttttctcaggtttttttttttgttgttgttgttgttgttttgagatggagtcttgctctgttgcccaggctggagtgcagtggtgcaatcttggctccctgcaacctccacctcctgggtttagttgattctcccaccttagcctcccaagtagctgggattacaggcacgcaccaccatgcccggctaatttttgtattttttttttttttttgagatggagtttcgctcttgttgcccaggctggagtgcaatgatgagatctcggctcactgcaacctccgcctcccgggttcaagcgattctcctgcctcagcctccccgagtagctaggattacacacatgcaccaccatgcctggctaatttttgtatttttagttgagacggggtttcaccatgttggccaggctgatctcgaactcttgacctcaggtgatccgcctgcctcggcctcccaaagcgctgggattacaggcgtgaggcactgctcccagcctaatttttgtatttttagtagagacagcgttttgccatgttggccaggctggtctcgaactcctgacctcaggtgatccacccgtctcagcttcccaaagtgcttggattgcagggatgagccaccatgccttgccctagttttctcagttttaaaataagaatccaaatacccaactcctgagttgatgtgggaccttaagtgtgataatgggagtgggagtgctctataagatcccagacaatacagaaattatagttatttcatgactatcaaattaccaccatgactagcccagacagtagtggggtggggggaggggaagatgttttctccagccagaagtctgatttgagaataagaaagcaggagctgagacctcaggaatgagcccccgggcctctgggatggagagggcagatgttgaatcctagctccagctccacctccactccaggaaggcagtacgcaggccagaggggaacttggggtggagtgatggaaggatcagatgtgcctcatacacttcaggtctccaaagaccagatgtgctttccttctcacgtctgccaataagcccctttgaggcccggtttgcagcaagggtcattcatcactggggctgaaatacaaccaggcatagtgtgttgacttggctgctaacagactctgcctccttgggtaagtcctttttcctctctgggccccaatttccctatcattaaaatgaaaggattggatcgggttgtccctcaggtcctttgagctcctacacgctgtatttaagacttttttgggccttgattttctaaaaatgtgaacaatgtgatttgccaaaaatataattggtctgatcatctgatagttggacactgaatcatggatgggtgaaaaagttcaaagcaattgtggggcaggagacgggcctggctggggccctcttctgtttttaagtctgctggttcctgtggctccttctgtacgtgtctgtgtctggccaaactggcccggctcgcctgaaaatctcagagcaagccaaggttgtagcccaggtagatggcttgtggatacagcaggtgtttcccaagccctgggatccggctcaggtacctcacaagataaaatgaggaaaggaaagaaaacaggaaatcctacccactatatgcaactaattgtttaggaagaattccttctaggcaagcccgttgtctcagaagtcagcaacagctgctgggttggaatggctaacttgtgcaatctctgagattcttaggctccccccaaaccccgtctcaacctgtttagccctctgccattctctgaagctcagctcaaatactgttccctcccactttcaaatccccatcatactgtatatctgtcttatagcatgaatcatgccttgtgttttgagctatttcctttcacctatggattaaaaataaaatacatgttctgagtgaaaattccaacctataatctttcactctcactttccagagttagccgctctgaaaaggttgttgttttttgtttgtttgtttgtttgttttatttgtttttcctttccagaaatcttctattgccaaagctattgaaaatgtgaggttgggcttggtgacttatgcctgtaatcccagcaatttgggaggccaaggtgggaggatcatttgtgtccaggagtttgagaccagcctgggcaacatagggagaccccgcccctaccaaaaaaaaaaaaattagccaggtgtggtggtacatgcctgtagtcccaggtactcaggaagctgaggtgggaggatggcttgagcctgggaggttgaggctgcagtgggccgtgatcgtggcactgcactccagcctgggtgacagagtgagaccctgtctcaaaaaaattaaaaaaaaaagttttgaacagagcgttggctctggagtctaagcacttagatttaagtctcagctctctgcttgttggtcagatcagcttcagcaaattctatcacccctttgaccctcagttgtctgctctgtaaatgggatagacatgtcctcttctcctgtctcacagggttggtgtaagggccaaataagaaaagagattgaaagcaccttggaaactgtaaggggggccctatttatctccatgcttgtcactgcaacttgactgtaagcatctttgaaacagaaacttggcccctcgagggctgtgtccccattgcctcttgttccagtttgtccagaatgggaaggtggtgatgccgggggtatggaactgaatccccagagtcgtgctacacctggagatgctgatgctctgctcctgccctggttctgggtacacagctacttgaccttcctttgaagccaaacccagctgagaggaccatttttctaaagttacttggcttgcaaaatgctgctcctccaccaagtgggcactggcccagcctcactgccccagtgtgctttcattactttgaaaattctgcaactcttgtttcaccccctctacctccttcagctcctagttcctcagattctggctccaagtaatgatttcaaagttccccatgccccccacccacccccccaatgtatgatacatatatatagagagagaggaagtagaaagatgtggccaagaaaattcaattttctgaatggatcagatgtaaaactgttggaaattacagctagaaagctctgcagatagcatttagtccaacctgcatcactccccttcaacctttgacagaagggaaactgagacccagaaaagggaagggacttatgcagggaatttgcggctctgacctccaagtaaaggtgggaaggggcgagactctgcaatttaccaatgcaccgctgaaagggttaaagtcaaggaaactagcctggggaaggtgggtggggtcaaagaagagatgagtgtggccagagaagggaggatcaatcaggagaaacagtcaggaccagctgcaaaattcccctggaaagtggaaatagaagaaatatgagggttgtggtttagcaagttattatgagccttgctgggcaaagagagggaagagagaggaagagaaaagtagagggggcccaaagaggagtaaaaagggaaggaggaaggccaaaccagacgaatggaggagtttgagagtgatagggtcagtgagtgcttaaacacagcaaatcagtagagtcctgtcccatgtggggcatccagctaccttataagttaccactagctctgctgcctggtttcttcttctaggctctgagcacatgagccagtccttactttcttagcaaactcagcccttttccactgtccactgtttggagaggcagttccagactgtaggctttttacttcagtagagttggcacaccaacacaagggcactgtgcagcctggcctggctgccagagcaggctctagatcccccactccacagtcatgatctgattttagtcacacagtcatactatgagttgaactcagcccattttacagatgagaggtgcaataattttcaaatgaaaacaacaacaataagaataaacctaagtatatactgggaaacaatacacgtactgattaagaatgagagtgctggagacaaacggcctgtattcagatccccattttgcccctcattagttgtgtgatcttggacaggttgccaaatttctctgtgcaggtttggaaggatcaaatgagttgatccaagtatacaacctttgaacaatgcctggcacatagtcggtgctcaataaatggcgactattcttgccattgtcattagtatgtgccagatgctgttttaagtgttttatctgtattatgtcatgcaatcatcactcacaaggtaactgaggctcaagtgcaagaagaatatatctggttcattggcttttaaaacttcgttagatgcagacttctaccccccaaaattgaatcctatgtgacaccccaatatataaaacaaaacaaataaaaacagcatggctctgattgaagcaaggtggggtaggggtgggacttggagactcctggctcagtgttccctgttctcccctcccccagcctccctatgataggctttgaggctcttccccacccactgatctagtccatctaaactttttatgctcagataaagacattgtaactctgagagagcaaataacatgcccaaggttaaacaacaagtcaaaggcagagtggggtaccaggcatgaagggacaatcacttggtcaaagagaacagcccccttggttaaactagaacacagaacatcccaagcttgggcaaagaagagctaggaaaggagagtgagcaggagggaagggggatccccgatgtgagcagccccactgactattcatatgctgctggggccatgcagacgtcaagatgagacaaagccctatccacatggggcctctcattgcacagggtttggggttctgttgtgacaagggatgtagcctcctctctcttaggtgtctgttctgtgggatgcagctgactggggccaaatcccaccatctaggccttccgattgggctcctggcctgagctggcattaccacaactccccttctcctccagggttctgggatggcagcttgacttccaacccattgttgttggggtgggggaggtaagaggggtagacttgacgctccgcccttttcacagcttccatgtatgtgcacccctatctgttcaaggcatgccactgccaacactgtttatctaagaaactgtgcgtcgccaacttttgtctctaggactttggcatgggttacctggggacaccgccctgaggagaaattataggataaatttttccagagaacttcttcgagaactcaggacttccctggaatcccttctgacctgatctcgtgagctactcaggctccgtgcaagccttggaagacaatctgcagggccgagcaggggaggggcaaatgctggaagacaaagctcaagtgcaaggccctgagttccttgcctctgtttggatgggcttcaggatctccatctgtcccacgtggggcaggcatggatcagatgctctctgaggacccaccagctccaggctgggcttgtgtggaagccctgaccactcggtgctctctcaggcactggcctagaatccgagggggacacaccaagtgatggaaacaaacagggcccctggctagtcacaagagggcaaggatgaggacacaggaggcagagtactgacctccaaactgcaaaacgctcctctgacaccaaagcagcttttctttctggcaaggccagtttgcatgaatggacagagccctggaatcctgagccagactgcaaggcatgtgttactgtgtgttggtgctgtgccctgccaggtgacaggaagaggaaaaggggcttatgcaagctctgactgaggggaaggtgtgtgtactaaggccaggaagtgggggtgggggccgctgtaggtgggcactgtgactacttcccagataaaggcagaaggaattagtgagcatcagacctgagtggcctacgtgatacaagggcaagaagaaagcagcgaggcagggtgaaggggtaagtggtgacttttctgttgacaaacacttctttccacctaatagttcagggaggtaggtgttactgtctccatttaacaagtgaggaaactgaggctcagaggagttctatgacatgtcatctagtaagtgttgaagctgatgttcacatctaaggctgttttgagagttgcagttcttaggggccccttctctagagctggtaaaatgtgcacacatatacactgtttctgccatccagcaacccttctaagacttggccgcaaagggctaggaattatccttcccattttactaaagcccagaaaaggtgaatgattgggccttagtcatccatagcaaggtagagacaggcaaaaggctgagactggggggccttctgatggaaagctgccgtacgctgctagaagtagcactcccactgtggttccacctgtgtctggtcattttccacttacgaagtgctctcaaatccattatcttgaggtttacagggcagaaaaaaaaatcttccattttctaggtgaagaaactgagcatcagttacttgccaaaggttacacagctactgaatggcagagtcaggacttgagaccagagttgtgtccaaactcccctttacttttctgccaagtgcatgtggccagcaacggaaggacagagtaagttcactgaaacataatgtttgagaccaaaagcaacaaaccccaactccctggggagatatctaagcccttctcttttttccatatgaacctctgaattgcagaggcaggcttgcagcctttgaaggggaaacagagaagccaatgagctcagttctccacagcagactccaagagctgctggctttcatggctaactagatgcctcatcggcccaatggctttgtggtcagggtgccagggttggtccagccacaccaatggtgggactgggggaaggtcttctctctcttcccctctcaccacctgtggttgcatttcatgcttggtcattgagtcatttttatgctcttttcctcagtaacatgggggaaagaaaacctcaaatctctcagccaccatttggtttggtcaaggttgctcctgggctttccactcacccacccacctactcacttactcttcaattttttttttttttttcagacagagtctcgctctgtcacccaggctggagtgcagtggcatgatctcagctcactgcaacctccgcctcccggtttcaagtgattctcctgcctcagactcccgagtagctgggactacaggcgcacaccaccacgcctggctaatttttgtatttttaatagagatggggtttcaccatgttggccaggctggtctcaaactcctgacctcaagtgatccgcccaccttggcctcccaaagtgctgggattacaggcgtgaagcactgcgcccagtgcattcaatcttttaatgaatatcctctcaagtgctaatgctgcgccaaatcccttcctgagcaatggatatgccattaataataaaatacagcccctggctgagagaattcaaacccttattgggcaggaagacatggataattaaactcgatatagaatgattgctgatgtaactgagctgtggagtcacccagaaagggaacaccttatgctattcataggagatactgtactaaactggtatgttggactttaccaagtataggagatagggcaaataatttaacctcttcatgtcttcatttccttatctgtaaaatgggataatagtacctacagggtttctgtaaggactttatgagttaaaatgtgcaaagagctgaggatagagtcaggcacattgaaagcaccatataaatgtttgtgaaataagtaaaggaaataaggatgagcattcttgtgagagagaagtgcacatgtaacacatttggtgggttaaggaggtgtgttctgggaatgccacctgcgttaactgggcagtcttgtgggtgctttgaatgccagtcttagaagtgtggacttgtccctgtaggtgatgggcaaccatttctaaagctagatctttgccacagagtgtggcagaggactcctgtgtgaaatgctagtgctgtatccaccagctcaacaggtgctaggcccaagagactgccaccagccaggaaacagtcagttgccaaatctgaacgctggaccagccctgtgcatggctcagccccaggattagcatcgatatagggaaaggggcagcagggagcccccttgtcactgccctcaaggagctgatcttctaattggaataaggcctgcttctgccaataatcaaatcaatcatcctggtgggaagtggtggaggtaggtaggtaagagaaactccatgtggcctgagaggcagtatgtacagtggttactagctaaagctgacagtccaaactgtatgaccttgggcaaattatttaacctctctatgctacagttttcccattgaaaatggtagcaataataattcagcttatcatagagttatatatgatgattaaatcatatatagaaagtgcttagaatgctggctcacatgacaaacactccataaaccttagctattctcagtgactaagggcctatcttttactgaaccaggtgcctgctacccctggggtacaaggccatggcctggaggcatatgaaggtattagaccggtatgtctcctcttcctggagtgtacattttcctcaaaggcttaaggaaggaaaagatgaattttaataagaaaacaaggatgcatactagagttaactgaaaattcaagtggatgtttaagataaaagctggacttcaaagacattcccacttggagccaacacttcaggtttacatcatcagccccccaaggtttcatcacattcttccctctcagcccttaggggtacttgaatacaaaagttacagtaaaacaaacacttgtgaattcaagtaactctcaagggggtccaatcattctctgggggtaaggatgattaccaccgttatatatgggtgaagatggaggctcgaggtcccaatcctgccactgccacttatgagcaatttggattacctttgctgcttctgagtttctccaactgtaaactggggtaatgatgatgatatatatacttcagagcattgtggtaagaattaaataagcacttagaacaatgtctggtatagcttgtgctcaatccacatcagcttttattagatccattcttgcatctcctctcacagcaccattgtcagctatgtgtcatattatgtccattatctggaggagaaacttgaagctgtggaggttcagtaaggtgccccctctcctcctctttgctaacagcaggcattcctgcctggagtggggaggtggtgggaataaataacctcgaaggtccttcccagcaacagggctctgtgactcaagtgaatcttcggagctctttcatatcactgttctggctggagctgaagcagcagaactcaggaaataggggtgggactggacagggcgggagatgccttagcagggtgggaagtgactgctgccgcccttccttctaggccgctgccactgccgggggctatgtcccacactcccgcccaaccggagagcaaaagggaaactcctctgcttggaggaagctgactgaggcctccttttccgcgggcggcgtgggggagggggctgcccctgtgagaggcgcagtgcagggactactcgaaactcaggagtcaacggggtggcagcagaaagctgggcccagagaggggcatcccagtggctgtttgtcctgcctgggctagtccagaatggggactgctgataggccagagggtgctgggagagacgggcttcccattgatttatggtcatttgaagggaaaaggaaaataattccatgaagtagaaatggcctagtggaaggaggagcagagtcagatctgccttggttctgaaacaaactcactgtgtgaccttggacaagtcctcttccccacatgaagaatgcattcattcagttagtaaatattttgtgaacacctgctatgtgccaccattgccctggggaaaagggatgcatggcatgaagatcaacatgttaacctctaatttccttctagctctgacactgagttcatgaaaagtgggtgcaaatatcatgcaaataagcacatatcaactggaaactgcacttcctttttctagcttatccctcacaaatggagtagcttagctctagattccaggaacaaggtatggagacagtaggggggaggggctgtgaccttcacccatgtacccctttatcgttcacaaagcacattcattattcccatcgtgtcataggaatattaccctcattttacagatgaggaaactgagtctcagagaggagaaatcacccaggttatgccacagttagagcagaggccctattaggatgttggtccctttactggccaccaacagaagtagaatggaaatgacctggtctgagagctgttggtaacttttggccttatctccattgaaaacaaatttaaccaggaccccccaccatccccaagtcaggtaatgcaagtttgcttgcggtggtggggattgcgtattagaaaaaacggttatgtaccttagagtcctagtccaggctttttttgtggtacacgccaggggctaaactctttgaaaataaaagctaatctttcttaatgaagtctatactccgtgccaggcaccatgatcagtccttcagatccttacaacagtcctgcaacatagagataactgccccggcctagatgatggccaagtcatttgcattcttgggcctcagttttccatctgtaacataagggagtctataaggactgattccacttcaggatattctggtactagaaagatttcaaagtgtcgttggtggaacccagctggtcggttgctcaggccagccagtcagagaatgtggttgcagggaggagtgaaaagcagggggcggtaaagggaggccgaggagtgagtcagtctgtcaagatggccagagccattgtttccttctccatctggctgttgcacaaggccttcctccatgtcacatggttggtgagatttgggggcagacaggaggtggaggggctgaccccataactaggaagacacccccactatcttgcaccgaggtatgagaacagaaaggagaggaatcagtggagggaaaactcgcagatgggggccaagttggaaaagtctggaaagaaggtgactccaacctggaagaaggcttcctatggtgatggggaggcggaatagttgagtagatgactggaggctagagaagggggagttcctgctcaaggtgggggcgtggaactttctaattgcgactgagggggcggggaaacacagccatcatccgctcagcccctccctccccgggctccccgcggattcgctcagtcccggggcaaaactacccgaggcgccagcactccggctcgccagctcgctcttgggctgcttagccgcctggcaccgcgcggcgcccgcggacacatggcccaggcgcggggctggggtccggcgttgcggttcccgaagccacggacgtggactccgtggggtgtggagggcacccggtggtacgcgccgcgctgggatccaggtgaactgagagccaggcagccccaggcggggaggtcagggctgagctgcgcttcgcggagagcttcccgcaccggctcttcgaagctccctgctccctctgcctccttgtttggttccagcccggttttcatcgttgagtcctatgtccatttgtctaaaacctcacccctggccggcagtgcccccttttgaggctttccaccccgcacgccttctttcttctaattcttaggcagctcttgccccgccctatgggtgccccatcctcttatcccagcagtctatccggcttcgtccccacccacctctgtctacatcctccgctcaaaaagaacaccactttggttactaacacgtggtaggcgttcagtaaacagtatgtccctttacacccattcctccagcaccttcttcgtctctgcctttggtgtctgcttgttcaccctcctgtcttcctgtcccactatatgtctaaacctcaacctgtattttttccttgtcattgagttgtccgtctgtcctttcatccttttatttttatttatttatttattttttggtctccagatcgttaagtgttatcacctacacagtagctccctacatccccctatcactccaagggcctcttaccttcccactctgtaccccaggtgcaggacacagcccagcaaccctggtagcacctttataatcaactcgcattgcctgggagctccaaaccaaggaatgggtctctgagggatctcccaaagtctctggcattttgtctttttaaaaattgaaaaaaaagttttggggtacttatatttccaggctactacttctgagtaattgttatactcactcactctctctcgagactcgaacttctgagctcaaacaaccctccctcctcagtctccaaagtagctgggattattgcacccagctctaattcgctcttgattccacttaaagggcagggaggaaatagcaaactgggttgggtttctcaccatagatttaacatggaattgaacacgctgaaacacaggatccttggagattctgagaacagactctctgattgtacttatggggacactgagagccagagagggcaagactctcagccaggtcacacagttcctccgtggtagaaacaaagtagaagccagagtgacagttgcctggccctgacccaggagccttgggtgttgggggccaggatcatttccttgggggcctgtccatatagagtcatcaggtcccatccaccccggaagcctggctgcccctccctccctgtcctctgggaactgacctggctacccacctgcctgggatgggcgttctctgtcaggggctgccattgcctcccccactgacatgggagctccaggaaggcaggtacccaggctgtgggcctgcccgccccactctctgaccctgtcccttgcccagtgcccggcacagacaaggtctgggtaaccatgttatgggaatggctgatgcatgtgtgtggggaagttccagccctggctgagggcaaatcagaactcctgcttagtaagtgtgtatgtatggaggggaaaggggggagctgtgcttgaggaaaggcctgttgagagggtagacgagctccaaggccaagttgagcccagagccctttgctgagtggccctcaaccaaccaaacacatcccatgccctctccgatgtcatcctggggcctctgagggctgcccttcaaggtcaggagacaggggggtggttggccagggacaggctcagccagcctgaattgacattgtcaagccctagagacccctcttcacagggctgggctgggccaggctgggggcagggcgtataaaagccacacaccactccacaagcagccctccagcttccagggcgccacgtctggtggcagtgtggggtcaggccgtggcagctgacgatggaacctgtgaatgggaaggaagagcctctctttctgcttccccggctcctcctcgccttcccaggttttttctttgggagctgcagccctggagggacactggaaaggatcccagacaaggaggtaggatcctgagggctgttcaaggactctggatacccatagccccaaggtgagctgggagcaacgctgggggcaaagaccagggctccaggagtggggcagcttagcctcagccctccccttccctgcctttcccccaggctccccacccttcctttttctcactttcctcccctggccccaggtaccccccatcctcagaggaccatcatgccacccccacccccgtgctctgcagaagccctgtgcatgctggacttgcagatgccccacccccatgggaacacacagagcagctcacagaagcagagcgttctggaaggaagggaccctagaaccagggcccaccccattttttccagatgaggaaagtgggcctagccagggagaagcaagctccagggctgaggactgagactaagctgggcagaggggagcactcctgtcctcgcctgttgtgtgtggggtgtggggctgtgtcagaggcaggcttgcctttgctcatctcctctctgcatgttgtgacctttggaatctggagggcaggaatggggtggggcaccggggtggacatcctgctctgggcgtctgtgccactacggtcaccaagtgctctgtccacggtgaccccatctatttgttagggctgggcaggcagacctccccgaggcgttagtggggtgctccatctgcctgcagcagaaaacctctggggaccctttgagatgggccagtaaggtcagtccggagacccatcctgggtgtcaaatggtacctgtggcactgtcatggcccggggggtctactgagtggatgctggggcccagccttccatcaggctggcacattgactggtgttggttgaggagagatgacaggtccccgcgtatctgggaaagagccagggctgggttatccagctccacctgcccagtccaagtgcctggaggcagtcatgagccgccccacacctgtatgtctgagcttagggagggcaagggcagagaggttaggtgacccctgaatctcccctggcctgggcctggctgggcctgtgctccagagtccctcactgccagcccagggctctgagctcagcacagagctcctccttccagggtgctctggggtgaggctggaggcaaccgtgatagtcccctaggctgtgggctgagagggggtgctccttccaggatgtagctttctgtcctctgtccacacttggcaatgtatagacagtgaggtgtttgtgtggccctcaccttttcaaacccctccccaccactgtattccctctgtccacatctgcctctgcttgggctgtcttcttagtgcaaatctccctcctatggccatggctcctcaggaagttttgttttgttttgttttgttttgttttgtttgtttgtttgttttaatgaaccatgactatcctctgttttgggacctgatcaatagccccctttcatgaggctgggcgggggccccaagccaccagggagcaggcttcgttgaggcatgcgggaatgtgcgtacaagtgtcagagcctgtgtgtgaggccaccggtactcatgtacttggtggggctggtctgagtgtaattcattttcccctcactgctcctaccccttttctaaaaacttcccagctgaattccctgaagtgatttgctgcggtttctttagctcctatggaaaagagtagtagaagagtctatctggttccttttggatattaacctagccattccagagtgggggcatgggtctgccagcagcagctcgagcaactcccattcccaggcaggcagggcggggggactgttgggagtcctcaggtaggcccttattgggacccaagggtctcagagtgaggctcaggggaatggtatatggaactgctctttgccacagcgtaggagaaaagggctgataggtcccccaaaggttagctctatagcaccttcagtgtcatcctgccacctgccacagtcctttacagtatactttcacatttattgtctctactctacccagtgggtattatactctagtcttgttatttataggtgaaaaaactgatggctggggtggcacaatgacttgtcctgggtggcataacaagaaagtggtagaactggggccagcatttagctctactaattcctaatccagggctcattctactattgctcagtgcttctcaccatatctgacgcttataagcacttactatgtgccagccatcactcttaagtgtttacttagcctagtggatctgctctgcagccattgaaggtcagggttgtgatgatcatctacactttccagatgaggaaactgaggcagagtcacacagctagtaagtagcagaggccatttgtacccaggccatcttgctccagtgttcattatactccctcttgtggggcttacgtggtctgtgggcatggtagaatgaggaaagccccatgcctcgggcacagaaacacacacacacacgcacacacacacacgcacaaacatacacacagagactttttcttttgccaggccttggcctgcttcaagcactctacattcccctgcctgatgactgagctggcatccaaggtagcaacagcaatggtactataggacacacaggcaagagtgagggcttgaggaaaaggggaagtcaagaacctaaagcctccagttacctccacagccactcaggctgcaacctagaaatgggcctgtgaaaagatactctttctcatccattccaggcactattaatccatgcaagactcaggggcagggagcaggggttggcaggggtattgaaggggatgagctatctttgccctgctgaacaggctgagctctcctggccagaataaaagagggagatcaaaaaagaccaaaagaaatagccctgatatcgcttgggccatttcaaaatgtcacaatgtgcatggcaaatatcatgattgtagcttaccctgacaattgtgttcactgtcattcgacaagcatttttattgaacatctactctatgccaggcactgcgaagttctccttctaagtatttatagcagtgccccattttttggtagttttcatactataccctcctccttttttgtttcctggtttgatggcttttaaaaaaatacagctggtgtctcagaacccatgatatctgattcagttaaatgtatctactaaaagataagttgactttgctcattagtcatatgattgtcatttatttttggttgtgctttgaatatctttcaacatttgttcattcattaacaaacaatagtgaggaaagtactgtaagcactgtgcttggtttcctggagtggatggaattggctttgacaaggtttcttgcccttagggaaatgataaaatcattgcaggaccccactttttgtcctttttagcactgtgcacaggcaagatgcctttggcttcaactcagagccttaaggatgcttacaattgttaaagcccagcctcaggaaggaggtcatatcccttcccacccaccagaaggattttgcttctgggagtaacttctggtgtgcaggcctcatccatagacccacagggacttggcgcaccttgaacaaattgctagaggatacgaggggcagtcctgccatcaagaggaaaagagggatacatgggacacacagtggtggtagtgtcactttatcattgctcctctgactctcatcagggccagcagggaaggaatgtgggagaatttcagtttggcctagtgaactgaaagctagacaggagaggggcacttggggctgggttaggtctggctctgtctttccctgggtgaccttgataaagttgctgccctcagagacagatatttttgctctcatctgtatcagatactctaacaagcaagttagatggatgcagttcctgccttctaggaatggtgtggagaaaataaccagtgtacaggtattgaccctgccatggatttgctgagtaaatcatttgaggccaggagtgtgagaccagcctgggcaacatagcaagacttcagctctacaaaaaatgtaaaaattagctgagcatggtggcacacacctgttatcctagctactcaggaagttgaggcaggagattttcttgaccacaggagttccaggctgggtagctttaagtgagtcatgcttaaagtctgctcagtttctgtctttgtaaatgtgagggatagcagttgaactgcatgaggtcctggatactctcagacctgactaataggagtcctcaattcaacaatgaaatcaaggttgtgaacttgtgttggacccttgtgatgaaaggccagagagaaatcaaagccgaaggctcttgtttcttactgaatttgaatggactttctggtggtgcttactatcagaactcctggaagccctcccctgccacgattaatgttcgtgccccaaattttccatgcatttctctgcggaggtagagttcagacttggggtaggggacagaagcctggggtattggggaagttgcagagccactggggcctgagcaacgtagggatggcagcttcctgctcaaattcctaattatctggttttcccctaccaattggagatttcactgaagttgtgtcttctggacatcccataaattatccgagcaagtcactgaaccctcccgggcacatagcatatgtgtttaaatcccccaaacagtgccggactcattcagaactcaataaatattagcctgtgtgcctggccaagtcactgcttgagcctcagtctttgggcttgcacctcctccctggcagcggtgtgaccggagggaaaggcagcggcgagggccttggaggacctgcaggcagtgccccgcccacccagatttgggtgactttctggcgagtccggtgggccagactgcgcccccattggccgaggggaggtgggcggggcgtccctacagccctactcgccgacgctccctccccacttgagctgagtggactcgggttgacaacggctaagcagccgcggcagctgctcttctggctggcaccgtcacccctgcccgaccccaggccccgcgtgtgtcccggacggagcagtccctcctgggctcgcctcctgcccgctcgctctgtgtcagcgcccgaacccaaaggggtggacgcggcctccaggtaggagtctgggcgacggcagggggagatccagacaaacgggggcgcctggggctccctctccccgctttgcctctctggcgcgctccggctcggcccttctcctagcggttccgccgggcggcgtacgcaagagacagggaggaagcgagccgagccacccccgcccctgggattggggggtcagaatcgccgaaattgggggacccccgagcgcgccagccgcgcgtcttccagcgaagcctcgcgagtggggcggtggaaggcagctgtccgcctgttaccgccgggcccgtgggtctcgcagccgtcgctctggggctttggaggggcgttgcagctggccgggggcggcagagcttcaggctctgttgccgggtcgcgccagatctcctgccctctcctttctctgctttcgagggcatttccaggaagcccccgtccggctgtatgggttttcccgtcggccactgcctcattgctttctctcctgagaaatgcccaggacttcttggtattaagatagctgcggggaccaagcgaaaacgtttggacacgtctcatcttcataggcctcattttcccataaagtccaaaatgggtttggattagaggaaaggcttttagtggaagtttttggaatttccaaattaggtagtgtggggttctctccacgttcctcctgacacttgtgaaagttgcgcgctgaattacgactcaggaaactggggttcagccagtccatgtgaccttaggcgagtcatactactgtgtgggccatagtgttttcagccacacctcaggtggcagcttgatttcagtatctaaagggcccggtctctttcaccctgacatttgtttacttggtacctggggtcaggctcctaactggcaggtaaaaggttgtctctgagacgctcggggtggcagcagctatgcacacggagagctttgtggtgattatgcagctaagccagctggaaaactagagtgtgcgtggaggggtgggcgacagcagccagaccaaggtagggagaggtgggagttttcttccagagcctggggccccagaggttgggggcctcagagattgggctggcttggagcctatgcttacccccaagtcccagggcctggcttctctcccagtcagagcctaagcggggaggaggggttaatgaatcacacccagggctattttcaaaccctgactcctcctgtgcgacctgctccctccccactctagggtttgccgcccccccgccccccacacctgtattattgccctctgagttttcctctcattttcatcctcctggaatgaaagggggacaaatcttgtctgcggatgcgatgggaaggtgggcagcccaaaggcatggagaagaaggctgcaggtgatttctgggtggctttcgcagtgggaagagtgtgatgggaagggtggtgttttgctgtaagggcataggggtcggtagtgaaactctttcactctaaaggtacagctgccatctagctggacattctgggctggttttcattttagggacgtggccttttgttaatgtgttggactttggattttggatttctgctccctagacctctatatttagtgctaggaaacaccacactggacactgcctctcctgtttttggagaattatgctaaacctctctgtgcatctacagctcccctcccccacctagagaggagaagctgcctacagatgatatctggaggtgtttagagcaagaagggctgaactgaaggtgtgcaaagcaaaggggctgtgtgcgctgtgtgcttgcttgagacagggcttgcagtgagtcatgtggggaggatggcagagccttccttattcaaacacaatacctcctgagttccagcagagaagcaaagaaagtggcaccaagaagactcgaatgttgtccctctctgtcctcttaaagttttaaaattccattattgggactacagattggagagggagcagaagacccctgtgtctaggtttagaggatagcaacagggacacaaaggcaagaaggtcccaaaggaaggaggggatggagtctccaattgggaagctgtcacagctgcagctgctttgctgctaggagactcctggagctccttatttgagccatggaaagttcaggttcaacagatggcaggtttatcacgtgcaggctgtgccctcacctcttttctggctagaagaaagggttgcctctgccttgaaaagaagagaaggaccttttgccttaggctcccagtttggttaggatcaggtgtcatggccctgggccttgggaaagctgttcagcagataaaatagggacagcagatttcaaagatacaagggctttagggtgggaagtgtgagctcccggagatctaggtgagttttacattcttccccaccccacaacagggtagttgggcactgggttgggcacacagttgctggtgtcaggtgtttattaaggggtcttggtttgtgtgtgcgcacgtgtgcatgggcatgcattcgggaagggtcctggtagataggaatcagtggactggaggccacagcctgggcccttgtcacaagtctgaagtgctgtgtttgtgggtggagtttccttttccccagccctgcaggttggtaacttgcatgctaaacagttgctgttcctgtttacctcgaccacacacaggaattttagaactgaatgttaagttccctaggagttcagggtggtgtggagcaaagaacaggggattgggagttgaacatggggagctttaactccaggctctgccgcccccctcaaattctccgactctgggtttctcctcattttttccacttcactggattaaactaggggatccatagctaagtgctttgtaaactaccatgtgctgtataaattattagtcattaagtttaggcttggtgctaggtcttgtggaggacacagagtaaaaacccccagttccagggaatgtaccatctagtttgggggttagtggcataaataatacatgccactaattatttatgtattaaataataataccttggtgaggacttcaaaaaaattattgtgaataatttcaaacatatataaaaatagagataattagtgtactaagaccccatgtacccatcacccagtttcaacagccatttgcccatggccaatcctgccctgtccatactcttatctacatcatgcccttgttattttgaaacaaatcccagaaaccttatcagttcatctatacatatttcaatacgtatttctaaaagataaggattcataaaaacaaccattatcacacctaaaatagtttcttaatattatcaaataaccggtaagtgttcatatttccaattgttgagaaggacttatttgccctggacgtccattctgccctgggaaatccattccagggagtgattgcttttgactgaggggaaggtgacggacagaggcagtggcatttgagctgaaccttggaagagaggcccaggaaaggtcccagcccagatgttagccgcctctagggctccagatctggaggctgacccatggaggcttcttgcggagacttcctgcctttgtttctctagcagtaaatgacagttctcactctcacacttgcttccccagtccagggcacccaggagtttggggtacgcaggtctgggagaattctgggaggctgctctccacctaggcccctcccctgcgcctggcccctgaggccagttcagagcaaaacaggatgcattcaggatgaacgtctttcccagcttgtcatctaatcaccaaggcccagcttggagcttcctctctcattcatgataaaaaccctcactgtctctcttttcccttccgccccagtaagggtgtgctgacttcctccatatccgggccagccctctacccccatgtggggctgagggagagattccctcagtgcaggcctctgcccccacccacctcaccacagcctgtcagagagggagagaaagaccccaggaatgttctccctgactgcaggctcctgctcttgggctgtctttgggaaaagagcagcctccttccaacaagcctggggtcctgccactgcttggttaatcattgagccacataataaccaccttggaaagtcatctctaggggatggtcattaactaactccctgtccacctcaggccttaaagagaccatatcctgaaccctcaccttcccccaagggaacattgacaaacattcactcacgggaacttctggggccagtgaaaagtctgcccctccatcctttacttggcaaacggaagcagttattcacaccatttgaaggacatgggttcagcttggatggtattgagaaggggagcggagtgaattgatggggatttggatgggcagtggggtccagcatcagagttaaaaaggggtaggggggtgtttctaggagtagttgatcgcctcatctcaatttgaaagtctaaaagagcaagaaatgcccacccaaagggtctgccgatgctgggtatggggtgaggctgtgtgaatgtgtgtctgttttcagtacagctgtgggtccctccacaccaggctgcagtggaaatggggacagccaaccacatgattgctgctgagaggctgaggacctctgtaagtggaggaggatgccttcctccgggagcctgtatctggacaagcagtggcacttggtaagggtcgggccaggacccagacccagacccagacccagacccagacccagacccagacccaatttagaaagctccagaccatatgcagtttcctgcagtttcagtaggaagagaaggaaccaccccgtgggcctactacagagttgggaaacggcttctggttctgccccctctatagctttctctcggtgagtgatttttgctttctctgggcctcaatttccacaactataaagtgggtagggcagttggcaggcagactcagtggtctgtgagccttcctttcagctatgcaagtatgcctccccactcaagacccttttcttatctaccaggcaatggtgagctggcttcaaattcaatcaggcccagacactgaatgttctcagctggctgggtcagttggagctggccaagccctgaattgccacagcttgggttctccttgtgcttgggcatttctgcagtttgctctctggcccctccccaagcctgtgtctgtccctagtggccagccactctctgacccattcagccacaagttaatgagtgaactgctccccctgggtcgtaccagcccaaggtgctcctgggatcctaggtccctgtgggaagcagccaagggcctagccagctccagtcacctttatgctctctcccacaacccctctagaggtaggtatgcaggcagagctcagggcagaaggacctttagagggcactaggtccaactttccttctgaagcttggggcttcccgacaggtacttgtgcagttcctgctcactcatgttcaatacctgggaatgtgatatgtttcaagcaagttgctttcgtctttggaatgtgtgaaagttttctcttatgttgaacttaactgtgcctccctgaggcttctaaccctgggttccgagtgtgccctctgggaccacctggaccctgtctgctctctctgaccttcagggatctgaggatggaacccaagtgcacctgtgtcttctctaggccaaacaaccttcaagcgtctgcgctccttctcagacctggagcagcccccttcccagcctcatcactgtcctctgtcctccctacatgctactgtttatggcccccttaacatgtgggggcaggaaatggggcactggaaacccctcactccccttagtttatttatagtctgaacttgttcagatgacttttccataatccttttctggttaccacaacaggtagactcctaacccccagaatcttgggtgcaaataccttagacaacactgatttgtttatggttcaggtccagccagctctcacgattggagagcccttggaaggtagggccttcttattggtgcccccatagtggaggacaagcctggtgttagtaggtgttccccttgttgagttaaatacaatgtaatatgtggggggcttccagcgtaccctgctttcctgccactcggttttatctttggagttggtcaggggtgggtggagggaaggggatattttagggagtactgaagccggaaatgagtatgagccatgcccacagtggggcctagaagagtgaatcagacagtgagaaataccaacgtagccattccttcccctggcagttgatgatgatgactatgagtcctcccatttcttcagttgccaaggcactttcacttccatgattccattgtgttcttagagcagccctgtaaagtagatggtatgatttccccagaatgatctgtggtggtctccacctgaggcccagggaagggaagaacagtctccagtgagggaggatttggagcccaggtctcctgaccctcagccctccctgttttccccaaaccacacccagcagccatggcagccggggctgactcggcagcttccccaccacagaggaacccctgccctggctgcaactctgttcctgtgagagagtgagctccaagggacgtggcctaggatttcctgtcctttatctgggctggccaaaggctggcctgtctgaggtgtgagataggcacctgcagccagcctttctgctccaggctgaggtcaagtcaggctgtggcagaggcagtgagcttgtgggaagagcttgtccccaaacatctgtcctgagcagtgcccacaccagcagggccttctaaatgggaaaaacagagaggggaatgtggaaaaggggtcagagtggagcagaagtaaaatacgtcctgagctgtacacaagctctcatgttcacagtgctgggagactttgggcaaattacttaacttctctgagccttcattttgtcagctctaaaatggagatatgtacccacctcatggagttgttgaatattaaatccaacaatataaataaaattattgccattattgttgcttggtagtaccttctgcagtcctgtcatttggttgtttttcactgacctgggggtgggcagttctcaaacctgccacctcgtgggcattcggtctggactttgcagtcatttcagagtccaccttacccagaaaagctccctttggccatgcccacccacagggctcccttcctctggccttctttagtggcattcgcgacactcaacaggctatagtagtgatggtgacaccaataataatagtgaactcttctaaattcttggcaaattttaacttctttagcattcatggcaattccataaggtaggtactgctatctttgtctctcttttatttaataaacttgcccaaggtcacatatccggggagtgatggagctgggatcaggacccaggtggtctgactccacctcctgacatctttaatgactgggccatgcctctctccagatgcctggccaggaggcaagagctgaggttcgggtctccttccccacctgagtgctcatcacacgcaccagtgatcagtcacttctggacaggcagtccccaggtccttgcctgtctgctctgtgcacttcttctcaccctccatcaccaaggtggacagatggatagagggaagacatggaggagtgggtattcatgctctaaaacagagctgcattggggtggggagggagtgcaggagggagttgggcagtgggggtggcagtgtgggcagtgggggtggcagtgtggttctgacatcagcaccaggcctgcctgattagcaccttctagtactgggggtggagaacagggtgctgggtggcatcagggaggaagagacatttgaatatgctctcttgacaaccaggttgcattatttagaaggcatgggtggttaggggctggcaggaggctggctggattagctcttatgatcactagctggcgtgtcccatgctagaattgggtgggaggaggttgtccagaagctgtagccctccccgaagtgcttccatctcagggtcttgggggctgcaagcttccttccctcaggctgtactagctgccagctccattgcttcagggcttattcccctttatcttgcctccgaagcaagctccagggagtgctacgaaggccagtccatggtagcctgtctccctgagaaggatgggcctggcagcagctctggccgagtgctgcaggagaattcagtttttgttctgttttcagaccttagtacccagcatagggcttggcaccaagtaggtgcttgggtattattagttgaataaattcacagtccatggggagtggattctaaagggagagccgagggaggctgaaatgggaacaggtcaacaggagggctgtggttatttaggtaggcttctggcccaatctgtagtccaacagaagctacatgacctattgcagcctcagttttcccatttgtaccataggcattacctgctttggaggagttcttgtggggaccaagtgacatacaggatgatcaagtgctttcctggctgataggaagttaaattcaggctaaccactcttactacaaaaaccctggtagatgattttgtgtctgctgtgtgccaggccccagcctagacaatttcttttctttaatgaggaagattctaacttggtagctctgactctagagccaaactgcctggatttgcatcttggctcacctcttcttagctgctgaccttgggcaagttactccatatctctgggcctcagtttcctcctctgtaaaatagagatattattggagcacttagctcacaggtttgttgtgaagattcaatgacataatacacattaaaaaaaaaaacttaaagaaatgtctgggatataataatggctcagtacaaagtccatggctcagggcacatagtaagtactgtataactattagtgtctgctatattttattaataattacattcagtatcttaaatattgctgtcattaatgagtaagaagtatagagccaggaccaggggcggtggtggctcacaccagcaatttggaaggctgaggcagaaggattgcctgagccaaggagtttgagaccagcctgggcaatatagggagacacctatctctacaaaatataaaaaatacaaaaattagctggacatggtggtgcacgcctgtagtcccagctactctggaggctgaggtgggaggattgcttgagcccgggaggtcgaggctgcagtgagctgtgattgtgctactacactccagccctggtgacagagtgaggcctcattttaaaaaaagaaaaggaagaggtacagagaggtgacaaataggctacgtcttcaggtggctagcctgttaactcttcccactgtaccctgtaacttctacgcccataggccctacagagctgtaagaccaccatttggggttctccttcccttggccctaccatggcctgagcatgcacgtcatcacccttgcccccagagccctaggctccgccccttgctatgtgctcagcatcacagccctccctctggctctccttggggctgggggaggggtcgtgtctgctcccttcccggggaggccacttctctcaggcccatttcctttctatcagagataattttctctggatctcagggtggggccaggctccttcaaggcatttcctgcccaggagtttatatttggcctgagcaaaaggaaagggaagtaggcaagggggtgggatgcagacgtggtggcacagggtcaaaacagacaagtgccaagactttccagaccaagagagggaggcaggaggtaggcatgccccttctctcaagtgaacgtgggtgccctcccctgagcttggcagagtgaagtgctccttcaggtcataatgcctccaccatcaagcagagttcattttctgttcgcacatctctgagccttggttcctggctatgtggtttctgtcctagggcaaggctttgaggtgaagacatgtgctcaattccatttctagtgctgtggtgataccagacaagggagcagagtcagaggcctctatactgtgtagtgggaagtagggcttcctgtctgtgtgttgccagaacattcggtagcccttaacacactgcagcggcaacacaaagaccaaaagtacccagtgcagagaagcccccagttgaatgggggatagactcacatgctgctgagatgatcatggaaatgtgttaggggactgcttcattgaactgagccactgggtgttagggggttggtgagaggtcaggggaggcttcgcgggagtgggtgtttgacctccagcttgatgaagaaatagcagtttgaagcttcaaatcaggccatgtctagattgtgcagagccttgaatgccagggagcagtcaagactatctgccccaggctgtgggagctctttaggttgtagagtaggggagcggccaggttagagctgggctcttggaagaagcagctggcaggatggccccttgaaaggagaggctggaggctgggaacttggagggctgaagtaatccaggcaggagaacctagagcacagttgggcaggaaaaaacccaaccatttgatggaaaagttggtagaatttggtgcctaaatacatgtggccagaagagagcaaggatgacttgaggtttaagcctaggcagtgggcgtattgggaggcaggaacatatagagagctggtttgtggggaaagatgggtttggtttgcgttgccactgaggttcctcgcttgggtcctcagaagagaatgtgaaggaaggaagctccccgcactgagacagccactacgcatcacacacacctctgctgcagctctagattttggggaacggccattaggagatgtggaaactgaggttcagacagaggtaatggcttgcctgaggttatgcaagttgctcatggagctaaggccagaaggtagttcacctgaccgttagtccaatactttccactcaaaccacagtggagagcagtcaccgctggcctaatatctgccccagactggtttggctggcatcatttatctctaggccagggactggagatggtggagtagcacatggctcattaaaacaactctctctttcctaggcaccatgaccttgtcagagcacctgggactgggttgggggcaggagccccttgggggcaagaaaactaatggagcaactgcagcagagcaggtggcagctttgaccttccttgtcatagggaaacccagtgccaggcaggaatgttagctgtctactttggtcctgccataccaagctcaagcccaggagcccacaggctgggctgcctctggacccaaattctccagcagcctcagtgggcctgaggtctggtttaacctcagggtgctcgtgactctccctcatttacagctgcacacaggagctcaggccactgcttcacggagaggagcggggaaccacagttgggggtttcttgtgtaacttccatttttaaataaaatgccaaaccagaattgccacctcttcctggccgatcctgcaaggtgtccacggtgtgcaaaggctagggaccaccactgaatgttgcacccattcttcacttcagcccccaggacatcctggggggagggtgggctgcccagaggggccggaggccccagataaggcagaggccaaccctcaggatctcgtgcttcagatctggagtcaaccttcctttgtctggggctgtctggtgtggtgtatgatgtttagcaacatccctggcctctactgagtagatgctagcagcatttactccttgacccccaccaattgagatgaccaaaaacgtctccagacattgccaaatgtcccctgggggaaaaattgtccctggttgagaatccctgtggtagagactagaagttttttctggggtgtgcagtgttgagagagggatgttatacagaaggtagaaccacacacctgaacctaccactggccagctaaaagattcagtggcttgtttttcctgccaccctgtcctaggggcccctcctgggctgtttgctttggtggtgcctcatttgtgacagggaggctccagaagtgttgctcgcatgggcctggaacttggcatccagctgtagccccggccaagaccgaggctggcatctgaacaggtgcagcagggccctgagttctgcccggtgacctaacaagccagaggccagccagggtccagcactgccaacctaggctgggtgaaatacagaggcccttcctgcggtgcccctcctgtgaggtttggaatgtaggatgagagctattttggtcctgtctcctttcctccctgtgcctccctctgtaagaatcaagttagagttgtgattccagtgaagagcagcaggagcagagagaggcaccagtgaactggaccgccccatagatagggcactgcagacccccttgcatgtctgcttcaaggtcaggagggaaagtcttggtggccctgtaatccctgacagctcttagtacaggtcctcatgaaggtccctttcccactgtcccccagggagagaggtggcatagccagtcagccacccattacagcacttcttctaggggcactgccaacctagagggtagctttgtgcaaattcaaatgaaacagtgcccctgagggatgcagccctgtgccagggctcaagccttggtgggcaagcttattttggcctgggtcccttagtgtttccttaggggagggtaaaagaagctgctcagagcagttggggccacatgctgaggatggtagcttctgagatacaagccctctgccaaaaggccagcaccttctccttaagaggggtccctctctagggttggagagcgggcaaaggaaatgggccttgtagcaaccaaaagaaatgatctgagaagcagtttgccagggcctagcatttctgagcagcagtagcagggcctgcagtggtaggcgactccttgcctgcctcctagccctgccttgagggaccagcctcacagagcctgccttgggaactggggttgtcacatagatagtggcatcacaggtctttctccgccgctcaggacactggcttttcctcctgcactcactgaaggtgggagagacaaacatggagaccagaccctgttttggaggcccccatcctctggcgagggccacggaggagatgcttttccaaataggaagctaagtcaggtaaaggaggccaccacgtgtttaaagtcaccttaaggagcaggtcagctaactcaatgaccttcacaaacaccgactgcctgccttccctcagccatcatagacattcacactgatgctggtcactctccctgctcctgcactcaggtctagagagaacgtgggcctatgaatagaacaggcctgtgactggtctctgggtagaattttccagggacctatatctgtggctttctagcaggccttttctgtttagggcggtggtctttatctcaggctgtactttagaagaaccgggagagctctcaaaaacaaacaaacaaaaatgaaccctatccccagagagtttaatttaactagtcatgggtggggcccattagtaaaagctccccaggagattttaatgtgcagccagatttgagaggtgagggaggaatgggacgggacacccaagagctccagcagtaataaaggatgctttcatctatgtccctgtgacatccatccattgcttgtcttgagtcctgtatcttcccgcctggtccccatgcctgatactgtctttatgggtaggcatgagcaggctgaacccaggaccgggcagctctcttataacccactgagtgaccagaaggtacaaggactagggttgcctagtagtggtgtgaagagggggtacccagcccaagagtggggttggtgatactggctggctgaggccttacttcctgtagtctagattagatgcctgttgccttctctcttcctcctggctctcttctctcacctcttttcaactggtacacaatctgaactgtgtcttaaagactagatgggtacaaaattcagctcatcttaacaaaaatagccttcattaatgataacttttatatagccactttcaaaaccagcaaaagcccgatcaaatctataaggtaaccacagtggtagacaggaaagtcgttagtctccactgtataaatttggaaaccaaagcttagagaatgacacgagttgtctcagatgacttagtggcaagcatggaagctggcttgattagaaaaaagctttttttccaacttagtgatcatctttgggcattattgcatctcccagtgagaaatgttgctgcctctttcctgggtgcataagccctatgcttgagtgtttctcaagaccagaaggcctgcttttttcctggttgcatccttctcagcatagaaaactgctctgtgctgtctctgggacgtggcctgtgtaaatgtaggtgcagatactgtcattgacctcagaaagcatgtgctgctgctcagcctttccttctttgatgctccctccaggagacctgtgggtttggctctgaggcctgattggactctggagctttctagtatgccctctcccctgactctcccagcctgggtcatctgggcccctcccccaggggcttaagtctcagtggaatccagtttgtgccagctgactgctgttactgacctatcctggcacatcacctaagctttggccagagcatgcactgcctgcagaatatagcctttaaaactgctggcagccatgccttggaatctgcatatctggatacagaggtagggcaaggggccacagacattcctacctcactcacctcagcctgcccgttgtcactctccccaccagatacataagcccatcctcagtccgggccacctgggcttcagccccaggtgaatcgagtctactgggggtgggggtggggtcgctcctggcctcagcctgggtaggctgagacgagtgggagggacaaggcagagcacctcagttcagcctttaatcaccaagacatatgtctctgactgatccatctgggagggagcctcggggcctcccagccctccatgagatggtgtattgtggggagccaatgtccctgacatcctgtttggtaataacccattacattctctagattcctgttaaggagggctggtggggaattcagtctgtagccctactccaaactcctttgctcctttgtctttggagcaattgcagcctctttgaaggctccttacctcacttcccccagccatttggctgcaattctgacagtggtctgggcaaagccattgtccggacccacaggggaacgcagcagctgggcttctttctctaatttcctctttttctttgggacccttcagagtcagagttggggtggaacacatttgttgagtgcttggtattatgtgccaggggcttttactttctgtagtattttatttaatgctctcagtagctataagatgtggatgctggctgggtgtggtggctcacacctgtaatcctagcactttgggaggctgagacagggagacaggaggatcactggaggccaggagatggatatcagcctgggcaatatagtaagaccctgtctctacaaaaaataaaaagaaaattaaccaggtgtggtgtggtggatgctattgtagtcctagctactcaggaggctgagatgggaggatcacacaaacccaggagtttgagcctgcagtgagctgtgatagcgccactgcactccagcttggttgacagagtgaaaccctgtctcaaaaagaaaaaaaaaacccataaacatgaaaaataaaataaaaatagaaaaaagatgtggatgccatggctcctattttaccaagaaggaaacagaaacctggagaggttatacaactcgcccaaagtcaaagagctagtgactgacagcatcaggatttgaaccctgggttgtgactccactagaccagaaggagcaggaaaacagcctggggggctggggttggttcctttgagtctgagctccttgcttggctggcatgagggcaggtggcataatgcaatggcaaagagcactgaacatggagtgaaaagatcagggttatagtctcagctgtgacactttaccctgtatgaccttggaaaagtctcttgggcctcagtaggccttatactgtaacttttaaaaaataccaatgtggagagtcctaccgcagatcaattaagccagccttctggggaaggggccctgggcactggtattttttaaaataacacttcctagctgattcttatgtgcatccaggggtgagaatcactgagcaatgtgatttagaccaagacttttcaaactttaatgtgtttgcccaagggtcttcttaaatatagtggttctgggtgtggggcttgggattctgcatttctaacaagctcccaggtgatgttgatgctgctagtctgggactacactttgagtagcaaggggctacagggctctaggtagtcatgaaagaacttggcattgacctgagtgagatggtccccttctgccaacccccagctagggccaatgcctagcatcaggggagggaggtgcctctcctaccctctccattagccatgagtaactgagggctgcagtgggattttaagggtgtgttcctggcatgcaggcctaccctagagatttgctccctttcctggggtggccatacttgtgaccctttaggggccactgtctgctcctgcgcctgcctctctggaagtcctaacctggtccattttctggcacctcccttttgtcctaataacaggaaagcagagctggctgccaggatgcgtgctaagatggggaaagggtctcatcccaggggcatgacaggaacagggacagggaagtggctgtggcagccagctcagctgtcctagcagcagaaccatgttcctcacaggctccctgggcagctccctttggactggtcttacatcacctagactaccactggcctggagcacaggatcctttttcaggcttgcattgccccctgccagacaggtggaggtactgctagcagggctctgtcagacactttccagggacccctcagaggtcctggcgattcctagatctctatcttaggttaggaagttgcagtaacataaaacatacatgtatgcatgcacacacacacacacacacacacacacggagagaaagagacgagagagagagagagacagagagacagagagagaaagagaggcagatgcatgcacagactgaggtgcctgtgggtatatacaggtgcatggtcccacagtgatcctcatgagtcatggacatgagcagatttggctacagctacatgtagagacagatgctgtggtgggcactgacctgttgcattcactcacagaaatgcagagatgttcatccttgcccttacccccatttgcccccaaaacctgcaggggctccaggggctgcagagccctctcttctttccctcaaatcctcatcagtgtgtgacccttgaggagcccattactttttctgactgacttctgacttcccccactcttccctccactgtctactcacctagcatctctgaaatactgttttgtccttcatcttatctgtcccagccactaggatttcatcctgggtttccttgtgagtgagcactgggaagagagagctcttcctgtcttggaaaaacctcaccagcctccttagagtcctctggtcaggggggccaggcgagactgtggccacaggtgctgaggaaatggaggatgtgttgggggcaggactccatggcaggatcagctctgctgaagccagctgacttccccaaccaacccggtgatgccaggtcccatggtcccagccccattcatcttggcatcacctgggtgggaagcaaataaccgcccaggcaggtgcagggctttgctgctggtatttggcctaccctgactaggagcgcctcctctgtggctttagtccagctgcacatctctgctggtgctggcaggggtgctcagctctgtgccagaactcccagagcagaggcgacaggctgacctagccatggccccccaagaccccgacaggccagtactgtgtcttcatgacactcagcactgcactatgacacaaataggccaagagggctggggcagtactgggaagctccctgaggagggaggactataatgagcatgggggtgctgctgtcagactcagctgggattccaaccctggcactgctgctttgtccactgtgagaccataggctgagcctgtttgtttgtctgtaaaatggggatagcaaagccatcaccagttattgtgtgtgtgaaatgagagttggctgtcaaagtgctgaagaatgttagatgcgatgatgagaaagagaatgataggaatggttgaacatttctacttcctgcctgggctaaggtggtctacccagggccttggaagggggtgagtccctcagaaaggctcgggggtggacacagctgtggcttcttatcccagcaggcctccttgaccccagatgatcctggttcctgggcagggggtgggagagtgggaggggtttggaacaggcagggaatgagactcaagaaagccagggccaggatgcccagacagtagggcttggggagcagagggcctcctggctggctatgacttggagcaaatgtgctaggacctctggccttctcttgccattgctagatcaccagaatgagacatgtctgcctgctggggttgggcagcatgcacctagggccctggtgtcagcaccctcctaaccccatttctttgcctgtttctttcccttgttctgttttagaagccgaggccaaaagagcatgtgagtggcttcaagcaacaggattccctcagtatgtgcagctttttgaaggtaaggccactcaactgtttaccctcccatacttcccctagccctcagtttttcatctgttagatggggcaagtcagattctctttccaactacacacaagcagtgtctcctggccctgctccgatttttttcagggactttgctcctgcagttgcacctttctctcctgcatcatctctaagggattgctctcacaactgccacaagctctgctgttgcccatgcctttaaagtaccttgtcttgaccagggtcatcacgtggtaccaatcctgaggatgccatgtaggtacacacggtgtgaagaatgccgcctggagttgtacaccctggtggcccaggcttggcctcacttgccccacagtgatggcctcatttctctgttttccttcatttctctttcgggtttttctagagttcttcgcacttgctgtttcccttccccttttctccccacacccctactgcaccctggcttcacctccacctcgcctggtcaacttgcctggtcaattcaccagtgacctccatgtggtcacactcagtggtcacttcccagtcctcatcttgctccatctctcagcagcattcggtgccactggccactccttccttcggcttctggaatgcccccctttcctggctgcctctctggctgggttctgtctccttagctgactctgcttcctctaactgatatctaaagtttaggatatcccagggctctgtccggggccctcttctctctcaacatttctttctcatgagatctttgtctaagtactatccatattctgatgacttccaaatgtccagacctcatccccaagctccagattcatatattcacagctgccaattcaatctctctactcagatgtctgattggtgtctcggattaaacaggtctgaaaccaactcatgatggtaccaccatttacccacttgctcaagccccatacccaggagtcatccttaatttaattcctccttgttcccatctcctatctctaacccttcagcaagacctttttccctccagaacgtatcttgaatcaatccactgcttactacctccactgccacagcctggtgtgacccagtgtcacagctcacctgggctagtgcagcagcttcctgtgctcttgcactctcatctctacactgcagctggagggctctttttggccataggtctgactgtcactcctgctccaaaccctccgatggcctcccagcacactcagaatgtaatacacacagacactctgctctggcctgtcagactgcattctccaacttccattgattactcttacctttgttcacagggctcctctctacacttgctcacaccaagctctttccctcttcagagccttgatgctgatgttcctcctgcctggaactctctctgcagtttccttgcacagctggctgcttctcatctttcaggactcagctcggatgtcactgctttcagaaagctctctgctgaccacctctctacaagcagcctccacccctaccagcctccctttacactatcatgctggctgatgtcttccatgactgcaccatcttggttttaagtactgttgcttatctttttcctttaagagtgtaaactccaagaaggcaggaaccgtttttgttgtgttcactgttgtatgctgtatggtttgctcaagtgtctggcacaaagtaaatgctcaattggatactcattagttgaatgagtaaaggaacaaatgggcttgcttcaccagtaaggtagagagctgtgagacttctcagattctctcttccattcccccaactcctttctttcccctctcccctccctaagtcccagggagtgtgctctgggccacagggggatgcaaggtattgtttggctactgtgctgtcctgtcccttctgtccttgctcccaccctactcccccaagttcaccttgggccaaggagaagtttccctgcctgagcagcccaggattcaaaggggaatgggggagcccgtgttgggctcttggcagccacccggggtcttgggcctgctatctcccatggacctgccttactgactgacagagttctttgggtccagctcagccctctaggcctctcccagacctttccctgaactccctgggcaccctcctttattcctgactttttttccttctgctttgcctcttgtcttcctgctccccctccttcctggccgttcccttccagcccaagggctgctgaggctgagtttgtgatataccactgcactcatctttgcttctctctgccatacagaaggttcgtttcccctggatattggctctgtgaagaaaaaccacggttttctggacgaggactctttgggggccctgtgtaggtaggtgggctgagggccaggcctgggaagccaaaggcctggcttgaagcttcctcgtggaaaaaaacatcccttgtaccctctaacagaggaggagcccagcttactaacaaagctcatcttctgtggtcacattgctcattctgttctttgtgtttgtgataccctcaaccacccagtcactctagctagaaagccaagatctggccttgtttcttttctcctaaagttatagcccccaaatattcctctgcttcagtccctctctacttacaccagcttggcccttgtttgaggccaaaccatggcttctccttggatcgatcacaaggcttcagcctaactggctttagtcttgatagcccatctctcccctcccctctccctcttccctcaccctactcccagatcgatctagatccaccagcgtcgcattgtaacagctccaaatggttgttctttctgcttaaaatgtgtcactgcctaaggataaaaatgcaaagactttttagcataccacccaaagccctttgcgagctggctcattagccttagccccattggtctcatgcccacactggtctgtttgctgactgtatacctacagtgtcctgtgtaagcttgggtaagagtccctgtttctctcaccttcaaaatcccatttgcatcctccaggaagccttctctgactgcatccctccttcatggaagttgcttgtctctccctgtgtttgtctgctgtgccttctgtctgctctgtctttgaacacgccccatttctgtagggtttatttccactctctttgtaagctcctggagggcagaggccataatcttcccagcattgtgtctggttcttaaaccttcacgaatattggagcttgcgagaagttttgatggcttgggcatgtgaagtggcaggtgcatcttggtaggctctgccaggctttggggatggggacccttggttggacacttccattttgttacaggaggctgatgaccttgaataattgtgcctcgatgaaactggaggttcattttcaaagcaagcaggtgagtcatggcaaagcgtgggtctgtggtcttgtggtgccataaggaaacccagggcatacgtaaaccatttgtaaaactagctccagtatcccaggagtctgagatgtccagagcagtgcctttccccagctaggggtagagatggaggagatctaggaccccattctttcctgggaacttgctttcttgcttttttttttctggggctttctataccagaggcctgtagtcaggtggggcagccaagtgaccaaagccctgggctgtgagacaggaggcccatggggcctggtctcagctctaccactgattactgagggacctcagggaaacctcttcccttctgggcctcagtttccccattttgcaaagaaggagatgaactagaaaatctccaattccgtccagctctgttgtgattctaatctaagactacagcctagagcttgggaaggtctgtcactgacttaatgtatatcattgaccttgggcaagtggcttctggtttgtaggtttgttttcctatctgtaaaattggaaggggggttagattaattagttgaccattaccattaccatacatctgggctctgtctgtgactgctggcttcctctggcactcccagagctagctctccccacctaggccatgttctcagccagaaagcagggcccttcacctcagagtcccccaagagtttggaagcagagagtggagtacaagcaaggacttgtggcctgggcttctctgacctgatcctgcagtgcctttcccagaatgaagactcagaagaggaagagcagtgtaccatcagtagccactgggccttccagcaggaaagtaagtgctggtctcctatggggtcctctgatctgttggccccaccgagccctggcctgccagcgacctcaagctgtgagagcgtcctcaccgagcttagtgccacctctctgccagtcatcaccgtgagcctaccacccgagccagcagacttgcccttgccaggccgtgcccccagctcgagtgaccggcccctcctcagccccacccagggccaggagggtccccaggacaaagccaagaagcgccatcgtaaccgtagcttcctcaagcaccttgaatctctgaggcggaaggaaaagagtggcagccagcaagcagagcccaagcatagtccagccacctcagagaaggtctccaaagcctcatctttccgcagttgtcgtggcttcctctcagctggattttacagggccaagaactgggccgccacctcagccggtggcagtggtgccaatactcggaaggcctgggaggcctggcctgtggcctcgttccggcatcctcagtggacacaccggggtgattgcctggtgcacgttcctggggaccacaaaccaggcacattccctcgctccctgtccattgagagcctgtgtcctgaggatggacaccgcctggcagactggcagccaggtaggcggtggggctgtgaggggcgccggggctcctgtggctcaacgggcagccatgccagcacgtatgacaacttgcctgagctgtacccagctgagcctgtaatggttggggctgaggctgaagatgaagatgatgaggagagtgggggcagctatgctcacctagacgacatcctccagcacgtgtgggggctacagcaacgagtagagctgtggtctcgggccatgtacccagacctggggcctggagatgaggaagaggaggaggccacttcatcagtagaaatagccacagttgaggtcaaatgccaagctgaggctctcagccagatggaggttccggcccatggagagtccccagcctgggcccaggctgaagtccagccagcagtcctggctccggctcaggctccagctgaggctgaaccagtggcacaggaagaggctgaggccccggccccagccccggccccggccccagcccaggacagtgagcaggaggcacattcaggcggggaacccacctttgcctctagcctgtctgtggaagaaggacactccatttctgacactgtggcctcctccagcgaacttgacagtagtgggaactccatgaatgaggctgaggctgcggggcccctggctggactccaggcatcaatgccccgtgaacggcgcgattcaggtgttggggcctcacttaccagaccctgcaggtgagagtttgggttgggatggggcggacgcagggtctcctgttctctctctgtctctgaagctgatttctcagtcatgaggcccagggctaagtgcttggcggctgcgttatcccctcacagccagctcaggagagagagtacaggacttgggaatccagaaagttaggtccagaacctgcctgtgctgtggccttgaggaaatgatgctctcctctctgggcctcagtttcctcatctgtaaagtgagggaggatgctagaggagatggtctctggtccccagctttgcccattcagggtttcttggagcagcccctccacagtagtcttgggatgggcaggggtcttcactgcttattggcactagatgggcctgagctctgtgccaccctccccaagaacttcttggcccctaagaagctgagtccaagctttttccaccctggggcctcagcagcagcactagaaagtgttcccagctccctgcattttttctttggggagaaaaaaggggaccacaataacaccttttctaaggtttagccaaacctgctcctctgggcttctccacccctctcaccgccccccaccaggaagctccgttggcatagcttccagaactcccatcgtcccagcctcaactcagagtcgctggagatcaaccggcagtttgcaggccagatcaacctcctgcacaagggctcactgctgcggcttaccgcgttcatggagaagtacactgtgccccacaagcagggctgggtctggtgagtggctcctgggccatggagggtggggaactgctgactcaggtccacgtccccaggcagggtcagcccaggaggtgggtgcaggcaggcagggcccacaggccaggggagcggtgagatatgccaggaggctggaggggcttggtgaggctgggtatggggcagaggacctgaggtcctccagctgtatcttctccatcccaatctctgtgctgcaactagtgagattgtcctaaaatgcagctgtggttgtcactctccagataaacacttttctctggctccccattgtccagattccctcccaccatgactccttcctgttctggtcccgctccatccttctggctctttagcctaccgctcctaagcaaccccaccttacagaccagtgggaccagtcatccttccgtgaacgtgctatgatctttttcctgcctctttgcctttgtttgtgctgtgctctctgcctggaatgcattttccccatttctcctctgggacaatgccttcctatccctcaagagcctgctgagttaccacgtcctctccgaagccttccctaactcactaggtacagttcccctccctcaatgggtcttcccctaagttcttggcctcctactggccacatgagttgttactgcctattgacacagttatctccttggccagactgagagctctctgtgttcctctgtgactccctggggctgggcccaaaacaggtgctcaatgagtgttgactctggggcagtggtgtgtgccttacccccctcaccccacctgatcctctgagactgcaggcagagtctccaaactgtgttccccctatctgatcacttgtcattctcccaaacaggtcaatgcccaagttcatgaggaggaacaagaccccagattaccggggacagcacgtatttggggtgccacccctcatccacgtgcagcgcacgggccagccactgccacagagcattcagcaagccatgcgctacttgcgcagccagtgcctggaccaagtgagccctcgtggggcagcctgccgggagatggtgcaggggtggggtggtggtgggcattgggctgaaggctgaggagctggggagaggaactgctctggccttccccctcacttgggctggtccaccagaggcctttgctgttctcagcaaggaccagcaaggatgaaactcctttctactccttatgcccagctctgtgctaccttctttctggcccaggctctgtagtccttatcttctgggagcctgaatttgcctagatccacctttttctactcatctccacaaaagcatcttttttcttttgtcctgaagctgtaaaaatccttctctttggttttcccatttgtctcctaccctgcccctcaggaggcctgataagctttgaagtctctggggtggcctaggctcctgacacccagtctagggctggcctcacagtctgcctcctactcatgcatgttttcctcactccctccctcccctgcatggagtaggtaggcatcttccgcaagtctggggtcaagtccaggatccagaacctgcgtcaaatgaatgagacctcgcctgacaatgtctgctacgagggccagtcagcctacgacgtggctgacctgctaaagcagtatttccgggacctgcctgagcccatcttcaccagcaagctcaccaccactttcctccagatctaccagcgtgagtcgcccactcctatccccaacaacctgtcccattctcaacctccctgaatcccagaacttgtggaagataaacctggtgcaggcaaatgtagctggacctgtgagctgattggaacagttactatctggagttggaatggcccttgcagagagaccattctgcttccccaaacccattatatggaaaggtagactgaggccctgagggaagaactacataaggttacactgtatgttagtaataaagctagatcaagcacccagagacctcacagaactgacattttcccttccctctcaccgctccccttgggactgctgtgccttttgcccccttggaaacaggaggctggctgctaaggcctctggggaagtaaggaaggctcttcttccattgcttcctcacagtcctccccaaggatcagtggttggcagcagcacaagccgccaccttgctgctccccgatgagaaccgagaggtgctacagaccctgctctacttcttaagtgacattgcctctgccgaggaaaaccagatgacagcaggcaacctggcagtgtgcctggcgccctccatcttccacctcaatgtctctaagaaggatagcccctctcccaggtgaaatggtgcacggcatgtcagggccgggctgggtccagacaatttgggccccactggacttttggcttttgatggctggcactgctgtgtctcagcctcaccacaaggagtgagcctgactcctcaggggccctgggctggtgggatgctgtggagcagggccttccaaaaggcagcaggttgttttgtggccaggtttggcaaagtggcttcctggcagctagaaggcagcctgtctgccatcttgtcttgtgctcttgtgccatctctcctctcaccacctcctgctccatctaggatcaagagcaaacgcagcctcattggcaggccaggccctagggacctgagtgacaacatggcagccacccagggcctgtcgcacatgatcagtgactgcaagaaacttttccaggtgagtaaccccaggccatgacacctacttaccagacctgggggaaccatcaggcctgacctcggtgccccaagtcagggataggacccaatttgacacatacccctcaagcttatacccccaactcttcccccacaatgtttctcatctaccttgctgtggtagctgcacctctccactgcccttaacgtgaacctgacagaccccatggggtctcctgctctctggagctgcagcccattgtgtgtgtgccctctcaggtgccccaggacatggtgctgcagctgtgcagctcctacagcgcagctgagctcagccctcccggcccagccctggctgagctgcgtcaggcccaagctgcaggggtaagcctgagcctctacatggaagagaatatccaggacctgctgcgtgatgctgctgagcgcttcaagggctggatgagcgtgccagggccccagcacacggagctggcttgcaggaaggtgagtgccacaccacgggtggctgctatggggctgggagagcatggtgcaggcaagggtagtcagagaacccaaaggaaggagccggggaggagctgccgcctgagtctcgctgtgcctcggcctggtccttggagaatgtcagagagtcaagaaagtaccttaaggaatcaagaaccaaatgagaccaagggaactctctcaggaaccacctgccagaatgaccttccaaaagccccgttccagatacgatgctgctttgatagcctcaactcccatctctccctgccccgcagtccagctgaatccttgcatttgcacctttgtgcggtcctgctgcctggactgccctgaccccaagcattacgtctcccgagtcacctttagcgacaacggaatgtgttcctcctccattcagaaccttctgtcatgccccaggatggaggggatttctctctgttcccctctgggcactggtcatgctctttcttggacgtggattctgagtaagattgcaagcctgaagtgtcctgtgtaaaaaaatggtcataacaaaaccttccatgtaggatcagggtgagtgtgaatgcctggtacatactaaaggttctgtaagtggcagcttttgttgtgcatgtgttttactgcctgtgctagatggcaagctccttgacaatcaccatcttcctgcacctccaagcactgtgcccatcatggtagggcctgagaggcctctgagaatgtgtgccccgtcatctctttatgctgtctaacagactgaaaagcagacatccagaaaagagagagagagggcagggagcatgggagcactgtctcagtctggccagcgctagcagaggagctctgcagcctaccctattaagcctcaggccctgcagtttgaggcctggacttagggctggagtcagagttctccagccctgacagctgcccccatccccactcctgtggctcacaggcaccggatgggcaccccctgcggctatggaaggcatccacagaggtggcagcccccccagctgtggtgctgcatcgtgttctccgggagcgggccctctgggatgaggatctgctgcgggcccaggtgctggaagccctgatgccgggtgtggagctgtaccactatgtcaccgacagcatggcaccccatccctgccgcgactttgtggtgcttcggtgaggggctgcagctgctacccttctgtgcttggggggccggagaagtggggtggaaaccagcactaggaatctgagcctacgtgtcccttctccaataggatgtggcgctctgacctgcctcgtgggggttgcctgcttgtctcccagtccctggatccggaacaacctgtgccagagtcgggtgtgcgagccctcatgctcacatcccagtacctcatggagccttgcggcttgggccgctctcggctcacacacatctgccgggctgacctcaggtatcaggcctgggacagcctgctcgacccccttggccttgaccccctcccctgcctctgcccctactttctgccccatgctattgatccctggggctggggacaagtcctttcttccttctccctggtgagggctctggggaaaaatccattgctcatgcctggtttcttctgcttccctaggggccgttctcctgactggtacaacaaagtctttggacacctgtgtgccatggaagtggcaaagatccgggactccttccccaccctgcaggcagcgggccctgagacaaagctgtgagccttgggctggtcccagggtggcaccacccaggccccctgggcaccaagggagcgagggggaataagagcagggcagccccctgggtgccgctgtcaggagcagagccaggcccaggtggctccagctgcctgtcctgtcccctttcctaaagctcctctgcacatagaggggagaaaaagagaatttaggcaactccactcccccttcacccccaaccctgtattctactctcccgaaaagagaagagaatcgcatgagtagcaagactgctgccaccagccacctgcttgtgaggccgccacttggcatgaagcctccacagctccccgcctgcaggggcaaagaggtcgacagcaatgtgtgatcccagctctctgccagactgagagggcaagccgtcttgtttgctgcaaggatgcttttgaggttggacaggaggttctggtcctgcctttggggccaacgctggctctgaagtgtctttttcagaggaattggactggagtgaatgggcacaggggtggagcgcagggcagccccagtcaccacgagctgtttcatttgtgtaaatacgatgctgaattttatgaggctgagttaagagtgggcactgacgggcccctaatatgtgacatgacgatttggcatagatagggatgtgagagtggagtaccttcctttctcaagtctcgagatgccagtgaaaccagtattccctgacttgggtttcacactttatcgaccaccccatggggtcctgtgtagcctttggccacgcactgacactgcccaggccaagcaaaagcagagtgtggttaagagacaagggtctatgtcatcatcccttttgcttatggtagtgggctaacataacagcccctttctcaagcagagacctggcccctgggccagccagatggaagggcctatcttagccagctggagcttaagccaaacctgttctgtcccactggccagccatctttgctcacatggaaattcaaatgccattcaaaggccactggtgctttatttttctatctgctgagtaaactgaaatgagatgggtcccaaccaccactgtaattttcaagcctattttatttgtacctgtaaatactgtacagctaatatatatatatatatatatatatgtgtgtgtgtgtgtgtgtgtatatgtgtttatagagatacacacacatatatatgtgtgtatatatatacacatacatatatatacacacacgcatttgcacagacacacacatatatcaattctcatgagtgtattataatctctggtgggggcaagtgtctggaaggcctgaggggcacttcagatgagaatggagaggtagggagccaggtgcagcaggatccctcaaatcaataaagcattaccagagatgcactttaa

SEQ ID NO: 4667 - DNA, 78171 bp, human
gccttccaggaggcgggaggcgcccgctgtcgaggcagctgagccccggcaaccgctgctctccgcctctcccctcgcggggccggctcatggagcgcagggaccgggctggctctcgccgagccccgggcctcttttagcctcgtccccagagagggaggagccggtgcccggcacagccccgccggccctagaagctccccacgcgccaccatgcctctgctggacgttttctggtcttgcttcaggaaggtgaaggtaagtgactggccagccccagcccatcccgctgctcaggggggaaggaggcagatgtggaccactgcgcaccagctgggaaaacggaccagacgggcttctgagactacctgaggctctcggagttagaaaggcttgggttcaagtctcacctttgtcacttaaccagttctgtgaccttctgttgcattcccatacaaacaagtctgctagttggctctttttaataaaactcgcctctgttgcttcctggatcttgccacaaaggcaagatacttaacctctctgaacctcagtttcctctcagctttagaatgaggaccatagtaacaccaaccttacggggtgatgaggttggtgttattgtttacatagcaaatgtatgcaaatccaggagataatgtgtgtaagcttcctagcaggatgcctggtgtggagcatccacacaaacaatggtatctattattattattattattaatttctatccatatatataaaagcacatactctgtgctaggcaccactggagctacacaaagacaaaaaagggctggacacagtggctcacgtctgtaatcccagcattctgggaggccgaggtgggaggatcacttgaggccaggggttcaagaccagcttaggcaacataaggagacccccatctccattttttaaaagaagacaaagaaggacatggcttttgtcctcaaagagaatataagaaaagtgacaaatatttaccaggcacctactatatgccagacattgtgctaaatagtcagtttgtcagtaaatatttgttgagtgtctactatatcctggccatgggggatacatgagcacagccgaacccacaagtgtgtgtaaagcatgattccactctcaagaaccaagaaactaatatttatttagtatccactatgtaccagacctaggcacttttaattcattcatgtggcagtgatcctcagcacaacccattgttttcctgcttttatagatagggaaaagacactgtgaatagttaagaaatatttacaaggttgctcagatatgactggcagagctgggatctgagctcctaagtccatgcctttcttgacgctgtgtggtttcccacagtccaacccagtaggaagactttcaaacgactagcctgactgtaagacaggatgaaagaatgctgggacctttgggaaggaaagatccattccaccgggagggacttggagaggtttcacaggaggtcacatttgggctgagcctgaggcttaaaggaagagaagagtttgtcagtccaaaagtgggggaagggcattccaggcatgcctggcagagggaacttcgtgagctagagtttggaggcagtcaaatggtagtgggctgggggaaaggcttctttcgtgatgtggctcaaatgtagggttagagaggataggagcttgagaaagggaagcagagactacttcccaaagggtttggaattaatctgtggattcatggtcctcatctagtaggggtcctgaatgagatttttcaaccatctgtggtggaatgagagaaaagtagggataatgtcgtgcagtgttcataaaactaaattaattcaactcaaaggactattctttatttggagactgttgtgtccttcctgtgggggtggggattcaaatgatctttctcctacaaaatatgagtgagaaattttttaaatgtctgccctcagcaaaattacaaagtttgcgacatgctgattgtttccctatttatttatttaagaacactttcctcatccatgaaatctgaaagtctggtgactactgttttggggaataaggggctgatttcagcataatagggatataattaagtggacggttttagaaaaagcactccagcagtagtgggcagggatggtgtggaagggcccaagtggagatgcagaggccaggaaggaggcagctgcagtggaaataaggatgggagaggaagaaatgatagagagctggatggaatgataatgacgagggaagggaaaattaaagtgcctttgaggtttgacgcccgagaggcacctctgtcccctaccccagttaactgttctaggtgcttggcatggatttaaatctctttgcactcattaccccaacttctcagatgcccagaaaacatgtcctaacccctgtcagcctcttggaaactgttgggctaggttaagagcagtggctcatgcctataattctagcattttgggaggccaatgcgagaggattgattgaggccaggagttccagaccagcctgggcaataatgagaccctttatgaaaaataaaaaaaatttgctgggcacggtgatgcataatggacacctatagtcccagttacttaggagactgaattgggaggattgcttgagcccaggagttcaaggctgcagtgtgctatgattgcaccactacactccagcctggactacagagcaagatcctatagaagaagaagaaggaggaggaggaggaggaggaagaggaggaggggaggaggaggaggggaggaggaggaggaggaggaggaggaggaggaatagtaattataggtatggtgtcacgcctgtaatcccagcactttgggatgccgaggcaggtggatcacttgagtccaggaaatcaagaccagcctgggcagcatagtaagactgtgtctctagaaaaaaaaatttaaaattagtcaggcatggtgatgcatgcctgttttctcagctacttgtggggctgaggcaggaggatggctgcagtgagtcatgatcgcaccactgcactccaacctggccatcagactaaggctatgtctcaaacaaaacaaaacaaaacaaaacaaaacaaaacaaaacaaaacaaaacaaaacaaaactggtgggctaggacagccccaagagaaggttgaggatctctatcatgggtcccagacgtttgcacgcattcacttatgagtgtgtccacagaggacatacacgtgcatttgtgcatattcaaccccacacacatatgcacaggcacaccattcaagtgtgcatacacacatacatagagacgaacacacatataccctggcacaaacaggcaaatgcacatgtacacacagacagtgcacattcctagcatgatgtagactcacacacatatgcatgcatgcatatacagaggtaagcacacaggcacatcagatacataccctcctatgcacaagcatgagggacacacagagacacagccaggcacatctccaaaaagcctgtagacatacaaaagcatgcacacggcgtgaaggtccacgtgcatgcacatgcatatgcacaggtctgtggttgctcatgtccttggcagatgtgaatcaacacatggctggatctcagggctaagaggcagcctgccggatccacacacttggactgcgtgctcccttttccaatgctgctgctttgaggccccagtcagaaaggcaggctctctgggctcgggagctcagtcaagggcacgggctgctgtgagccaccctccctctctgagccaggccccctgagtgcgggagactgaggggtttgaggggtggggaatggccgggacagatcctgtcagagctgaaagggccctctcagatcatcttattcaaacttctcatggtcctgatagggaaaccgagccccttccctcccccaccatatggagcccttcatcagctgaagaggtatgaggaggggtgaagcacacaaacttgggtttcaattccaccccacacccacaggcacacatactagctgtgtgccttcgagcaagtcttctccgagcctcaatttccttgtttgcagaatgacactaatcagtgcccgcctcacagaaatgccacgaacatttggtgggtgggttaagtcttttttttttttttttgaccgagtctcgctctgttgcccaggctggagtgcagtgtctgctcattgcaacctccacctcccgggttcaagcgattctcctgcctcagcctcccgagtagctggaattacaggcgcccgccaccacgcccagctaatttttttttttttttgtatttttagtagagacagggtttcaccgtgttggccaggctggtctcgagctcctaaccctaagtgatcagcccgccttggcttcccaaagtgcgggaattacaggcgtaagtcaccacgctcggcaaggctgtgtctttaaagtgcctgacatggagtaggtggtcaatacacatgatttgttggaagcagcttccgaaactgtgtactagaggcaccacagcaaagaatgagggttattctatatttgaaaattccagggttagggtctcaggtccagtctgctcctttgccacaactcctcagccctctactttgactatgcctgggtctaggaatagaagtgatccatttgggagatgaaggctgacaccccagaagccagggatggtgggaaggtggcaaaaggccaggccagggctcaggattgctttgagctgctcttgtgttaggggcagccaagggacaagacgtttaagtgtgagatgaacccagtataaatagtccaatacgtgtttgctgtgtcttcccctggaggccagtcagggcccggaaggcatccatggccccttggtacaacgaagcatgcatgagtcagtttctcacccgctcccccgcaacacacagccacacaccccacactccacacacatgaaacacacaccacacacacaccacaaacacatcacaccatacacacaccacacaccacacacatacaccacactcccccacacacacaccccacacaccacacacacacacaccacacaccacacacacaccccacacaccccacaccccacacacacccccacacaccacaccacacacacacacacccacaccccacacacacacaccacaccacacacaccacaccacacacacacatcacacacaccacacacacacaccacaccacacacacacaccacacaccacacaccacacacacaccacacaccacacacacaccaccacacacacacaccccacacaccacacacacacatcacacaccacacacaccacacaccacacacacaccacaccacacaccacacacaccacacacacacaccacacaccacacacacaccacacaccacacacaccacaccaaacacacacaccacacacacacaacacagcacacacacatcacacacacaccacaccacacaacatacacaccacaccacacacacacaccacacatacaccacacacaccacacaccacaccacacacacaccacacaccacacacacaccacaccacacaccacacacacacaccccacacaccacacacaccccacacacacccccaaacgcacaccacaccacacacacacaccccacacacaccacacacaccacaccacacacaccacacaccacacatacacctcacaccacacacacacaccccacaccccacacacacaccccacacccctcacacacaccatacacaccacacacaccacacacaccacagcacacacacaccacagcacacatacaccacacacacaccacacacacaccacaccacacaagcacacacaccccaccacacacacacacaccccacacaccacacacacaccatacacgccacatacaccccccaacacaccacaccacacacacaccacaccacacatacaccacacacaccacaccacacacacacaccacacgccacacacacacacaccccacacatcacacataccacaaacacacacaccacatacacacacacacaccacatacatacagaaccatttctttgatgtattcttttgcccccttccagcacttagcatggtgttatgcacataaggggtgcccggaacacaaatcctccctcatgttactccgcttcaggtgggcatatcaggtcctagagggcactggcttgggaggtgggaaatctgcctggagcgccatctcaaccatgacctctggatgaccttgagagggtcaattctctctcctgtccctcagttccctcctcttataggtagataatcatgcaatatcagagatgaaaaggcccttggaggtcatctattcctctttctctgttcctctctccaaactaccagtgaggaaactgaggcccagagaggggagagatgtggccaaggtctcagagggcatcaggacacagcggattccaatgtggtctgtgtaatacaccataatctccctactcgttctgtggcaaaatccaaacacaacttgtctctggtaaaatctaaaagcagtactgggggaatgtctctacacatgccacacacacacatgcatacatgcacgtatgtgttaacaaccctgccgtacctacccacaaggcttctatgggagttaaagcaaatcatggacagacagtcgtgtggactgggaaggctcatagaggtgaacctcccagtcgtgggccaacatgggatcccatgcttttcactaggcaccatactcacatacttaggtcatgcacatgagtgtgtatgtgcacaagggctttcctgagctcgcccaggcacacattctcaagcaccatctcctgtgaatgctctcatccaagtatgcatgagacttccatgtggctgctcttatacatggcttcccaggcacctgttcatatgggtgtgaggtttcacaccccctgtgcaggctcacattcatgcacacacacacacacactcgcaagtgaggtgagcatgcatcctccttatgtgtgcttgcccataccccagcccctctctgcccccaggccagctctcagcttcccaatctgcctaggagcagcctggcaggatatggggtgaacgtgtgacgatgatagggtgattcagcaatttcactcccagcctccaggatgtctctcctttttcattcctttgcccttgtcatcccaagtaagtccaatttgccacatgcagtgtgtatttgttgtggaaggggcagggggagtatagagaattcaggggttcacatgaatgtatacaaactcctggggctggaaagggacctcagagactcctcgatgccatcactacagagttgcctctatcacatcttaccaaaagaatggccagacacttgcacacctccagtgatgtggagctcaccgcttcctcaggacactattgcagatcccttcgtcagtctgatgtgtgtgtgtgtgtgtctgtctgtctgtgagtggaagtactaatgtacatgtgcacatatgagacagtatatacagccagccacgtcttaattacttgttccaaagaaataaattatgacataagactctcaggtcatggtaaaaccacgtagagggggaaaggcaagggcctatactccatagaaggaaggttcactcgcagggccctttctgcagagttccacagcccactcaaataacctgtcagctgggtgataggtattggccccctatatgtgtgaaaaattcagaccgtggattgtccctgacatggttaattgtaagatgcctagatgctggacatatgctgtgtaactttgaggcacaggcccatgggctagagcaaaataataagttgtggtaaggttattggcatagatggagctcaagagagttgtgaggtggcttctgggtgatctaggaagctttctgggaccagtttttgggaccagagtagaaggcagcttagtgttgccaaaggagcactggacacagagtgagactgacctggatattacgtccacctctgccacatctaggctgagtgctcctgggcctgtcacctctcctcagtggataagacttaatggagttgccagcgagatgatgtctgtaaaagcctgttacaaggtagatgctccattgaatctgaatctgaagggatgatctttggaagaaaagggcaaggagtgttttcaaggcagagtgaggttggagacatgtgagggaagagtcatagatccaagggacttgtcctgagtggaggtgttgggaatgaatggaaatgggaagaggaggaagaacaagagactttgaaatttgtctgtgggagtttgaacttcatgttcttgatgcagtgaaaagaccaaaacatctacatggagtcaagcccttcacctatctgagccacaacttgctagctgtgttgaccatgagaaagttacttcgcctttctcaaaagaagacatttatgccgccaaaagacacatgaaaaaatgctcatcatcactggccatcagagaaatgcaaatcaaaaccacagtgagataccatctcacaccagttagaatggcgatcattaaaaagtcaggaaacaacatcaggagagggtgtggagaaataggatcacttttacactgttggtgggactgtaaactagttcagccattgtggaagacagtgtggcgattcctcaaggatctagaagtagaaataccatttgacccagccatcccattactgggtatatacccaaaagattataaatcatgctgctaataaagacacatgcacgcatatgtttattgtggcactattcacaatagcaaagacttggaaccaacccaaatgtccatcaatgatagactggattaagacaatgtggcacctatacacaccatggaatactatgcagccataaaaaaggatgagttcgtgtcctttgtagggacatggatgaagatggaaaccatcattctcagcaaactatctcaaggacaaaaaaccaaacaccgcatgttctcactcatgggtgggaattgaacaatgagaacacctggacacaggaaggggaacatcacagaccggggcctgttgtggggtggaggaggggggagggatagcattaggagatatacctaatgtaaatgatgagttaatgggtgcagcacaccaacatggcacatgtatacatatgtaacaaacctgcacattgtgcacatgtaccctagaacttaaaagtataattaaaaaagaaaaaaagttacttcgcctttctgagccttagtttcttgctccaaaaaatgtagataatagtacccaacttacatggttattatgaagctcaaatgagttaatatgtataaagctcttagaaaaggggcacatagtaagcattgctcatctttattatttgtacactggggagaatgataactcctaccttatagggctgtagtaaggatcaaatgagaatgatcccaaagcctgttgagatgtttatttgttgttatcttggacaaaatgtgtgtgtgtgggggagtttccttaggctgagaatagccttaagtaattcattctttcactagttcaaccaagcaatatttattcagggcctactatgtgccagacactgtgttaggtcttgaggagataggtaatggtgagcaaaactgctgtaggtcctcatctcatgcagcttactgtctagtggatacaaaatgagtttttcacactcaacccccaagtgccctattggtgggcacgattgatttagtccagaaaatttcagtatatgaaactgttcaatgcgttaacagttttagttaatctagaacctgtgattggccatcccacctagtccttaaggcaaagggatagccatgctgaagtgtgagtaattcctgcaacagcaaagtctggaacaatcttaggctcagcctggaaatggggatggggacccctctgccaaatttgcctgatccgaagctcctaacccttgccccatcagcacaactggtgtgatttactcgagtcatgtgagattggataatatttgttctcgggggtggaagagatggggacgagcattgggaaggtgagatggggagtaggaagcaaggcttcaactctgacttaagtctcttcagatacagattcttactttgcttttagcttctttgatgccaaaaggtgtacaagtgggaggtcccggcggggtggaggatatacttcctatggctatggtggaggttgggggaggcaaaaatgagttggaagaggctgcagattggcaataccagacttctcttttacccctaaagactagagaaagttagaactaatactagctaatatttgcacttgatcttagccaagaggtcaggaagtgatactagctaatatttgtagagcacatactatgtggtgtacactgttcgaaaccctccacatatattaactcatttcaccatcacaataatcctgcaaggcaagctatcattgtcatcatcctcattttactgaaacacagaaaggtttagaaatttatccaagattacacagctattaagtggtgaattggggatttttaacccaggtaatctagtttcaaagtccactatgttcatgtaatctgtgctgcatttctccacctataaaatgaggaggctggattggtttatctctgagtctttccagctctgacagtctcattatatttcacatatacttctatgaacttccaggccaaatgaaaaaaaaatgctgctcccaaatgtcagtgatttccactaaagtccctcgggaggagagtggggagcccaggctcagggaaaagagccgacactggagcttggtcttcccagcagcctctagggcctgagaacagctggggacctgggaagctctgggagccagggcccggcctgcatttccaagtcacttgtaacaataacaaggagcagcagctcaggcagcctctgctgggatttggggtcagaggtttcacagtgggtggaggaacagacctcctcaactccatccctctgggcagcccttgagctgttgctgctgctgctgtcagggcccttagagtccaggtcaatcagcagttccaaggctgaggctgccaaggggcaggggaaaggaagtcctgcacttggggaatgggagttgaggccctggaaatggatgcaggctgactttccctggccctttcctctaccttgggttggttgccttctgggagctggagagaagaatgtagtatgaagatataatgtcatagatggaaataggacactgatctaacagccctggttctgcctcctcttctcttctctaagcctcagtttccttacctacaacatgaggagaatattccccacttcataattgattgtgatgatgacctatgtgaaaaggcctgccacacaatgggtgctcagtaaatatgagttgaatgtaaagatagttgattgattgctctaggtgaccctgggcccatagcttggactctgttttttcatctataaaatgaggaaacatttttacctgccattcccttcattccctggctgaggagagcctagaattggggacatcctgtggaagtgaaaggacagtagaaaacacagatgcgactaccctcagggtcaggaagtgggttgtttaagcaatttcctcattccttctattcccgcccctgctcccacccctggtcagactagtttagagtctggaaaagaagctccatcccacactggaatccccgtgtctctctcctccagccccttcctacactcacccttatagggcgcctctcccggaaagactctgcagttctgggcaggaaggagggtccctgttgactggtgagaaagtcaagtctttgggatattacattcctgagattatccagagaacccctgggggttgcagctgctgctgactctcctccctggccctactcttggcctgctgtggacatgaggactgtagggcccaaggcaggagaaagattgggggaaaggctcaaaggcaaagagtcaggcctggagcagccctgcaggccaggtgaggagtcaggatggggcaggaggaaaggatgtcctggcagcactggcaggaaggaattaaggggaaaagcgtccgagggagtaggaatttttgccaaggggagacttataaaaccatcagcattccttaggctataggttgggggcccttttcgggggtggatgagtaggtattagatcacagtcatcctggtggatagagatggaaagtcaggctttctgagaggccttctgtgaggcccacatactccaagccagtgtgggacagcttgcacccttggggggagacagaggggaggtaggtgttctgggggttcctcaggaggctgtcccagattctgagttctataaaagccttctagaatttattgcttccattgctctttcccagctgggattgttcctcatcctctcctttgtgatagaagactaagaattgtcaggcacctacctctcatttggtaacaagtctgaagcccagcaaagaattggtcaaaggtacagggtcaagcgcagaatgtgtcagtcagtccttcttgaaaccagctctcctctgcccttttcagggacaagattggcatcctccagggctgtagcaccccatccccagcagacatcacatcccgaacatgagcatatgtctccaggtcattgacatggggtttaaaagtggcaccgtgacaccagtgctccaacttaggacctggtggcaggctcaattgagcttcagcccacataccatcctccatctctactcagctgtctctgaactgtgagctgctctaagaaaccagcctgtgtctaattgacccctgtgtcctgcgacaacctggctcaaaacagcccctattctaggcctagcctagagaaagtttgccaagtgcatagaacacacatggactcccatgtacgtacaagtggccaaagccactgcacccaccttccagctgagagaccccaagacagaggagtcagctccagagggctcatgagagcctgctttccacagtggccatggtctgtgctggcaaaactcaggataggcctgggggcggtgagagcccactctggaagaagggagggccaagctgtgaatagggctctgtgtggcccggctgagaaggctgggggaggctggaatgtgaagaacgtgctctcatgactgtggtcctaggcctgggtctatggcacaggactggctaggagtgaggggtggggatgttggaggtggttagagaaggaagggagaggtggggcagagaaaccaggcaaggcaaggaaaaaaagtctctccagacatctcctcagataccagggcaagggctggtcctagagcctggaggctgagcgaagaggatgctggggagagtgagctccatcccagccacttgtggctgaggatggcccggttctggacaaagcttgtccatagcctttgcagcttgtctccaaactacacctctcagacctccctacttctcacccagcaaccatcgttctgtttttatcctccttttggctctggctttcgcatttgcactctttcaacgtgtttcccttttctctgaaaaaactcatgatctgccttttatttttgcctggcaactgtatctcccactagactgagagctcctccagggcaggaatcacatctgcttttgttcatgtttgcatctgcaggtctaccccagtgcctagtggactgctcagagcagatgctccacagacttttttgaattcaacaggtctaaggggaaattcattacaacaggaagatttccccccgtatacccccaaataactttttcctctgttcctgacttcagttaatagcaccaccatccacccagttgccaggccagaaacattggggtcatccttgactcctcgcttatcttcccacatcctatcatttactttggttctaccatgtaaattgtctatatattggtccccttcttcctaccctaaggaccactgcccaacccagaaccttaccactaactctggtctccctttgtttttccttctttctttcttttccttccttccttccttccttccttccttccttccttccttccttccttccctccctccctccttcctctctctctctctctctctctctctctttctttctttctttctttctttctttctttctttctttctttctttctttctttttggagtttcgctcttgttgcccaggctggagtgccatggcgtgatctcagctcactgcaacctccgcctcccaggttcaagtgattctcctgcctcagcctcctgagtagctgggattgtaggcatgtgccaccacgcccagctaattttttgtatttttagtagagacagggtttttctatgttggtcaggctggtctcgaactcccgacctcaggggatccacccgccttggactcccaaagtgctgggaggccactgtgccgggcctctggtctccccttctctagttttgcctaggccccccattcccaatccatccttcactcaacagttagagtaacattccgaaacataaatctgactacgttacctctctgtttaggccccctcaatggctctccattgggctctagataaagtctcaagttcttaagatgacctataaggcccttcgtgatctggcccctaacctgctgcttcagattcatttcccactctctgtctggcactctgctctccagctagaccaaggtcctaaatgtgacagttctgggaaatgagatgaacagacgggtgggacaaaccacaggctttgatacatcctcatccttttctattctctcccttctacctgccaggctctttgcccccttgtcttcttgatgaacaactgcttagctttcaagacctgttctaaacactacttccttcatgagggtccttatgacaatgtgcccccactcccagcaacaaattactccctctgctcagttccacaaggctttatactttccaatagcactcacattgaattgtgatgatttgtgcatgtaatcgactccccctctgagctgagagttcatcaagggcagggaatatgtctgatctatatgaatccctgagtacctagcacaggacttagctctgaggaggtacctaatgaatgagtgaataaataaaggaatatatgaatgaatgacccactggatgagaagattgtcaccactaatcctggtcttcttctagagtggctgtctttataacttttggattcttggcctctgggttcagaacctccaaatcagagggatatgttctacaacaaggaaacaaaaagggccttcactttgtagcagaaatctttgatgcaaaagttcatatgctatcttcccctgtaagtctttcagctaccaaaatagcatcaagattaaggtcaaaagcagagtgggactcatgggcctgatccaatccaggttattctggacctcagagagaaaaaaatagagtgccataaaattgggagccctattgatctcaagcacagacttggttctgacatttaccttgaccttgagcaaatcatttcacttctgtgccccatttgccttatgtgtcacatgaagataataaaatctaccatgcaagatggttgtaatggccaaagaaggtcactcatttgcaacctataaatccctaaatttaaggcctacttatctcctgaactatctgtaattctgttaaaactatgatgggttaggctggtggagtgggggagtaggagatttaataggactagagcatagagtacagtctgtcccacccatcagttcatctcttaatttccaagaactgtcacatttaagacctcacaggggcctgctttgtccttctcttctactctctcatcctttctcattcttctttcctccccctttgtctacactgagaattatattgacttgcttaatcatagttccactttgtagctttgtagcaaactttcatatctgtcgctattggtctttctcctctggtcacgccgatctcattctagaactttttatctccttcacactaacatccctcaagggtcctgccagtgaacactcgggaggacatcccccatccctcctctctcctgtggccaattgtgggctacgagggtggatcagacctttagtcattttagggtaatctaaggctgagacaaatcttttaggattaggaagcattgtggtcaagtgtctgcacctggtatggcagtcattgtgcagagggtaagagatagacacatactatggcaactattttcctgataaccacttggttggtttagaggctggctgtgtgaaaggagaacaggcaagaagacccttctacctctaagaggtacccttctttccttccttctttcttttctctcctccttaactattgaatgaatgtctctacaactaccattttagcccaagccactgacattgtttgcctgaactactgcaaaagcctcctaacagatctccccacttccaccctggctctacaatccacttcctacccagcagccagagtgaccttttgaaggtagaaatcagatcttgtcattctcctgctctatatccaccaatggctgcctactgtaatttgaatcaaagtccaaatccttaccctggccttagcctctcataatttggccttcgtttctctcttcaccatccgcctgaaatgctcttcacctagctcttcacattgctgacaacttcttgccatctgggtctctgctcaaagttcagctctttagagagacccctcaggccacctctctatccccccactcaatcactctctacctcatcctgtctttaaaagtttctccttcttggttcttagtgatgactgaaatttccttatttctttgtttacttatttattgtttgtctcttcctactaagagttcagctgcgtaaggatctcatctgtctagatcactgctatatccttagcatctagcatagtgctctgaagggcactggtattgtataaatatttgttgaatgcatgaatttatagagtgcttaatcattttaaaaagtgcctttatgtacgttaatttgtcacaaagcctgtgaagtcgggattattgctttcctagtcttatgaatgcagatgctgaggctaaagaggttatgagtgatgttcaatgtcacataatcagtaagcaggggaaggtgaccctgaacttgggttctccaattctgaatactgcccttgccaccaacacatcctgtttctagccttgttgatgctataccaaggatggtatgtgccaagcaaatgttgacttattctttaataatctttcttatcaggcctcggaacagtactgtgagctgtggcagagtgtctccaatcccctgacctgggggccttctccattcagggagagtgaagtgaaccagcaggatcagccatggggtagcagaaagtacagttgtatggagtgggcagccaggagtctgggtctgggctccactttgctccttacttcattttccttttctttggacctccatgtgtctttctgtaaaatgggtaatgggtagatcgaacttgctaactttaagatcgctttcagttcagatattgcatctctgcaatgccttgacttcttctctgtttcttttgcagtgcttcccattgctgcaggtgaagaagaacgctggtaagtacacgaggtgggcattgcaagtggcatacaaagagactgagcttctcagtagtcctcatggggcaaccgatcaggtccctgggcagcagagccaacggccgagatgcaaaagccggagacatcctctctgtctccctccactgggcatttgctgtcctcctcgggccctgctttttggctcacgtgcagagcctctttatttctcagccggaggttttgctcttgtcagagagccaggggaggacttccctccagagctttcagcaagtggcagccacccatatacttcccttgttctcaaatgccttctttccactgggaagtgtattaggggtgagagatgcctcaggagagaaaacaggtaagtggagggtaaaggaaggagacttggaatttggggttcagtgtctgttatattcccagcacttgctttatctagaaggcttccaacaggaggtaggctttggagttcattagactgaggtgatatatatagccttttccttttgctctctcacaagtttctgtgagcccaacttcccatcttcctggtgcctctggtgtcctacttgggtgtggataagtggatggcatactgggagcaactaccttccattgagaaggatacagttgtctagagagggataacagctttgtggaggaagagaaagaaggctactggccagggaagagtttggtgctggagcctgaactcctggtatcagctgggctttgctaaggtcatcgaggccatcgtcctggctctagcctgacttcagccattcccattggctccaatttttcatcaggatgagctcatgacttgaatgagcatagcttctaggagacagttaggattggggttgccaaaacagaaaggcatctattaacaagtggcatgctaagggcctgtgcaaggcatcttgggaagacgttggaagagacaaccagaacccttactaataagaaccttccaaagtagttggagctggtttgggcgaatcacgccaggatgcagagagaggattctagtgacttcccaaggacgtttccatcttacggctctgagtttttgggtggtggctgctacaaaacaagaactgataggtgaggggtttatttgcattgccatgacagcagagaagagaggatttattttgaaacaggaacactgctttgatcagcatacagcatacatctgcttctccacttccccaccctgcctttccccgtcatcatcattccaaggcgtcttgctgcgcagtttctgctttgcaacagagacttctgagggcacaaggtctgtgcactgcccatactaggggaaggacacacttctccatttcagagacaccagcttcaaaggctaaaagaaacccctcaggccctgaaatagtgacccccttagatgaatgcacccacagctgccaagttacttctttagaatatctgtgccaggcagaggtgccagcactgagctctgggagggtggcttccagaggagccaggactatcttttactgggtagggtcaggcagaggaggttgccacctacaaagctgagatgggactggtctttctgctatttcttaggttaaagtttgaaaatgtctatttaaaggcaaatgggaacacattgtttcaggctgattcaaaaacaatctgacataaattatgagtttatgtggatgtggaaatggtagcagcaaggcactgggaatcaaagcacctggattttagcccaaatttcattatagattcactgtgtgagcccaggaaagtagcttcctctgtctgggctggcatctacatctacaaaatggagcttattgcatgggactcttgtatggatcacaatagacagcgcattaaaaatgtcaaagtactgaacaaatgtgattgtttctgaaatttaggtcagggggtgagcagaacgcttcatctgttttattacgtattatttgagaaataggtaataccttcacaggtttcaaaattcaagaggtacaaaaatacaaagtctcttctcaccccaagtccccaaccacccagcagtcctcttagaggtgatcagtgttagcagcttcttggccctcgatgagtttagaaggtctgaatcaagtgagctgtgctagatgggactgcgatgggggctggcactgcctgactggcctgggggtggggctgaggggagctgcagaaagggtcatggagcaggaatctcggggcaggaaatatggggtggtagaatcagcattcttttgggacccagtcttgactgtgccactcgtggtggaatgataacaagtaagaggcttcccctctccgaacctcaatgttctcatctgtacattgagcctgccccattctcctaagccatttctcccaagtgtgaccagagcagaacagaagtggtagaggagaggaccagccagggactttttagtgacaaaaaagccaaaatactgactctgggctgacagttgtatataataatttccctctttctctctctttcttttctttctttctttctttctttctttctttctttctttctttctttctttctttctgtctttctttctttctttctctttcttttctttctttcttctttctccttctctttctccttccttcctacctacccttccttccttccttccctcctccttcttctttctcttttttctcctctttctttctttctttctttctttctttctttctttctctttctttctttctttctttctttcttctttttttctttccttccttccttccttcctttttttttctatgagacacggtctctgtcactcaggctgaagcgcagtggtgcagcatagctcactgcggccttaatcttctgggcttaagggatcctctcacttcagcctccttcctcaatagctgggactacaggggtgcatcgccacgcccagctcatcttccttctattaggatgaatcaagcaaagatttatctgacacatcattgcttttgttctagtggtcccactgacagaggaaaccttgtaagggctgtcacaggatcacttggtaccaccttataggagagcattaggaatgtccaactggcttcaacacatgtggtgctgcccaggcccaaaagaatgacctgaattacctttgaagtccctgctatcacagtccaagaagccactagcacagtgtttcccaaatgtcacttatttgtgaaccaacttcagaatttttgccatcacatcatccatgccattaagtacttaatatttttctttaaatcaacctgattttaaataataacctcaccctaagccataatatctatgaaattaggttttgaggcactagttacatttttcctaatatgtagtaaattaaatatatatcatgatgcagatgccaatgtaccaccccaaatcatcctatgccaacatatatatcaaacactgagaaacacagagctagcggtagtaaaaccagcagctcaggaggaggttcaggccttagggactcactccaagacatgctacatgctctcaggctcccagcatcacttcatatttcttccagacccacacaccctgttgcttgagcacaaattgctcctaagatggaaaggtcctggagcctaaaaggaacccgcttcctccaaataaaacccacaattcaaaactgcctcttaagtgctgaagtgagaatacttgattggggccggaagctccaggttccagttttggctgtgacctttgccagctgtgtgtccttgggcctctcgctttccctctctgggccttagtgtctctaactataaaatgaatagcttgctttaaatgacctctaaggtatcttgctgttctgaaattcaatgactccttgacttacaaaccccacactccgcggagctcattagctcgcttaccagcagcccacagaggtgaggaggctgctgaccttccctcccaccgcctttgcaccaaatcttccccaaggccccctgctcccagtgcacaaagctccttttgttgcctggagccattcggggcttcactccaggctcctgctgaagtggctgaggtggcctggtggggtaatagtttgcctgtaacaagagcccctgctcgcaacccaactggctccagtctggctgcaggcttggcctcagcatcagactcatccatcagctgccccagacccctcccccaagctctgagggggcggggagacagatttgaacagtagaaaatggaaacaaatacatttatttaacatgctattgggtgtctgtcacctccaaggctcacaagggcagtagacaaaaatactaagcatatgaaagtcatcagaataataataattcaatccacatcctttcttttgaaaatgaccaaatcatttttataacggagtcttgacagatctggtcatttaacatttgttattttacaaagaacatttgcagggcatggcttatctaacatttgacagatattttacccagcaacttggaatagtataaagatctacttagttagggagcatctggaatttattatcatttgagacaggaaatcttttaaccatgatccacagtgaattcagccaaggtaaaaatgctgggatgtgacttgagagacctaggatctagtctcgtctccatcattaactccttctgcgaccttgagttagtcacctctgccccatgggcctcagtttccttgtctgcaaaatgagaatgttgaactagagggtctcaagattttgattttgcactctgaccccctctcctccagaagtcaggctgaaaggaaggggaggtgggggtagggtcagtggaaagggcaatttcaaggtgttctttgggatggggggaaggatttccaggcctgtggaggagtgtaagggcttcttttgtggcctaaggggctgggaagcccaggttctcagttgctgttttcaagagtgcaagacagaattaggtctaggtttagagagtcaggtcaggtacatctccctaggtatagcctagatgaccattttcacagtgtaggccactccaaatcaggagctggagagggcatgggaacttcaggtggaaagacaggtctgaaaaggacctgggaagtgctactggacacttccaccagaaggtcctgtggatccttcaaactcaacactaaagatcataattctttatcatttctctggaaacctcctctttctccagaatccgctttcttggttaaagcagccccatgcacccagccactccagcaagagtcacgggcgttacctggactccatttttctaatttgctgccatttagttgtgtgcatgggacctcttcataaggcttcctaaatctaccgccttttcttgtcactcacactagcatagccctccatctgggccctagcagctctggccttgatggttgcaaccgctacctaactggtcttcctgccaccatgctcgcccttccagttcaccctccatgctgctgccaaagttctctctttaaaagaaaaacttaggcatcctcaaaaatctttggtcatttcctacctttggtcaaagtccaacttctttgctctggcattcaaggtctctcaagcttagacagcctatctttcttgcttcctttcccacctcgttcctatatttctgagccccatgggacaacttgctatttcctagacagacagtgaattctcatattggactctccactgagtgtgttgttgccagcccccttcttggcctgtcaagccacactctggcctccctttccatcttgtccatagctattacattataaaacatcacactgttctgcattggcctcttttctttcctgtctctcccatagaccatgagctcttggtgtacaatggctatatctgactgacccctggattcccagaactaagcataaggtctcacataaacaatgagtctgccaagaactggcttttatttttgatggcatagcaaaagaacttctggtaatcagactggtgacttcttcctttcagcagactttcttccctatcatttcagctctgaactagctattacagatcaacatagagccccactggctccagatgacaaaacctcttgagacagggccttaaggatccagtggttccagccaatggtgcagatccgtgtaaaacacattttcaccaaactcttgaaatttggaggtcgcccacatctcaaggcaggaagggcacttaaggactatattaacccatgcttttgaaactgagtactgaggagccctagtgtcccctagtgtcttaggggacatgaaaggaagacagagttatgggatatctcattcctgcttcattcaactaaacctatttgactttttgaagtttccatgaacatttcatttggagactggagttggcggcattaaagtttcatttggagactgtagttggctgcattaaatgttggcgatcatagctcgaatctggtgttcaattttcccttttttacctttcctgctacatgcccaacttgagctttgaccaaactcctcaggtatggtgaagcatcctttttcattctatactgttaaaagttctttatattgagccagaatctgccttacaacaacttccacccagtggtcctattttcaccccttggaagtagtgtgttccttcttccttaaggccaatctgctgtcatttagaatctcccaaagtctaaggtaggagagatcttatagctcatacagtccaatgttctcgttgcagctggggaatgaagcccagagaaactaagtgatctgcacaacagcatagagctagttggcagcaaaactgagactagaacccaagtctctactcatctataatgcgctccccagaatctgtcctttcctagctcctaaaatcgtttctcacagtcctgatcactcttcactacacgtactcctgactgacagtgaccaatggctgaagatcagcagctgagcttgtgaaagctccatggctcccaagccttggtctgcctggggagaaggcagagacaaagcagaacaaactggtgtcagaagcagagccgttccctcaccacagcctgaaagtcattctcctcatccttctcttctttccataaaactaaattccattcaaacagcgccccaccccccatggcagggcagccaaggggcagctttcagaggccccttctgacctgtttgctaaagggttcctgctgtgtgaccttccacatcccaagcccagaaacaggaagagttagtttggtttgctttttgggaagaaaaatgaaaacataggaagtagggctcctgagaacagaggcttccaactctgtgttcatttgtccctggagcaggatatttcagggaatacattccacaggggaagggaacagcctcccttattaaaaacaaaacacaaaacccttcaaggtttggaaaaagaaaaaggccaaaaggagacttttaaggaggggaggggcaattgttttataatctccagcccttcacccccttggccacttggagctgtcatactttgatctcactaccattatcagcacatctgttgcccagagatgtcctgctccctttaacctatggcccaagaaagagtccaagtctcctttcttgtttccctgaggatgaccgaagtaggctggcactcagaatcttcaattaaaaccaagaaaaaacagacagtaattaattacacaatgcacaaacagcagaacaacattcaggccttgccaagtacatgctttttgttttaagaagcccagcaaaagcagggaagtgctttgtcagtccccaaatatctcccaggataactatttcatcgtcccagatacgctgccataagtttgcctggctttttcctccctcagctgtcagtcactgggaggcagatgccatcttgtttccctactactgttgctagaagggcaatgcaacaggtcttttaccaaaaacaacaacaacaacaacaaaacaaccttccagaacccctactgttcttttcagttctagtttctgggctgaggaacatggttagttcacagatagttgccagggtaaaagtgtggatcattttggggtgccaaagaaacatatagccctggaaggaaaccagctctgcctacaatctggagcttctacaggtacacatgtacatgtgtcacatgtgtagtgtgcaaacacacacatagtctatttaccaaaattttagtttcatggaataacaaggccttcaccatacaaaaacataccattgtctcccctgaggttatgggtaagcagaacctcttcctagaagatgcttccaagagcatctgcctagaatggcttgtttttttccaaaaagatctggaggcaaaattttcatattaaaacaagcatataattgttgtggaatagcataaaaaattcacatgaattacctgggcatgatggctcacacctgtaatcccagcactttgggaggccaaggcgggtggatcacctgaagtcaggagttcgagaccagcctgaccaacatggtgaaaccccgtctctactaaaaatacaaaaattagctaagtgtggtggtgggtgcctgtaatcccagctactcgggaggctgaggcgggagaatcgcttgaacacagaggcggaggttgcagtgagccgagatcgcaccattgccctgcagcctgggcgacaagagcaaaactccgtctcaaaaaaaaaaaaaaaaaaaaattcacatgaattcataagataaaagtggagacttgaaaaaaaattctcacttgtggttggctgtgtgagattctcctccagctcctcgggcctctgtggggaataaattctttctgttcattggaggtactttggggatgcaaaagtctgagagccacaaagtaaaacagtaggctccttgagggtagaaacgtctcatttttctctgtatcctcacatctgaaacagagccagccacagagtgcttgggaactatttgctccattcatgcatccatccatccatccattcatctatctatccatccttaccaagaaacaagcaaaaaaggtagccttagagtggtggaaagaatacagtttctggaaaattcataaacctctgggtctgaattctgactctgtcacttattagcctcagttttcatcacgtctctaagcctcagttttctcaggtttttttttttgttgttgttgttgttgttttgagatggagtcttgctctgttgcccaggctggagtgcagtggtgcaatcttggctccctgcaacctccacctcctgggtttagttgattctcccaccttagcctcccaagtagctgggattacaggcacgcaccaccatgcccggctaatttttgtattttttttttttttttgagatggagtttcgctcttgttgcccaggctggagtgcaatgatgagatctcggctcactgcaacctccgcctcccgggttcaagcgattctcctgcctcagcctccccgagtagctaggattacacacatgcaccaccatgcctggctaatttttgtatttttagttgagacggggtttcaccatgttggccaggctgatctcgaactcttgacctcaggtgatccgcctgcctcggcctcccaaagcgctgggattacaggcgtgaggcactgctcccagcctaatttttgtatttttagtagagacagcgttttgccatgttggccaggctggtctcgaactcctgacctcaggtgatccacccgtctcagcttcccaaagtgcttggattgcagggatgagccaccatgccttgccctagttttctcagttttaaaataagaatccaaatacccaactcctgagttgatgtgggaccttaagtgtgataatgggagtgggagtgctctataagatcccagacaatacagaaattatagttatttcatgactatcaaattaccaccatgactagcccagacagtagtggggtggggggaggggaagatgttttctccagccagaagtctgatttgagaataagaaagcaggagctgagacctcaggaatgagcccccgggcctctgggatggagagggcagatgttgaatcctagctccagctccacctccactccaggaaggcagtacgcaggccagaggggaacttggggtggagtgatggaaggatcagatgtgcctcatacacttcaggtctccaaagaccagatgtgctttccttctcacgtctgccaataagcccctttgaggcccggtttgcagcaagggtcattcatcactggggctgaaatacaaccaggcatagtgtgttgacttggctgctaacagactctgcctccttgggtaagtcctttttcctctctgggccccaatttccctatcattaaaatgaaaggattggatcgggttgtccctcaggtcctttgagctcctacacgctgtatttaagacttttttgggccttgattttctaaaaatgtgaacaatgtgatttgccaaaaatataattggtctgatcatctgatagttggacactgaatcatggatgggtgaaaaagttcaaagcaattgtggggcaggagacgggcctggctggggccctcttctgtttttaagtctgctggttcctgtggctccttctgtacgtgtctgtgtctggccaaactggcccggctcgcctgaaaatctcagagcaagccaaggttgtagcccaggtagatggcttgtggatacagcaggtgtttcccaagccctgggatccggctcaggtacctcacaagataaaatgaggaaaggaaagaaaacaggaaatcctacccactatatgcaactaattgtttaggaagaattccttctaggcaagcccgttgtctcagaagtcagcaacagctgctgggttggaatggctaacttgtgcaatctctgagattcttaggctccccccaaaccccgtctcaacctgtttagccctctgccattctctgaagctcagctcaaatactgttccctcccactttcaaatccccatcatactgtatatctgtcttatagcatgaatcatgccttgtgttttgagctatttcctttcacctatggattaaaaataaaatacatgttctgagtgaaaattccaacctataatctttcactctcactttccagagttagccgctctgaaaaggttgttgttttttgtttgtttgtttgtttgttttatttgtttttcctttccagaaatcttctattgccaaagctattgaaaatgtgaggttgggcttggtgacttatgcctgtaatcccagcaatttgggaggccaaggtgggaggatcatttgtgtccaggagtttgagaccagcctgggcaacatagggagaccccgcccctaccaaaaaaaaaaaaattagccaggtgtggtggtacatgcctgtagtcccaggtactcaggaagctgaggtgggaggatggcttgagcctgggaggttgaggctgcagtgggccgtgatcgtggcactgcactccagcctgggtgacagagtgagaccctgtctcaaaaaaattaaaaaaaaaagttttgaacagagcgttggctctggagtctaagcacttagatttaagtctcagctctctgcttgttggtcagatcagcttcagcaaattctatcacccctttgaccctcagttgtctgctctgtaaatgggatagacatgtcctcttctcctgtctcacagggttggtgtaagggccaaataagaaaagagattgaaagcaccttggaaactgtaaggggggccctatttatctccatgcttgtcactgcaacttgactgtaagcatctttgaaacagaaacttggcccctcgagggctgtgtccccattgcctcttgttccagtttgtccagaatgggaaggtggtgatgccgggggtatggaactgaatccccagagtcgtgctacacctggagatgctgatgctctgctcctgccctggttctgggtacacagctacttgaccttcctttgaagccaaacccagctgagaggaccatttttctaaagttacttggcttgcaaaatgctgctcctccaccaagtgggcactggcccagcctcactgccccagtgtgctttcattactttgaaaattctgcaactcttgtttcaccccctctacctccttcagctcctagttcctcagattctggctccaagtaatgatttcaaagttccccatgccccccacccacccccccaatgtatgatacatatatatagagagagaggaagtagaaagatgtggccaagaaaattcaattttctgaatggatcagatgtaaaactgttggaaattacagctagaaagctctgcagatagcatttagtccaacctgcatcactccccttcaacctttgacagaagggaaactgagacccagaaaagggaagggacttatgcagggaatttgcggctctgacctccaagtaaaggtgggaaggggcgagactctgcaatttaccaatgcaccgctgaaagggttaaagtcaaggaaactagcctggggaaggtgggtggggtcaaagaagagatgagtgtggccagagaagggaggatcaatcaggagaaacagtcaggaccagctgcaaaattcccctggaaagtggaaatagaagaaatatgagggttgtggtttagcaagttattatgagccttgctgggcaaagagagggaagagagaggaagagaaaagtagagggggcccaaagaggagtaaaaagggaaggaggaaggccaaaccagacgaatggaggagtttgagagtgatagggtcagtgagtgcttaaacacagcaaatcagtagagtcctgtcccatgtggggcatccagctaccttataagttaccactagctctgctgcctggtttcttcttctaggctctgagcacatgagccagtccttactttcttagcaaactcagcccttttccactgtccactgtttggagaggcagttccagactgtaggctttttacttcagtagagttggcacaccaacacaagggcactgtgcagcctggcctggctgccagagcaggctctagatcccccactccacagtcatgatctgattttagtcacacagtcatactatgagttgaactcagcccattttacagatgagaggtgcaataattttcaaatgaaaacaacaacaataagaataaacctaagtatatactgggaaacaatacacgtactgattaagaatgagagtgctggagacaaacggcctgtattcagatccccattttgcccctcattagttgtgtgatcttggacaggttgccaaatttctctgtgcaggtttggaaggatcaaatgagttgatccaagtatacaacctttgaacaatgcctggcacatagtcggtgctcaataaatggcgactattcttgccattgtcattagtatgtgccagatgctgttttaagtgttttatctgtattatgtcatgcaatcatcactcacaaggtaactgaggctcaagtgcaagaagaatatatctggttcattggcttttaaaacttcgttagatgcagacttctaccccccaaaattgaatcctatgtgacaccccaatatataaaacaaaacaaataaaaacagcatggctctgattgaagcaaggtggggtaggggtgggacttggagactcctggctcagtgttccctgttctcccctcccccagcctccctatgataggctttgaggctcttccccacccactgatctagtccatctaaactttttatgctcagataaagacattgtaactctgagagagcaaataacatgcccaaggttaaacaacaagtcaaaggcagagtggggtaccaggcatgaagggacaatcacttggtcaaagagaacagcccccttggttaaactagaacacagaacatcccaagcttgggcaaagaagagctaggaaaggagagtgagcaggagggaagggggatccccgatgtgagcagccccactgactattcatatgctgctggggccatgcagacgtcaagatgagacaaagccctatccacatggggcctctcattgcacagggtttggggttctgttgtgacaagggatgtagcctcctctctcttaggtgtctgttctgtgggatgcagctgactggggccaaatcccaccatctaggccttccgattgggctcctggcctgagctggcattaccacaactccccttctcctccagggttctgggatggcagcttgacttccaacccattgttgttggggtgggggaggtaagaggggtagacttgacgctccgcccttttcacagcttccatgtatgtgcacccctatctgttcaaggcatgccactgccaacactgtttatctaagaaactgtgcgtcgccaacttttgtctctaggactttggcatgggttacctggggacaccgccctgaggagaaattataggataaatttttccagagaacttcttcgagaactcaggacttccctggaatcccttctgacctgatctcgtgagctactcaggctccgtgcaagccttggaagacaatctgcagggccgagcaggggaggggcaaatgctggaagacaaagctcaagtgcaaggccctgagttccttgcctctgtttggatgggcttcaggatctccatctgtcccacgtggggcaggcatggatcagatgctctctgaggacccaccagctccaggctgggcttgtgtggaagccctgaccactcggtgctctctcaggcactggcctagaatccgagggggacacaccaagtgatggaaacaaacagggcccctggctagtcacaagagggcaaggatgaggacacaggaggcagagtactgacctccaaactgcaaaacgctcctctgacaccaaagcagcttttctttctggcaaggccagtttgcatgaatggacagagccctggaatcctgagccagactgcaaggcatgtgttactgtgtgttggtgctgtgccctgccaggtgacaggaagaggaaaaggggcttatgcaagctctgactgaggggaaggtgtgtgtactaaggccaggaagtgggggtgggggccgctgtaggtgggcactgtgactacttcccagataaaggcagaaggaattagtgagcatcagacctgagtggcctacgtgatacaagggcaagaagaaagcagcgaggcagggtgaaggggtaagtggtgacttttctgttgacaaacacttctttccacctaatagttcagggaggtaggtgttactgtctccatttaacaagtgaggaaactgaggctcagaggagttctatgacatgtcatctagtaagtgttgaagctgatgttcacatctaaggctgttttgagagttgcagttcttaggggccccttctctagagctggtaaaatgtgcacacatatacactgtttctgccatccagcaacccttctaagacttggccgcaaagggctaggaattatccttcccattttactaaagcccagaaaaggtgaatgattgggccttagtcatccatagcaaggtagagacaggcaaaaggctgagactggggggccttctgatggaaagctgccgtacgctgctagaagtagcactcccactgtggttccacctgtgtctggtcattttccacttacgaagtgctctcaaatccattatcttgaggtttacagggcagaaaaaaaaatcttccattttctaggtgaagaaactgagcatcagttacttgccaaaggttacacagctactgaatggcagagtcaggacttgagaccagagttgtgtccaaactcccctttacttttctgccaagtgcatgtggccagcaacggaaggacagagtaagttcactgaaacataatgtttgagaccaaaagcaacaaaccccaactccctggggagatatctaagcccttctcttttttccatatgaacctctgaattgcagaggcaggcttgcagcctttgaaggggaaacagagaagccaatgagctcagttctccacagcagactccaagagctgctggctttcatggctaactagatgcctcatcggcccaatggctttgtggtcagggtgccagggttggtccagccacaccaatggtgggactgggggaaggtcttctctctcttcccctctcaccacctgtggttgcatttcatgcttggtcattgagtcatttttatgctcttttcctcagtaacatgggggaaagaaaacctcaaatctctcagccaccatttggtttggtcaaggttgctcctgggctttccactcacccacccacctactcacttactcttcaattttttttttttttttcagacagagtctcgctctgtcacccaggctggagtgcagtggcatgatctcagctcactgcaacctccgcctcccggtttcaagtgattctcctgcctcagactcccgagtagctgggactacaggcgcacaccaccacgcctggctaatttttgtatttttaatagagatggggtttcaccatgttggccaggctggtctcaaactcctgacctcaagtgatccgcccaccttggcctcccaaagtgctgggattacaggcgtgaagcactgcgcccagtgcattcaatcttttaatgaatatcctctcaagtgctaatgctgcgccaaatcccttcctgagcaatggatatgccattaataataaaatacagcccctggctgagagaattcaaacccttattgggcaggaagacatggataattaaactcgatatagaatgattgctgatgtaactgagctgtggagtcacccagaaagggaacaccttatgctattcataggagatactgtactaaactggtatgttggactttaccaagtataggagatagggcaaataatttaacctcttcatgtcttcatttccttatctgtaaaatgggataatagtacctacagggtttctgtaaggactttatgagttaaaatgtgcaaagagctgaggatagagtcaggcacattgaaagcaccatataaatgtttgtgaaataagtaaaggaaataaggatgagcattcttgtgagagagaagtgcacatgtaacacatttggtgggttaaggaggtgtgttctgggaatgccacctgcgttaactgggcagtcttgtgggtgctttgaatgccagtcttagaagtgtggacttgtccctgtaggtgatgggcaaccatttctaaagctagatctttgccacagagtgtggcagaggactcctgtgtgaaatgctagtgctgtatccaccagctcaacaggtgctaggcccaagagactgccaccagccaggaaacagtcagttgccaaatctgaacgctggaccagccctgtgcatggctcagccccaggattagcatcgatatagggaaaggggcagcagggagcccccttgtcactgccctcaaggagctgatcttctaattggaataaggcctgcttctgccaataatcaaatcaatcatcctggtgggaagtggtggaggtaggtaggtaagagaaactccatgtggcctgagaggcagtatgtacagtggttactagctaaagctgacagtccaaactgtatgaccttgggcaaattatttaacctctctatgctacagttttcccattgaaaatggtagcaataataattcagcttatcatagagttatatatgatgattaaatcatatatagaaagtgcttagaatgctggctcacatgacaaacactccataaaccttagctattctcagtgactaagggcctatcttttactgaaccaggtgcctgctacccctggggtacaaggccatggcctggaggcatatgaaggtattagaccggtatgtctcctcttcctggagtgtacattttcctcaaaggcttaaggaaggaaaagatgaattttaataagaaaacaaggatgcatactagagttaactgaaaattcaagtggatgtttaagataaaagctggacttcaaagacattcccacttggagccaacacttcaggtttacatcatcagccccccaaggtttcatcacattcttccctctcagcccttaggggtacttgaatacaaaagttacagtaaaacaaacacttgtgaattcaagtaactctcaagggggtccaatcattctctgggggtaaggatgattaccaccgttatatatgggtgaagatggaggctcgaggtcccaatcctgccactgccacttatgagcaatttggattacctttgctgcttctgagtttctccaactgtaaactggggtaatgatgatgatatatatacttcagagcattgtggtaagaattaaataagcacttagaacaatgtctggtatagcttgtgctcaatccacatcagcttttattagatccattcttgcatctcctctcacagcaccattgtcagctatgtgtcatattatgtccattatctggaggagaaacttgaagctgtggaggttcagtaaggtgccccctctcctcctctttgctaacagcaggcattcctgcctggagtggggaggtggtgggaataaataacctcgaaggtccttcccagcaacagggctctgtgactcaagtgaatcttcggagctctttcatatcactgttctggctggagctgaagcagcagaactcaggaaataggggtgggactggacagggcgggagatgccttagcagggtgggaagtgactgctgccgcccttccttctaggccgctgccactgccgggggctatgtcccacactcccgcccaaccggagagcaaaagggaaactcctctgcttggaggaagctgactgaggcctccttttccgcgggcggcgtgggggagggggctgcccctgtgagaggcgcagtgcagggactactcgaaactcaggagtcaacggggtggcagcagaaagctgggcccagagaggggcatcccagtggctgtttgtcctgcctgggctagtccagaatggggactgctgataggccagagggtgctgggagagacgggcttcccattgatttatggtcatttgaagggaaaaggaaaataattccatgaagtagaaatggcctagtggaaggaggagcagagtcagatctgccttggttctgaaacaaactcactgtgtgaccttggacaagtcctcttccccacatgaagaatgcattcattcagttagtaaatattttgtgaacacctgctatgtgccaccattgccctggggaaaagggatgcatggcatgaagatcaacatgttaacctctaatttccttctagctctgacactgagttcatgaaaagtgggtgcaaatatcatgcaaataagcacatatcaactggaaactgcacttcctttttctagcttatccctcacaaatggagtagcttagctctagattccaggaacaaggtatggagacagtaggggggaggggctgtgaccttcacccatgtacccctttatcgttcacaaagcacattcattattcccatcgtgtcataggaatattaccctcattttacagatgaggaaactgagtctcagagaggagaaatcacccaggttatgccacagttagagcagaggccctattaggatgttggtccctttactggccaccaacagaagtagaatggaaatgacctggtctgagagctgttggtaacttttggccttatctccattgaaaacaaatttaaccaggaccccccaccatccccaagtcaggtaatgcaagtttgcttgcggtggtggggattgcgtattagaaaaaacggttatgtaccttagagtcctagtccaggctttttttgtggtacacgccaggggctaaactctttgaaaataaaagctaatctttcttaatgaagtctatactccgtgccaggcaccatgatcagtccttcagatccttacaacagtcctgcaacatagagataactgccccggcctagatgatggccaagtcatttgcattcttgggcctcagttttccatctgtaacataagggagtctataaggactgattccacttcaggatattctggtactagaaagatttcaaagtgtcgttggtggaacccagctggtcggttgctcaggccagccagtcagagaatgtggttgcagggaggagtgaaaagcagggggcggtaaagggaggccgaggagtgagtcagtctgtcaagatggccagagccattgtttccttctccatctggctgttgcacaaggccttcctccatgtcacatggttggtgagatttgggggcagacaggaggtggaggggctgaccccataactaggaagacacccccactatcttgcaccgaggtatgagaacagaaaggagaggaatcagtggagggaaaactcgcagatgggggccaagttggaaaagtctggaaagaaggtgactccaacctggaagaaggcttcctatggtgatggggaggcggaatagttgagtagatgactggaggctagagaagggggagttcctgctcaaggtgggggcgtggaactttctaattgcgactgagggggcggggaaacacagccatcatccgctcagcccctccctccccgggctccccgcggattcgctcagtcccggggcaaaactacccgaggcgccagcactccggctcgccagctcgctcttgggctgcttagccgcctggcaccgcgcggcgcccgcggacacatggcccaggcgcggggctggggtccggcgttgcggttcccgaagccacggacgtggactccgtggggtgtggagggcacccggtggtacgcgccgcgctgggatccaggtgaactgagagccaggcagccccaggcggggaggtcagggctgagctgcgcttcgcggagagcttcccgcaccggctcttcgaagctccctgctccctctgcctccttgtttggttccagcccggttttcatcgttgagtcctatgtccatttgtctaaaacctcacccctggccggcagtgcccccttttgaggctttccaccccgcacgccttctttcttctaattcttaggcagctcttgccccgccctatgggtgccccatcctcttatcccagcagtctatccggcttcgtccccacccacctctgtctacatcctccgctcaaaaagaacaccactttggttactaacacgtggtaggcgttcagtaaacagtatgtccctttacacccattcctccagcaccttcttcgtctctgcctttggtgtctgcttgttcaccctcctgtcttcctgtcccactatatgtctaaacctcaacctgtattttttccttgtcattgagttgtccgtctgtcctttcatccttttatttttatttatttatttattttttggtctccagatcgttaagtgttatcacctacacagtagctccctacatccccctatcactccaagggcctcttaccttcccactctgtaccccaggtgcaggacacagcccagcaaccctggtagcacctttataatcaactcgcattgcctgggagctccaaaccaaggaatgggtctctgagggatctcccaaagtctctggcattttgtctttttaaaaattgaaaaaaaagttttggggtacttatatttccaggctactacttctgagtaattgttatactcactcactctctctcgagactcgaacttctgagctcaaacaaccctccctcctcagtctccaaagtagctgggattattgcacccagctctaattcgctcttgattccacttaaagggcagggaggaaatagcaaactgggttgggtttctcaccatagatttaacatggaattgaacacgctgaaacacaggatccttggagattctgagaacagactctctgattgtacttatggggacactgagagccagagagggcaagactctcagccaggtcacacagttcctccgtggtagaaacaaagtagaagccagagtgacagttgcctggccctgacccaggagccttgggtgttgggggccaggatcatttccttgggggcctgtccatatagagtcatcaggtcccatccaccccggaagcctggctgcccctccctccctgtcctctgggaactgacctggctacccacctgcctgggatgggcgttctctgtcaggggctgccattgcctcccccactgacatgggagctccaggaaggcaggtacccaggctgtgggcctgcccgccccactctctgaccctgtcccttgcccagtgcccggcacagacaaggtctgggtaaccatgttatgggaatggctgatgcatgtgtgtggggaagttccagccctggctgagggcaaatcagaactcctgcttagtaagtgtgtatgtatggaggggaaaggggggagctgtgcttgaggaaaggcctgttgagagggtagacgagctccaaggccaagttgagcccagagccctttgctgagtggccctcaaccaaccaaacacatcccatgccctctccgatgtcatcctggggcctctgagggctgcccttcaaggtcaggagacaggggggtggttggccagggacaggctcagccagcctgaattgacattgtcaagccctagagacccctcttcacagggctgggctgggccaggctgggggcagggcgtataaaagccacacaccactccacaagcagccctccagcttccagggcgccacgtctggtggcagtgtggggtcaggccgtggcagctgacgatggaacctgtgaatgggaaggaagagcctctctttctgcttccccggctcctcctcgccttcccaggttttttctttgggagctgcagccctggagggacactggaaaggatcccagacaaggaggtaggatcctgagggctgttcaaggactctggatacccatagccccaaggtgagctgggagcaacgctgggggcaaagaccagggctccaggagtggggcagcttagcctcagccctccccttccctgcctttcccccaggctccccacccttcctttttctcactttcctcccctggccccaggtaccccccatcctcagaggaccatcatgccacccccacccccgtgctctgcagaagccctgtgcatgctggacttgcagatgccccacccccatgggaacacacagagcagctcacagaagcagagcgttctggaaggaagggaccctagaaccagggcccaccccattttttccagatgaggaaagtgggcctagccagggagaagcaagctccagggctgaggactgagactaagctgggcagaggggagcactcctgtcctcgcctgttgtgtgtggggtgtggggctgtgtcagaggcaggcttgcctttgctcatctcctctctgcatgttgtgacctttggaatctggagggcaggaatggggtggggcaccggggtggacatcctgctctgggcgtctgtgccactacggtcaccaagtgctctgtccacggtgaccccatctatttgttagggctgggcaggcagacctccccgaggcgttagtggggtgctccatctgcctgcagcagaaaacctctggggaccctttgagatgggccagtaaggtcagtccggagacccatcctgggtgtcaaatggtacctgtggcactgtcatggcccggggggtctactgagtggatgctggggcccagccttccatcaggctggcacattgactggtgttggttgaggagagatgacaggtccccgcgtatctgggaaagagccagggctgggttatccagctccacctgcccagtccaagtgcctggaggcagtcatgagccgccccacacctgtatgtctgagcttagggagggcaagggcagagaggttaggtgacccctgaatctcccctggcctgggcctggctgggcctgtgctccagagtccctcactgccagcccagggctctgagctcagcacagagctcctccttccagggtgctctggggtgaggctggaggcaaccgtgatagtcccctaggctgtgggctgagagggggtgctccttccaggatgtagctttctgtcctctgtccacacttggcaatgtatagacagtgaggtgtttgtgtggccctcaccttttcaaacccctccccaccactgtattccctctgtccacatctgcctctgcttgggctgtcttcttagtgcaaatctccctcctatggccatggctcctcaggaagttttgttttgttttgttttgttttgttttgtttgtttgtttgttttaatgaaccatgactatcctctgttttgggacctgatcaatagccccctttcatgaggctgggcgggggccccaagccaccagggagcaggcttcgttgaggcatgcgggaatgtgcgtacaagtgtcagagcctgtgtgtgaggccaccggtactcatgtacttggtggggctggtctgagtgtaattcattttcccctcactgctcctaccccttttctaaaaacttcccagctgaattccctgaagtgatttgctgcggtttctttagctcctatggaaaagagtagtagaagagtctatctggttccttttggatattaacctagccattccagagtgggggcatgggtctgccagcagcagctcgagcaactcccattcccaggcaggcagggcggggggactgttgggagtcctcaggtaggcccttattgggacccaagggtctcagagtgaggctcaggggaatggtatatggaactgctctttgccacagcgtaggagaaaagggctgataggtcccccaaaggttagctctatagcaccttcagtgtcatcctgccacctgccacagtcctttacagtatactttcacatttattgtctctactctacccagtgggtattatactctagtcttgttatttataggtgaaaaaactgatggctggggtggcacaatgacttgtcctgggtggcataacaagaaagtggtagaactggggccagcatttagctctactaattcctaatccagggctcattctactattgctcagtgcttctcaccatatctgacgcttataagcacttactatgtgccagccatcactcttaagtgtttacttagcctagtggatctgctctgcagccattgaaggtcagggttgtgatgatcatctacactttccagatgaggaaactgaggcagagtcacacagctagtaagtagcagaggccatttgtacccaggccatcttgctccagtgttcattatactccctcttgtggggcttacgtggtctgtgggcatggtagaatgaggaaagccccatgcctcgggcacagaaacacacacacacacgcacacacacacacgcacaaacatacacacagagactttttcttttgccaggccttggcctgcttcaagcactctacattcccctgcctgatgactgagctggcatccaaggtagcaacagcaatggtactataggacacacaggcaagagtgagggcttgaggaaaaggggaagtcaagaacctaaagcctccagttacctccacagccactcaggctgcaacctagaaatgggcctgtgaaaagatactctttctcatccattccaggcactattaatccatgcaagactcaggggcagggagcaggggttggcaggggtattgaaggggatgagctatctttgccctgctgaacaggctgagctctcctggccagaataaaagagggagatcaaaaaagaccaaaagaaatagccctgatatcgcttgggccatttcaaaatgtcacaatgtgcatggcaaatatcatgattgtagcttaccctgacaattgtgttcactgtcattcgacaagcatttttattgaacatctactctatgccaggcactgcgaagttctccttctaagtatttatagcagtgccccattttttggtagttttcatactataccctcctccttttttgtttcctggtttgatggcttttaaaaaaatacagctggtgtctcagaacccatgatatctgattcagttaaatgtatctactaaaagataagttgactttgctcattagtcatatgattgtcatttatttttggttgtgctttgaatatctttcaacatttgttcattcattaacaaacaatagtgaggaaagtactgtaagcactgtgcttggtttcctggagtggatggaattggctttgacaaggtttcttgcccttagggaaatgataaaatcattgcaggaccccactttttgtcctttttagcactgtgcacaggcaagatgcctttggcttcaactcagagccttaaggatgcttacaattgttaaagcccagcctcaggaaggaggtcatatcccttcccacccaccagaaggattttgcttctgggagtaacttctggtgtgcaggcctcatccatagacccacagggacttggcgcaccttgaacaaattgctagaggatacgaggggcagtcctgccatcaagaggaaaagagggatacatgggacacacagtggtggtagtgtcactttatcattgctcctctgactctcatcagggccagcagggaaggaatgtgggagaatttcagtttggcctagtgaactgaaagctagacaggagaggggcacttggggctgggttaggtctggctctgtctttccctgggtgaccttgataaagttgctgccctcagagacagatatttttgctctcatctgtatcagatactctaacaagcaagttagatggatgcagttcctgccttctaggaatggtgtggagaaaataaccagtgtacaggtattgaccctgccatggatttgctgagtaaatcatttgaggccaggagtgtgagaccagcctgggcaacatagcaagacttcagctctacaaaaaatgtaaaaattagctgagcatggtggcacacacctgttatcctagctactcaggaagttgaggcaggagattttcttgaccacaggagttccaggctgggtagctttaagtgagtcatgcttaaagtctgctcagtttctgtctttgtaaatgtgagggatagcagttgaactgcatgaggtcctggatactctcagacctgactaataggagtcctcaattcaacaatgaaatcaaggttgtgaacttgtgttggacccttgtgatgaaaggccagagagaaatcaaagccgaaggctcttgtttcttactgaatttgaatggactttctggtggtgcttactatcagaactcctggaagccctcccctgccacgattaatgttcgtgccccaaattttccatgcatttctctgcggaggtagagttcagacttggggtaggggacagaagcctggggtattggggaagttgcagagccactggggcctgagcaacgtagggatggcagcttcctgctcaaattcctaattatctggttttcccctaccaattggagatttcactgaagttgtgtcttctggacatcccataaattatccgagcaagtcactgaaccctcccgggcacatagcatatgtgtttaaatcccccaaacagtgccggactcattcagaactcaataaatattagcctgtgtgcctggccaagtcactgcttgagcctcagtctttgggcttgcacctcctccctggcagcggtgtgaccggagggaaaggcagcggcgagggccttggaggacctgcaggcagtgccccgcccacccagatttgggtgactttctggcgagtccggtgggccagactgcgcccccattggccgaggggaggtgggcggggcgtccctacagccctactcgccgacgctccctccccacttgagctgagtggactcgggttgacaacggctaagcagccgcggcagctgctcttctggctggcaccgtcacccctgcccgaccccaggccccgcgtgtgtcccggacggagcagtccctcctgggctcgcctcctgcccgctcgctctgtgtcagcgcccgaacccaaaggggtggacgcggcctccaggtaggagtctgggcgacggcagggggagatccagacaaacgggggcgcctggggctccctctccccgctttgcctctctggcgcgctccggctcggcccttctcctagcggttccgccgggcggcgtacgcaagagacagggaggaagcgagccgagccacccccgcccctgggattggggggtcagaatcgccgaaattgggggacccccgagcgcgccagccgcgcgtcttccagcgaagcctcgcgagtggggcggtggaaggcagctgtccgcctgttaccgccgggcccgtgggtctcgcagccgtcgctctggggctttggaggggcgttgcagctggccgggggcggcagagcttcaggctctgttgccgggtcgcgccagatctcctgccctctcctttctctgctttcgagggcatttccaggaagcccccgtccggctgtatgggttttcccgtcggccactgcctcattgctttctctcctgagaaatgcccaggacttcttggtattaagatagctgcggggaccaagcgaaaacgtttggacacgtctcatcttcataggcctcattttcccataaagtccaaaatgggtttggattagaggaaaggcttttagtggaagtttttggaatttccaaattaggtagtgtggggttctctccacgttcctcctgacacttgtgaaagttgcgcgctgaattacgactcaggaaactggggttcagccagtccatgtgaccttaggcgagtcatactactgtgtgggccatagtgttttcagccacacctcaggtggcagcttgatttcagtatctaaagggcccggtctctttcaccctgacatttgtttacttggtacctggggtcaggctcctaactggcaggtaaaaggttgtctctgagacgctcggggtggcagcagctatgcacacggagagctttgtggtgattatgcagctaagccagctggaaaactagagtgtgcgtggaggggtgggcgacagcagccagaccaaggtagggagaggtgggagttttcttccagagcctggggccccagaggttgggggcctcagagattgggctggcttggagcctatgcttacccccaagtcccagggcctggcttctctcccagtcagagcctaagcggggaggaggggttaatgaatcacacccagggctattttcaaaccctgactcctcctgtgcgacctgctccctccccactctagggtttgccgcccccccgccccccacacctgtattattgccctctgagttttcctctcattttcatcctcctggaatgaaagggggacaaatcttgtctgcggatgcgatgggaaggtgggcagcccaaaggcatggagaagaaggctgcaggtgatttctgggtggctttcgcagtgggaagagtgtgatgggaagggtggtgttttgctgtaagggcataggggtcggtagtgaaactctttcactctaaaggtacagctgccatctagctggacattctgggctggttttcattttagggacgtggccttttgttaatgtgttggactttggattttggatttctgctccctagacctctatatttagtgctaggaaacaccacactggacactgcctctcctgtttttggagaattatgctaaacctctctgtgcatctacagctcccctcccccacctagagaggagaagctgcctacagatgatatctggaggtgtttagagcaagaagggctgaactgaaggtgtgcaaagcaaaggggctgtgtgcgctgtgtgcttgcttgagacagggcttgcagtgagtcatgtggggaggatggcagagccttccttattcaaacacaatacctcctgagttccagcagagaagcaaagaaagtggcaccaagaagactcgaatgttgtccctctctgtcctcttaaagttttaaaattccattattgggactacagattggagagggagcagaagacccctgtgtctaggtttagaggatagcaacagggacacaaaggcaagaaggtcccaaaggaaggaggggatggagtctccaattgggaagctgtcacagctgcagctgctttgctgctaggagactcctggagctccttatttgagccatggaaagttcaggttcaacagatggcaggtttatcacgtgcaggctgtgccctcacctcttttctggctagaagaaagggttgcctctgccttgaaaagaagagaaggaccttttgccttaggctcccagtttggttaggatcaggtgtcatggccctgggccttgggaaagctgttcagcagataaaatagggacagcagatttcaaagatacaagggctttagggtgggaagtgtgagctcccggagatctaggtgagttttacattcttccccaccccacaacagggtagttgggcactgggttgggcacacagttgctggtgtcaggtgtttattaaggggtcttggtttgtgtgtgcgcacgtgtgcatgggcatgcattcgggaagggtcctggtagataggaatcagtggactggaggccacagcctgggcccttgtcacaagtctgaagtgctgtgtttgtgggtggagtttccttttccccagccctgcaggttggtaacttgcatgctaaacagttgctgttcctgtttacctcgaccacacacaggaattttagaactgaatgttaagttccctaggagttcagggtggtgtggagcaaagaacaggggattgggagttgaacatggggagctttaactccaggctctgccgcccccctcaaattctccgactctgggtttctcctcattttttccacttcactggattaaactaggggatccatagctaagtgctttgtaaactaccatgtgctgtataaattattagtcattaagtttaggcttggtgctaggtcttgtggaggacacagagtaaaaacccccagttccagggaatgtaccatctagtttgggggttagtggcataaataatacatgccactaattatttatgtattaaataataataccttggtgaggacttcaaaaaaattattgtgaataatttcaaacatatataaaaatagagataattagtgtactaagaccccatgtacccatcacccagtttcaacagccatttgcccatggccaatcctgccctgtccatactcttatctacatcatgcccttgttattttgaaacaaatcccagaaaccttatcagttcatctatacatatttcaatacgtatttctaaaagataaggattcataaaaacaaccattatcacacctaaaatagtttcttaatattatcaaataaccggtaagtgttcatatttccaattgttgagaaggacttatttgccctggacgtccattctgccctgggaaatccattccagggagtgattgcttttgactgaggggaaggtgacggacagaggcagtggcatttgagctgaaccttggaagagaggcccaggaaaggtcccagcccagatgttagccgcctctagggctccagatctggaggctgacccatggaggcttcttgcggagacttcctgcctttgtttctctagcagtaaatgacagttctcactctcacacttgcttccccagtccagggcacccaggagtttggggtacgcaggtctgggagaattctgggaggctgctctccacctaggcccctcccctgcgcctggcccctgaggccagttcagagcaaaacaggatgcattcaggatgaacgtctttcccagcttgtcatctaatcaccaaggcccagcttggagcttcctctctcattcatgataaaaaccctcactgtctctcttttcccttccgccccagtaagggtgtgctgacttcctccatatccgggccagccctctacccccatgtggggctgagggagagattccctcagtgcaggcctctgcccccacccacctcaccacagcctgtcagagagggagagaaagaccccaggaatgttctccctgactgcaggctcctgctcttgggctgtctttgggaaaagagcagcctccttccaacaagcctggggtcctgccactgcttggttaatcattgagccacataataaccaccttggaaagtcatctctaggggatggtcattaactaactccctgtccacctcaggccttaaagagaccatatcctgaaccctcaccttcccccaagggaacattgacaaacattcactcacgggaacttctggggccagtgaaaagtctgcccctccatcctttacttggcaaacggaagcagttattcacaccatttgaaggacatgggttcagcttggatggtattgagaaggggagcggagtgaattgatggggatttggatgggcagtggggtccagcatcagagttaaaaaggggtaggggggtgtttctaggagtagttgatcgcctcatctcaatttgaaagtctaaaagagcaagaaatgcccacccaaagggtctgccgatgctgggtatggggtgaggctgtgtgaatgtgtgtctgttttcagtacagctgtgggtccctccacaccaggctgcagtggaaatggggacagccaaccacatgattgctgctgagaggctgaggacctctgtaagtggaggaggatgccttcctccgggagcctgtatctggacaagcagtggcacttggtaagggtcgggccaggacccagacccagacccagacccagacccagacccagacccagacccaatttagaaagctccagaccatatgcagtttcctgcagtttcagtaggaagagaaggaaccaccccgtgggcctactacagagttgggaaacggcttctggttctgccccctctatagctttctctcggtgagtgatttttgctttctctgggcctcaatttccacaactataaagtgggtagggcagttggcaggcagactcagtggtctgtgagccttcctttcagctatgcaagtatgcctccccactcaagacccttttcttatctaccaggcaatggtgagctggcttcaaattcaatcaggcccagacactgaatgttctcagctggctgggtcagttggagctggccaagccctgaattgccacagcttgggttctccttgtgcttgggcatttctgcagtttgctctctggcccctccccaagcctgtgtctgtccctagtggccagccactctctgacccattcagccacaagttaatgagtgaactgctccccctgggtcgtaccagcccaaggtgctcctgggatcctaggtccctgtgggaagcagccaagggcctagccagctccagtcacctttatgctctctcccacaacccctctagaggtaggtatgcaggcagagctcagggcagaaggacctttagagggcactaggtccaactttccttctgaagcttggggcttcccgacaggtacttgtgcagttcctgctcactcatgttcaatacctgggaatgtgatatgtttcaagcaagttgctttcgtctttggaatgtgtgaaagttttctcttatgttgaacttaactgtgcctccctgaggcttctaaccctgggttccgagtgtgccctctgggaccacctggaccctgtctgctctctctgaccttcagggatctgaggatggaacccaagtgcacctgtgtcttctctaggccaaacaaccttcaagcgtctgcgctccttctcagacctggagcagcccccttcccagcctcatcactgtcctctgtcctccctacatgctactgtttatggcccccttaacatgtgggggcaggaaatggggcactggaaacccctcactccccttagtttatttatagtctgaacttgttcagatgacttttccataatccttttctggttaccacaacaggtagactcctaacccccagaatcttgggtgcaaataccttagacaacactgatttgtttatggttcaggtccagccagctctcacgattggagagcccttggaaggtagggccttcttattggtgcccccatagtggaggacaagcctggtgttagtaggtgttccccttgttgagttaaatacaatgtaatatgtggggggcttccagcgtaccctgctttcctgccactcggttttatctttggagttggtcaggggtgggtggagggaaggggatattttagggagtactgaagccggaaatgagtatgagccatgcccacagtggggcctagaagagtgaatcagacagtgagaaataccaacgtagccattccttcccctggcagttgatgatgatgactatgagtcctcccatttcttcagttgccaaggcactttcacttccatgattccattgtgttcttagagcagccctgtaaagtagatggtatgatttccccagaatgatctgtggtggtctccacctgaggcccagggaagggaagaacagtctccagtgagggaggatttggagcccaggtctcctgaccctcagccctccctgttttccccaaaccacacccagcagccatggcagccggggctgactcggcagcttccccaccacagaggaacccctgccctggctgcaactctgttcctgtgagagagtgagctccaagggacgtggcctaggatttcctgtcctttatctgggctggccaaaggctggcctgtctgaggtgtgagataggcacctgcagccagcctttctgctccaggctgaggtcaagtcaggctgtggcagaggcagtgagcttgtgggaagagcttgtccccaaacatctgtcctgagcagtgcccacaccagcagggccttctaaatgggaaaaacagagaggggaatgtggaaaaggggtcagagtggagcagaagtaaaatacgtcctgagctgtacacaagctctcatgttcacagtgctgggagactttgggcaaattacttaacttctctgagccttcattttgtcagctctaaaatggagatatgtacccacctcatggagttgttgaatattaaatccaacaatataaataaaattattgccattattgttgcttggtagtaccttctgcagtcctgtcatttggttgtttttcactgacctgggggtgggcagttctcaaacctgccacctcgtgggcattcggtctggactttgcagtcatttcagagtccaccttacccagaaaagctccctttggccatgcccacccacagggctcccttcctctggccttctttagtggcattcgcgacactcaacaggctatagtagtgatggtgacaccaataataatagtgaactcttctaaattcttggcaaattttaacttctttagcattcatggcaattccataaggtaggtactgctatctttgtctctcttttatttaataaacttgcccaaggtcacatatccggggagtgatggagctgggatcaggacccaggtggtctgactccacctcctgacatctttaatgactgggccatgcctctctccagatgcctggccaggaggcaagagctgaggttcgggtctccttccccacctgagtgctcatcacacgcaccagtgatcagtcacttctggacaggcagtccccaggtccttgcctgtctgctctgtgcacttcttctcaccctccatcaccaaggtggacagatggatagagggaagacatggaggagtgggtattcatgctctaaaacagagctgcattggggtggggagggagtgcaggagggagttgggcagtgggggtggcagtgtgggcagtgggggtggcagtgtggttctgacatcagcaccaggcctgcctgattagcaccttctagtactgggggtggagaacagggtgctgggtggcatcagggaggaagagacatttgaatatgctctcttgacaaccaggttgcattatttagaaggcatgggtggttaggggctggcaggaggctggctggattagctcttatgatcactagctggcgtgtcccatgctagaattgggtgggaggaggttgtccagaagctgtagccctccccgaagtgcttccatctcagggtcttgggggctgcaagcttccttccctcaggctgtactagctgccagctccattgcttcagggcttattcccctttatcttgcctccgaagcaagctccagggagtgctacgaaggccagtccatggtagcctgtctccctgagaaggatgggcctggcagcagctctggccgagtgctgcaggagaattcagtttttgttctgttttcagaccttagtacccagcatagggcttggcaccaagtaggtgcttgggtattattagttgaataaattcacagtccatggggagtggattctaaagggagagccgagggaggctgaaatgggaacaggtcaacaggagggctgtggttatttaggtaggcttctggcccaatctgtagtccaacagaagctacatgacctattgcagcctcagttttcccatttgtaccataggcattacctgctttggaggagttcttgtggggaccaagtgacatacaggatgatcaagtgctttcctggctgataggaagttaaattcaggctaaccactcttactacaaaaaccctggtagatgattttgtgtctgctgtgtgccaggccccagcctagacaatttcttttctttaatgaggaagattctaacttggtagctctgactctagagccaaactgcctggatttgcatcttggctcacctcttcttagctgctgaccttgggcaagttactccatatctctgggcctcagtttcctcctctgtaaaatagagatattattggagcacttagctcacaggtttgttgtgaagattcaatgacataatacacattaaaaaaaaaaacttaaagaaatgtctgggatataataatggctcagtacaaagtccatggctcagggcacatagtaagtactgtataactattagtgtctgctatattttattaataattacattcagtatcttaaatattgctgtcattaatgagtaagaagtatagagccaggaccaggggcggtggtggctcacaccagcaatttggaaggctgaggcagaaggattgcctgagccaaggagtttgagaccagcctgggcaatatagggagacacctatctctacaaaatataaaaaatacaaaaattagctggacatggtggtgcacgcctgtagtcccagctactctggaggctgaggtgggaggattgcttgagcccgggaggtcgaggctgcagtgagctgtgattgtgctactacactccagccctggtgacagagtgaggcctcattttaaaaaaagaaaaggaagaggtacagagaggtgacaaataggctacgtcttcaggtggctagcctgttaactcttcccactgtaccctgtaacttctacgcccataggccctacagagctgtaagaccaccatttggggttctccttcccttggccctaccatggcctgagcatgcacgtcatcacccttgcccccagagccctaggctccgccccttgctatgtgctcagcatcacagccctccctctggctctccttggggctgggggaggggtcgtgtctgctcccttcccggggaggccacttctctcaggcccatttcctttctatcagagataattttctctggatctcagggtggggccaggctccttcaaggcatttcctgcccaggagtttatatttggcctgagcaaaaggaaagggaagtaggcaagggggtgggatgcagacgtggtggcacagggtcaaaacagacaagtgccaagactttccagaccaagagagggaggcaggaggtaggcatgccccttctctcaagtgaacgtgggtgccctcccctgagcttggcagagtgaagtgctccttcaggtcataatgcctccaccatcaagcagagttcattttctgttcgcacatctctgagccttggttcctggctatgtggtttctgtcctagggcaaggctttgaggtgaagacatgtgctcaattccatttctagtgctgtggtgataccagacaagggagcagagtcagaggcctctatactgtgtagtgggaagtagggcttcctgtctgtgtgttgccagaacattcggtagcccttaacacactgcagcggcaacacaaagaccaaaagtacccagtgcagagaagcccccagttgaatgggggatagactcacatgctgctgagatgatcatggaaatgtgttaggggactgcttcattgaactgagccactgggtgttagggggttggtgagaggtcaggggaggcttcgcgggagtgggtgtttgacctccagcttgatgaagaaatagcagtttgaagcttcaaatcaggccatgtctagattgtgcagagccttgaatgccagggagcagtcaagactatctgccccaggctgtgggagctctttaggttgtagagtaggggagcggccaggttagagctgggctcttggaagaagcagctggcaggatggccccttgaaaggagaggctggaggctgggaacttggagggctgaagtaatccaggcaggagaacctagagcacagttgggcaggaaaaaacccaaccatttgatggaaaagttggtagaatttggtgcctaaatacatgtggccagaagagagcaaggatgacttgaggtttaagcctaggcagtgggcgtattgggaggcaggaacatatagagagctggtttgtggggaaagatgggtttggtttgcgttgccactgaggttcctcgcttgggtcctcagaagagaatgtgaaggaaggaagctccccgcactgagacagccactacgcatcacacacacctctgctgcagctctagattttggggaacggccattaggagatgtggaaactgaggttcagacagaggtaatggcttgcctgaggttatgcaagttgctcatggagctaaggccagaaggtagttcacctgaccgttagtccaatactttccactcaaaccacagtggagagcagtcaccgctggcctaatatctgccccagactggtttggctggcatcatttatctctaggccagggactggagatggtggagtagcacatggctcattaaaacaactctctctttcctaggcaccatgaccttgtcagagcacctgggactgggttgggggcaggagccccttgggggcaagaaaactaatggagcaactgcagcagagcaggtggcagctttgaccttccttgtcatagggaaacccagtgccaggcaggaatgttagctgtctactttggtcctgccataccaagctcaagcccaggagcccacaggctgggctgcctctggacccaaattctccagcagcctcagtgggcctgaggtctggtttaacctcagggtgctcgtgactctccctcatttacagctgcacacaggagctcaggccactgcttcacggagaggagcggggaaccacagttgggggtttcttgtgtaacttccatttttaaataaaatgccaaaccagaattgccacctcttcctggccgatcctgcaaggtgtccacggtgtgcaaaggctagggaccaccactgaatgttgcacccattcttcacttcagcccccaggacatcctggggggagggtgggctgcccagaggggccggaggccccagataaggcagaggccaaccctcaggatctcgtgcttcagatctggagtcaaccttcctttgtctggggctgtctggtgtggtgtatgatgtttagcaacatccctggcctctactgagtagatgctagcagcatttactccttgacccccaccaattgagatgaccaaaaacgtctccagacattgccaaatgtcccctgggggaaaaattgtccctggttgagaatccctgtggtagagactagaagttttttctggggtgtgcagtgttgagagagggatgttatacagaaggtagaaccacacacctgaacctaccactggccagctaaaagattcagtggcttgtttttcctgccaccctgtcctaggggcccctcctgggctgtttgctttggtggtgcctcatttgtgacagggaggctccagaagtgttgctcgcatgggcctggaacttggcatccagctgtagccccggccaagaccgaggctggcatctgaacaggtgcagcagggccctgagttctgcccggtgacctaacaagccagaggccagccagggtccagcactgccaacctaggctgggtgaaatacagaggcccttcctgcggtgcccctcctgtgaggtttggaatgtaggatgagagctattttggtcctgtctcctttcctccctgtgcctccctctgtaagaatcaagttagagttgtgattccagtgaagagcagcaggagcagagagaggcaccagtgaactggaccgccccatagatagggcactgcagacccccttgcatgtctgcttcaaggtcaggagggaaagtcttggtggccctgtaatccctgacagctcttagtacaggtcctcatgaaggtccctttcccactgtcccccagggagagaggtggcatagccagtcagccacccattacagcacttcttctaggggcactgccaacctagagggtagctttgtgcaaattcaaatgaaacagtgcccctgagggatgcagccctgtgccagggctcaagccttggtgggcaagcttattttggcctgggtcccttagtgtttccttaggggagggtaaaagaagctgctcagagcagttggggccacatgctgaggatggtagcttctgagatacaagccctctgccaaaaggccagcaccttctccttaagaggggtccctctctagggttggagagcgggcaaaggaaatgggccttgtagcaaccaaaagaaatgatctgagaagcagtttgccagggcctagcatttctgagcagcagtagcagggcctgcagtggtaggcgactccttgcctgcctcctagccctgccttgagggaccagcctcacagagcctgccttgggaactggggttgtcacatagatagtggcatcacaggtctttctccgccgctcaggacactggcttttcctcctgcactcactgaaggtgggagagacaaacatggagaccagaccctgttttggaggcccccatcctctggcgagggccacggaggagatgcttttccaaataggaagctaagtcaggtaaaggaggccaccacgtgtttaaagtcaccttaaggagcaggtcagctaactcaatgaccttcacaaacaccgactgcctgccttccctcagccatcatagacattcacactgatgctggtcactctccctgctcctgcactcaggtctagagagaacgtgggcctatgaatagaacaggcctgtgactggtctctgggtagaattttccagggacctatatctgtggctttctagcaggccttttctgtttagggcggtggtctttatctcaggctgtactttagaagaaccgggagagctctcaaaaacaaacaaacaaaaatgaaccctatccccagagagtttaatttaactagtcatgggtggggcccattagtaaaagctccccaggagattttaatgtgcagccagatttgagaggtgagggaggaatgggacgggacacccaagagctccagcagtaataaaggatgctttcatctatgtccctgtgacatccatccattgcttgtcttgagtcctgtatcttcccgcctggtccccatgcctgatactgtctttatgggtaggcatgagcaggctgaacccaggaccgggcagctctcttataacccactgagtgaccagaaggtacaaggactagggttgcctagtagtggtgtgaagagggggtacccagcccaagagtggggttggtgatactggctggctgaggccttacttcctgtagtctagattagatgcctgttgccttctctcttcctcctggctctcttctctcacctcttttcaactggtacacaatctgaactgtgtcttaaagactagatgggtacaaaattcagctcatcttaacaaaaatagccttcattaatgataacttttatatagccactttcaaaaccagcaaaagcccgatcaaatctataaggtaaccacagtggtagacaggaaagtcgttagtctccactgtataaatttggaaaccaaagcttagagaatgacacgagttgtctcagatgacttagtggcaagcatggaagctggcttgattagaaaaaagctttttttccaacttagtgatcatctttgggcattattgcatctcccagtgagaaatgttgctgcctctttcctgggtgcataagccctatgcttgagtgtttctcaagaccagaaggcctgcttttttcctggttgcatccttctcagcatagaaaactgctctgtgctgtctctgggacgtggcctgtgtaaatgtaggtgcagatactgtcattgacctcagaaagcatgtgctgctgctcagcctttccttctttgatgctccctccaggagacctgtgggtttggctctgaggcctgattggactctggagctttctagtatgccctctcccctgactctcccagcctgggtcatctgggcccctcccccaggggcttaagtctcagtggaatccagtttgtgccagctgactgctgttactgacctatcctggcacatcacctaagctttggccagagcatgcactgcctgcagaatatagcctttaaaactgctggcagccatgccttggaatctgcatatctggatacagaggtagggcaaggggccacagacattcctacctcactcacctcagcctgcccgttgtcactctccccaccagatacataagcccatcctcagtccgggccacctgggcttcagccccaggtgaatcgagtctactgggggtgggggtggggtcgctcctggcctcagcctgggtaggctgagacgagtgggagggacaaggcagagcacctcagttcagcctttaatcaccaagacatatgtctctgactgatccatctgggagggagcctcggggcctcccagccctccatgagatggtgtattgtggggagccaatgtccctgacatcctgtttggtaataacccattacattctctagattcctgttaaggagggctggtggggaattcagtctgtagccctactccaaactcctttgctcctttgtctttggagcaattgcagcctctttgaaggctccttacctcacttcccccagccatttggctgcaattctgacagtggtctgggcaaagccattgtccggacccacaggggaacgcagcagctgggcttctttctctaatttcctctttttctttgggacccttcagagtcagagttggggtggaacacatttgttgagtgcttggtattatgtgccaggggcttttactttctgtagtattttatttaatgctctcagtagctataagatgtggatgctggctgggtgtggtggctcacacctgtaatcctagcactttgggaggctgagacagggagacaggaggatcactggaggccaggagatggatatcagcctgggcaatatagtaagaccctgtctctacaaaaaataaaaagaaaattaaccaggtgtggtgtggtggatgctattgtagtcctagctactcaggaggctgagatgggaggatcacacaaacccaggagtttgagcctgcagtgagctgtgatagcgccactgcactccagcttggttgacagagtgaaaccctgtctcaaaaagaaaaaaaaaacccataaacatgaaaaataaaataaaaatagaaaaaagatgtggatgccatggctcctattttaccaagaaggaaacagaaacctggagaggttatacaactcgcccaaagtcaaagagctagtgactgacagcatcaggatttgaaccctgggttgtgactccactagaccagaaggagcaggaaaacagcctggggggctggggttggttcctttgagtctgagctccttgcttggctggcatgagggcaggtggcataatgcaatggcaaagagcactgaacatggagtgaaaagatcagggttatagtctcagctgtgacactttaccctgtatgaccttggaaaagtctcttgggcctcagtaggccttatactgtaacttttaaaaaataccaatgtggagagtcctaccgcagatcaattaagccagccttctggggaaggggccctgggcactggtattttttaaaataacacttcctagctgattcttatgtgcatccaggggtgagaatcactgagcaatgtgatttagaccaagacttttcaaactttaatgtgtttgcccaagggtcttcttaaatatagtggttctgggtgtggggcttgggattctgcatttctaacaagctcccaggtgatgttgatgctgctagtctgggactacactttgagtagcaaggggctacagggctctaggtagtcatgaaagaacttggcattgacctgagtgagatggtccccttctgccaacccccagctagggccaatgcctagcatcaggggagggaggtgcctctcctaccctctccattagccatgagtaactgagggctgcagtgggattttaagggtgtgttcctggcatgcaggcctaccctagagatttgctccctttcctggggtggccatacttgtgaccctttaggggccactgtctgctcctgcgcctgcctctctggaagtcctaacctggtccattttctggcacctcccttttgtcctaataacaggaaagcagagctggctgccaggatgcgtgctaagatggggaaagggtctcatcccaggggcatgacaggaacagggacagggaagtggctgtggcagccagctcagctgtcctagcagcagaaccatgttcctcacaggctccctgggcagctccctttggactggtcttacatcacctagactaccactggcctggagcacaggatcctttttcaggcttgcattgccccctgccagacaggtggaggtactgctagcagggctctgtcagacactttccagggacccctcagaggtcctggcgattcctagatctctatcttaggttaggaagttgcagtaacataaaacatacatgtatgcatgcacacacacacacacacacacacacacggagagaaagagacgagagagagagagagacagagagacagagagagaaagagaggcagatgcatgcacagactgaggtgcctgtgggtatatacaggtgcatggtcccacagtgatcctcatgagtcatggacatgagcagatttggctacagctacatgtagagacagatgctgtggtgggcactgacctgttgcattcactcacagaaatgcagagatgttcatccttgcccttacccccatttgcccccaaaacctgcaggggctccaggggctgcagagccctctcttctttccctcaaatcctcatcagtgtgtgacccttgaggagcccattactttttctgactgacttctgacttcccccactcttccctccactgtctactcacctagcatctctgaaatactgttttgtccttcatcttatctgtcccagccactaggatttcatcctgggtttccttgtgagtgagcactgggaagagagagctcttcctgtcttggaaaaacctcaccagcctccttagagtcctctggtcaggggggccaggcgagactgtggccacaggtgctgaggaaatggaggatgtgttgggggcaggactccatggcaggatcagctctgctgaagccagctgacttccccaaccaacccggtgatgccaggtcccatggtcccagccccattcatcttggcatcacctgggtgggaagcaaataaccgcccaggcaggtgcagggctttgctgctggtatttggcctaccctgactaggagcgcctcctctgtggctttagtccagctgcacatctctgctggtgctggcaggggtgctcagctctgtgccagaactcccagagcagaggcgacaggctgacctagccatggccccccaagaccccgacaggccagtactgtgtcttcatgacactcagcactgcactatgacacaaataggccaagagggctggggcagtactgggaagctccctgaggagggaggactataatgagcatgggggtgctgctgtcagactcagctgggattccaaccctggcactgctgctttgtccactgtgagaccataggctgagcctgtttgtttgtctgtaaaatggggatagcaaagccatcaccagttattgtgtgtgtgaaatgagagttggctgtcaaagtgctgaagaatgttagatgcgatgatgagaaagagaatgataggaatggttgaacatttctacttcctgcctgggctaaggtggtctacccagggccttggaagggggtgagtccctcagaaaggctcgggggtggacacagctgtggcttcttatcccagcaggcctccttgaccccagatgatcctggttcctgggcagggggtgggagagtgggaggggtttggaacaggcagggaatgagactcaagaaagccagggccaggatgcccagacagtagggcttggggagcagagggcctcctggctggctatgacttggagcaaatgtgctaggacctctggccttctcttgccattgctagatcaccagaatgagacatgtctgcctgctggggttgggcagcatgcacctagggccctggtgtcagcaccctcctaaccccatttctttgcctgtttctttcccttgttctgttttagaagccgaggccaaaagagcatgtgagtggcttcaagcaacaggattccctcagtatgtgcagctttttgaaggtaaggccactcaactgtttaccctcccatacttcccctagccctcagtttttcatctgttagatggggcaagtcagattctctttccaactacacacaagcagtgtctcctggccctgctccgatttttttcagggactttgctcctgcagttgcacctttctctcctgcatcatctctaagggattgctctcacaactgccacaagctctgctgttgcccatgcctttaaagtaccttgtcttgaccagggtcatcacgtggtaccaatcctgaggatgccatgtaggtacacacggtgtgaagaatgccgcctggagttgtacaccctggtggcccaggcttggcctcacttgccccacagtgatggcctcatttctctgttttccttcatttctctttcgggtttttctagagttcttcgcacttgctgtttcccttccccttttctccccacacccctactgcaccctggcttcacctccacctcgcctggtcaacttgcctggtcaattcaccagtgacctccatgtggtcacactcagtggtcacttcccagtcctcatcttgctccatctctcagcagcattcggtgccactggccactccttccttcggcttctggaatgcccccctttcctggctgcctctctggctgggttctgtctccttagctgactctgcttcctctaactgatatctaaagtttaggatatcccagggctctgtccggggccctcttctctctcaacatttctttctcatgagatctttgtctaagtactatccatattctgatgacttccaaatgtccagacctcatccccaagctccagattcatatattcacagctgccaattcaatctctctactcagatgtctgattggtgtctcggattaaacaggtctgaaaccaactcatgatggtaccaccatttacccacttgctcaagccccatacccaggagtcatccttaatttaattcctccttgttcccatctcctatctctaacccttcagcaagacctttttccctccagaacgtatcttgaatcaatccactgcttactacctccactgccacagcctggtgtgacccagtgtcacagctcacctgggctagtgcagcagcttcctgtgctcttgcactctcatctctacactgcagctggagggctctttttggccataggtctgactgtcactcctgctccaaaccctccgatggcctcccagcacactcagaatgtaatacacacagacactctgctctggcctgtcagactgcattctccaacttccattgattactcttacctttgttcacagggctcctctctacacttgctcacaccaagctctttccctcttcagagccttgatgctgatgttcctcctgcctggaactctctctgcagtttccttgcacagctggctgcttctcatctttcaggactcagctcggatgtcactgctttcagaaagctctctgctgaccacctctctacaagcagcctccacccctaccagcctccctttacactatcatgctggctgatgtcttccatgactgcaccatcttggttttaagtactgttgcttatctttttcctttaagagtgtaaactccaagaaggcaggaaccgtttttgttgtgttcactgttgtatgctgtatggtttgctcaagtgtctggcacaaagtaaatgctcaattggatactcattagttgaatgagtaaaggaacaaatgggcttgcttcaccagtaaggtagagagctgtgagacttctcagattctctcttccattcccccaactcctttctttcccctctcccctccctaagtcccagggagtgtgctctgggccacagggggatgcaaggtattgtttggctactgtgctgtcctgtcccttctgtccttgctcccaccctactcccccaagttcaccttgggccaaggagaagtttccctgcctgagcagcccaggattcaaaggggaatgggggagcccgtgttgggctcttggcagccacccggggtcttgggcctgctatctcccatggacctgccttactgactgacagagttctttgggtccagctcagccctctaggcctctcccagacctttccctgaactccctgggcaccctcctttattcctgactttttttccttctgctttgcctcttgtcttcctgctccccctccttcctggccgttcccttccagcccaagggctgctgaggctgagtttgtgatataccactgcactcatctttgcttctctctgccatacagaaggttcgtttcccctggatattggctctgtgaagaaaaaccacggttttctggacgaggactctttgggggccctgtgtaggtaggtgggctgagggccaggcctgggaagccaaaggcctggcttgaagcttcctcgtggaaaaaaacatcccttgtaccctctaacagaggaggagcccagcttactaacaaagctcatcttctgtggtcacattgctcattctgttctttgtgtttgtgataccctcaaccacccagtcactctagctagaaagccaagatctggccttgtttcttttctcctaaagttatagcccccaaatattcctctgcttcagtccctctctacttacaccagcttggcccttgtttgaggccaaaccatggcttctccttggatcgatcacaaggcttcagcctaactggctttagtcttgatagcccatctctcccctcccctctccctcttccctcaccctactcccagatcgatctagatccaccagcgtcgcattgtaacagctccaaatggttgttctttctgcttaaaatgtgtcactgcctaaggataaaaatgcaaagactttttagcataccacccaaagccctttgcgagctggctcattagccttagccccattggtctcatgcccacactggtctgtttgctgactgtatacctacagtgtcctgtgtaagcttgggtaagagtccctgtttctctcaccttcaaaatcccatttgcatcctccaggaagccttctctgactgcatccctccttcatggaagttgcttgtctctccctgtgtttgtctgctgtgccttctgtctgctctgtctttgaacacgccccatttctgtagggtttatttccactctctttgtaagctcctggagggcagaggccataatcttcccagcattgtgtctggttcttaaaccttcacgaatattggagcttgcgagaagttttgatggcttgggcatgtgaagtggcaggtgcatcttggtaggctctgccaggctttggggatggggacccttggttggacacttccattttgttacaggaggctgatgaccttgaataattgtgcctcgatgaaactggaggttcattttcaaagcaagcaggtgagtcatggcaaagcgtgggtctgtggtcttgtggtgccataaggaaacccagggcatacgtaaaccatttgtaaaactagctccagtatcccaggagtctgagatgtccagagcagtgcctttccccagctaggggtagagatggaggagatctaggaccccattctttcctgggaacttgctttcttgcttttttttttctggggctttctataccagaggcctgtagtcaggtggggcagccaagtgaccaaagccctgggctgtgagacaggaggcccatggggcctggtctcagctctaccactgattactgagggacctcagggaaacctcttcccttctgggcctcagtttccccattttgcaaagaaggagatgaactagaaaatctccaattccgtccagctctgttgtgattctaatctaagactacagcctagagcttgggaaggtctgtcactgacttaatgtatatcattgaccttgggcaagtggcttctggtttgtaggtttgttttcctatctgtaaaattggaaggggggttagattaattagttgaccattaccattaccatacatctgggctctgtctgtgactgctggcttcctctggcactcccagagctagctctccccacctaggccatgttctcagccagaaagcagggcccttcacctcagagtcccccaagagtttggaagcagagagtggagtacaagcaaggacttgtggcctgggcttctctgacctgatcctgcagtgcctttcccagaatgaagactcagaagaggaagagcagtgtaccatcagtagccactgggccttccagcaggaaagtaagtgctggtctcctatggggtcctctgatctgttggccccaccgagccctggcctgccagcgacctcaagctgtgagagcgtcctcaccgagcttagtgccacctctctgccagtcatcaccgtgagcctaccacccgagccagcagacttgcccttgccaggccgtgcccccagctcgagtgaccggcccctcctcagccccacccagggccaggagggtccccaggacaaagccaagaagcgccatcgtaaccgtagcttcctcaagcaccttgaatctctgaggcggaaggaaaagagtggcagccagcaagcagagcccaagcatagtccagccacctcagagaaggtctccaaagcctcatctttccgcagttgtcgtggcttcctctcagctggattttacagggccaagaactgggccgccacctcagccggtggcagtggtgccaatactcggaaggcctgggaggcctggcctgtggcctcgttccggcatcctcagtggacacaccggggtgattgcctggtgcacgttcctggggaccacaaaccaggcacattccctcgctccctgtccattgagagcctgtgtcctgaggatggacaccgcctggcagactggcagccaggtaggcggtggggctgtgaggggcgccggggctcctgtggctcaacgggcagccatgccagcacgtatgacaacttgcctgagctgtacccagctgagcctgtaatggttggggctgaggctgaagatgaagatgatgaggagagtgggggcagctatgctcacctagacgacatcctccagcacgtgtgggggctacagcaacgagtagagctgtggtctcgggccatgtacccagacctggggcctggagatgaggaagaggaggaggccacttcatcagtagaaatagccacagttgaggtcaaatgccaagctgaggctctcagccagatggaggttccggcccatggagagtccccagcctgggcccaggctgaagtccagccagcagtcctggctccggctcaggctccagctgaggctgaaccagtggcacaggaagaggctgaggccccggccccagccccggccccggccccagcccaggacagtgagcaggaggcacattcaggcggggaacccacctttgcctctagcctgtctgtggaagaaggacactccatttctgacactgtggcctcctccagcgaacttgacagtagtgggaactccatgaatgaggctgaggctgcggggcccctggctggactccaggcatcaatgccccgtgaacggcgcgattcaggtgttggggcctcacttaccagaccctgcaggtgagagtttgggttgggatggggcggacgcagggtctcctgttctctctctgtctctgaagctgatttctcagtcatgaggcccagggctaagtgcttggcggctgcgttatcccctcacagccagctcaggagagagagtacaggacttgggaatccagaaagttaggtccagaacctgcctgtgctgtggccttgaggaaatgatgctctcctctctgggcctcagtttcctcatctgtaaagtgagggaggatgctagaggagatggtctctggtccccagctttgcccattcagggtttcttggagcagcccctccacagtagtcttgggatgggcaggggtcttcactgcttattggcactagatgggcctgagctctgtgccaccctccccaagaacttcttggcccctaagaagctgagtccaagctttttccaccctggggcctcagcagcagcactagaaagtgttcccagctccctgcattttttctttggggagaaaaaaggggaccacaataacaccttttctaaggtttagccaaacctgctcctctgggcttctccacccctctcaccgccccccaccaggaagctccgttggcatagcttccagaactcccatcgtcccagcctcaactcagagtcgctggagatcaaccggcagtttgcaggccagatcaacctcctgcacaagggctcactgctgcggcttaccgcgttcatggagaagtacactgtgccccacaagcagggctgggtctggtgagtggctcctgggccatggagggtggggaactgctgactcaggtccacgtccccaggcagggtcagcccaggaggtgggtgcaggcaggcagggcccacaggccaggggagcggtgagatatgccaggaggctggaggggcttggtgaggctgggtatggggcagaggacctgaggtcctccagctgtatcttctccatcccaatctctgtgctgcaactagtgagattgtcctaaaatgcagctgtggttgtcactctccagataaacacttttctctggctccccattgtccagattccctcccaccatgactccttcctgttctggtcccgctccatccttctggctctttagcctaccgctcctaagcaaccccaccttacagaccagtgggaccagtcatccttccgtgaacgtgctatgatctttttcctgcctctttgcctttgtttgtgctgtgctctctgcctggaatgcattttccccatttctcctctgggacaatgccttcctatccctcaagagcctgctgagttaccacgtcctctccgaagccttccctaactcactaggtacagttcccctccctcaatgggtcttcccctaagttcttggcctcctactggccacatgagttgttactgcctattgacacagttatctccttggccagactgagagctctctgtgttcctctgtgactccctggggctgggcccaaaacaggtgctcaatgagtgttgactctggggcagtggtgtgtgccttacccccctcaccccacctgatcctctgagactgcaggcagagtctccaaactgtgttccccctatctgatcacttgtcattctcccaaacaggtcaatgcccaagttcatgaggaggaacaagaccccagattaccggggacagcacgtatttggggtgccacccctcatccacgtgcagcgcacgggccagccactgccacagagcattcagcaagccatgcgctacttgcgcagccagtgcctggaccaagtgagccctcgtggggcagcctgccgggagatggtgcaggggtggggtggtggtgggcattgggctgaaggctgaggagctggggagaggaactgctctggccttccccctcacttgggctggtccaccagaggcctttgctgttctcagcaaggaccagcaaggatgaaactcctttctactccttatgcccagctctgtgctaccttctttctggcccaggctctgtagtccttatcttctgggagcctgaatttgcctagatccacctttttctactcatctccacaaaagcatcttttttcttttgtcctgaagctgtaaaaatccttctctttggttttcccatttgtctcctaccctgcccctcaggaggcctgataagctttgaagtctctggggtggcctaggctcctgacacccagtctagggctggcctcacagtctgcctcctactcatgcatgttttcctcactccctccctcccctgcatggagtaggtaggcatcttccgcaagtctggggtcaagtccaggatccagaacctgcgtcaaatgaatgagacctcgcctgacaatgtctgctacgagggccagtcagcctacgacgtggctgacctgctaaagcagtatttccgggacctgcctgagcccatcttcaccagcaagctcaccaccactttcctccagatctaccagcgtgagtcgcccactcctatccccaacaacctgtcccattctcaacctccctgaatcccagaacttgtggaagataaacctggtgcaggcaaatgtagctggacctgtgagctgattggaacagttactatctggagttggaatggcccttgcagagagaccattctgcttccccaaacccattatatggaaaggtagactgaggccctgagggaagaactacataaggttacactgtatgttagtaataaagctagatcaagcacccagagacctcacagaactgacattttcccttccctctcaccgctccccttgggactgctgtgccttttgcccccttggaaacaggaggctggctgctaaggcctctggggaagtaaggaaggctcttcttccattgcttcctcacagtcctccccaaggatcagtggttggcagcagcacaagccgccaccttgctgctccccgatgagaaccgagaggtgctacagaccctgctctacttcttaagtgacattgcctctgccgaggaaaaccagatgacagcaggcaacctggcagtgtgcctggcgccctccatcttccacctcaatgtctctaagaaggatagcccctctcccaggtgaaatggtgcacggcatgtcagggccgggctgggtccagacaatttgggccccactggacttttggcttttgatggctggcactgctgtgtctcagcctcaccacaaggagtgagcctgactcctcaggggccctgggctggtgggatgctgtggagcagggccttccaaaaggcagcaggttgttttgtggccaggtttggcaaagtggcttcctggcagctagaaggcagcctgtctgccatcttgtcttgtgctcttgtgccatctctcctctcaccacctcctgctccatctaggatcaagagcaaacgcagcctcattggcaggccaggccctagggacctgagtgacaacatggcagccacccagggcctgtcgcacatgatcagtgactgcaagaaacttttccaggtgagtaaccccaggccatgacacctacttaccagacctgggggaaccatcaggcctgacctcggtgccccaagtcagggataggacccaatttgacacatacccctcaagcttatacccccaactcttcccccacaatgtttctcatctaccttgctgtggtagctgcacctctccactgcccttaacgtgaacctgacagaccccatggggtctcctgctctctggagctgcagcccattgtgtgtgtgccctctcaggtgccccaggacatggtgctgcagctgtgcagctcctacagcgcagctgagctcagccctcccggcccagccctggctgagctgcgtcaggcccaagctgcaggggtaagcctgagcctctacatggaagagaatatccaggacctgctgcgtgatgctgctgagcgcttcaagggctggatgagcgtgccagggccccagcacacggagctggcttgcaggaaggtgagtgccacaccacgggtggctgctatggggctgggagagcatggtgcaggcaagggtagtcagagaacccaaaggaaggagccggggaggagctgccgcctgagtctcgctgtgcctcggcctggtccttggagaatgtcagagagtcaagaaagtaccttaaggaatcaagaaccaaatgagaccaagggaactctctcaggaaccacctgccagaatgaccttccaaaagccccgttccagatacgatgctgctttgatagcctcaactcccatctctccctgccccgcagtccagctgaatccttgcatttgcacctttgtgcggtcctgctgcctggactgccctgaccccaagcattacgtctcccgagtcacctttagcgacaacggaatgtgttcctcctccattcagaaccttctgtcatgccccaggatggaggggatttctctctgttcccctctgggcactggtcatgctctttcttggacgtggattctgagtaagattgcaagcctgaagtgtcctgtgtaaaaaaatggtcataacaaaaccttccatgtaggatcagggtgagtgtgaatgcctggtacatactaaaggttctgtaagtggcagcttttgttgtgcatgtgttttactgcctgtgctagatggcaagctccttgacaatcaccatcttcctgcacctccaagcactgtgcccatcatggtagggcctgagaggcctctgagaatgtgtgccccgtcatctctttatgctgtctaacagactgaaaagcagacatccagaaaagagagagagagggcagggagcatgggagcactgtctcagtctggccagcgctagcagaggagctctgcagcctaccctattaagcctcaggccctgcagtttgaggcctggacttagggctggagtcagagttctccagccctgacagctgcccccatccccactcctgtggctcacaggcaccggatgggcaccccctgcggctatggaaggcatccacagaggtggcagcccccccagctgtggtgctgcatcgtgttctccgggagcgggccctctgggatgaggatctgctgcgggcccaggtgctggaagccctgatgccgggtgtggagctgtaccactatgtcaccgacagcatggcaccccatccctgccgcgactttgtggtgcttcggtgaggggctgcagctgctacccttctgtgcttggggggccggagaagtggggtggaaaccagcactaggaatctgagcctacgtgtcccttctccaataggatgtggcgctctgacctgcctcgtgggggttgcctgcttgtctcccagtccctggatccggaacaacctgtgccagagtcgggtgtgcgagccctcatgctcacatcccagtacctcatggagccttgcggcttgggccgctctcggctcacacacatctgccgggctgacctcaggtatcaggcctgggacagcctgctcgacccccttggccttgaccccctcccctgcctctgcccctactttctgccccatgctattgatccctggggctggggacaagtcctttcttccttctccctggtgagggctctggggaaaaatccattgctcatgcctggtttcttctgcttccctaggggccgttctcctgactggtacaacaaagtctttggacacctgtgtgccatggaagtggcaaagatccgggactccttccccaccctgcaggcagcgggccctgagacaaagctgtgagccttgggctggtcccagggtggcaccacccaggccccctgggcaccaagggagcgagggggaataagagcagggcagccccctgggtgccgctgtcaggagcagagccaggcccaggtggctccagctgcctgtcctgtcccctttcctaaagctcctctgcacatagaggggagaaaaagagaatttaggcaactccactcccccttcacccccaaccctgtattctactctcccgaaaagagaagagaatcgcatgagtagcaagactgctgccaccagccacctgcttgtgaggccgccacttggcatgaagcctccacagctccccgcctgcaggggcaaagaggtcgacagcaatgtgtgatcccagctctctgccagactgagagggcaagccgtcttgtttgctgcaaggatgcttttgaggttggacaggaggttctggtcctgcctttggggccaacgctggctctgaagtgtctttttcagaggaattggactggagtgaatgggcacaggggtggagcgcagggcagccccagtcaccacgagctgtttcatttgtgtaaatacgatgctgaattttatgaggctgagttaagagtgggcactgacgggcccctaatatgtgacatgacgatttggcatagatagggatgtgagagtggagtaccttcctttctcaagtctcgagatgccagtgaaaccagtattccctgacttgggtttcacactttatcgaccaccccatggggtcctgtgtagcctttggccacgcactgacactgcccaggccaagcaaaagcagagtgtggttaagagacaagggtctatgtcatcatcccttttgcttatggtagtgggctaacataacagcccctttctcaagcagagacctggcccctgggccagccagatggaagggcctatcttagccagctggagcttaagccaaacctgttctgtcccactggccagccatctttgctcacatggaaattcaaatgccattcaaaggccactggtgctttatttttctatctgctgagtaaactgaaatgagatgggtcccaaccaccactgtaattttcaagcctattttatttgtacctgtaaatactgtacagctaatatatatatatatatatatatatgtgtgtgtgtgtgtgtgtgtatatgtgtttatagagatacacacacatatatatgtgtgtatatatatacacatacatatatatacacacacgcatttgcacagacacacacatatatcaattctcatgagtgtattataatctctggtgggggcaagtgtctggaaggcctgaggggcacttcagatgagaatggagaggtagggagccaggtgcagcaggatccctcaaatcaataaagcattaccagagatgcacttt

SEQ ID NO: 4668 - DNA, 13150 bp, human
cacagcggcagcggagggagtctatgcgagctggacagcagtgggaggtttgtgaggctcgcactggccgcagaccctcgggctcgatcgcccgggagccaggactcggcgacgcgaggctgccgggctacccggccgaggcttcgggggcgcaaactaatgggactggctcgctcggcagcatctccccgctcttctaagtacactgagcagggcccgcgctgaagtagaagctgtccgggggcgcgtagcccggagtcccagtgtggcccggaggaacggagcccgtgccagggcggcccagtcgggagcccggggaccgagcttgtgctgtggggaaacccccacttcttccaagggacagcgatcccgggacggtcgaggcgtcggggcggtcaccgagacctctgcgggaagaccccgtcggggagagggcgcgcagccccgaagcgtctcgggaagtcgagcggaatcgggcgggatcacccgggggcgcagagcccccgtcgcgcctcgtgcggcagcggagagcccaggagaacgagccctcgggggccgaagcccatgcccgggttgggggcggctgcccagtgagtcctcctggccggccgggcggagaagagcgacaccgaagccggcgggaggggagcacttcaaggccggcggctgcggaggatgggcgcctgagcggctccgagcgcagcgcggcagaggaaggcgaggcgagctttggtgaggaggcgccaagggatcccgaagtgcagtctgcccccgggaagatggctcggcctgggcagcgttggctcggcaagtggcttgtggcgatggtcgtgtgggcgctgtgccggctcgccacaccgctggccaagaacctggagcccgtatcctggagctccctcaaccccaagtgagtaacttatctcctctggacgctggggtgggaggcactccttcagggtgaggccgcacgccccggagtgcatgtggggaggtcttcggaggaggagcggcgcctcattttgtctccggctttttcgagtgttttcctgcgggcgggcggatggagcagggtgcggcggggtggggtaggggcacttggctgggttgtgaccccccgggcttcccaccccctgcctctgcacgtcttggatgaagtcgaggtggtcgcacaggcggagctggggagtccgggcgcccgagagcgcaccggagaactgagtggaggcgagaacgcagctccctccggggcccctgggaacgtggtgattttcgccgagagccgctccaggagcgagcttgactcgggcgagggacgaggccagaacacgggttcctcgtttgcgtagctgtggagggaacacagagcgggacccggcgcttggggtgggtggcagcgccaacatccccactcgggcttctcccattttcatttctctttcttccctgttttcctccctggctttttgctttgctgtctctttttgccccccgcccctcctttctccctgccggagcggtagaaaggcgggcgctgctcccaggctcacaaaggcagcgggtggagaggggcggagtgggagagtggtcgttgggtagtgggggttcgaaccagtgcccgtcaggggtccaatggagccggtaacagagcttcaagggcccgccagggcggagagtggcggccgagctgttgagggaggtgggtggagaaggagcgattcctgcccaggcaggtccccttggcccccgagtctgtcccccagattgggaagctgtgcttagttttccccaaggggttggggcggggagtgggcagctatataaaggacatcctttcttttctttcttctccttcctctgcacaactaccccaccaccaccacacacacaacccctccaaacaacacgcacacctttcagggcggtggctcagtggtttctgggcttttagtgggaagtcgctggggctgttgtagtgacctctggaccttctcttttggcatccaggactcaggttggaaccaagggtcaaaattgcccttcctctcaattttctggaggtcccagcaatgtgcgaacaaccccacttagcaggaaactggggagctttgacctgctccatccgtgatcactgattcctgtatctcaaatttcttcctgtccactcttgctgccccacgccgcctcccccccagccccgccctgccccgggtaacttcccaggctcctgcctaccttggcctcttgggtcccagggacgtttgatctctcagccctggagtaggagaaggcagctttagttttcttctcctcgattaaggtagagtcctattactggttggtgggatggctaaaccagggttggggtggagggctctccctgggtacaaggaaagggattggcaagaatttctttcctacccagaagccaaacggggtacaacactctcctaacagcaggggctcaaaatgctctgggagctctgggctgcttgagcccaggggggaacgttgtgaagtgctcagtggttgtgaagtgctcagtggttgtgaagtgctcagttaccctggtaagggtggaggctggaaatgttctgtcttgagccaggagagttgaaatccgcctggggtagcccatcataggggctcatgggagtgacctaattgctctctcgggtctctaaccagagatagcatgcagctccacagctggaaaggagccctcctgcagagttgggggtgctggaagaaacacgatctgtctgtgcttccccctttttgtgctcagagactttagtgctctggactggcttacaggttttggggggtggtatcctctctgacccccctcctcatctacctcaagctgagggcaggcattgtggggtgaggatggggggtggctgaagactctctagaaactgtccgaattccattctgtaattgggtagatcctgggaaggatcagagactgatcctggtgcaccctccttccatccaggctcaggggtctggaatgcagccactgtctacatgtgttggctcggggtggtgggggcaaatggacaggaaggaggcactgccctcagctctccttgagctttgggggctgcttctgccaccgcgcccaaccctcaggctgccacagcctttcaaataaacagtccctctctgtctccctccctctctgcctcctgcccgagttctcctctcaggcccgtgtcagttcgccctctcataccctccgcgagcagcgctcacttcccctctccagctaggctcgcctgctctgccttgctctcacactccctctcactcttagtcactctctgcctctttttctcaagtccttttgtttctcgcacatgcccgtgctctccctctcaggctcattttctctcttccttcccctcttcctctcctggcttttggtctctctcctcagccctgtcagaagctggcaacccccctcccaaaaaagaaaatctcccagtgcctataaaccctgcttaattgcttccttcttgggaaaaaaaaaatcaaaataaaagaagtggtggggctgggggtccgcttccaggttccaaggtgcgtgcggcccggccccagccctgactgagaggggaagcgggaatggctggcccaagactcccaagcctctttcccaaattggtgctggggccttctgggatgctagtccctgagtggcaggagcttctgcctccttggcccctcctgtcagatttgccccatgagcgcaaggtggggggatgggtttggtcctgctagagttttttttaggaacctctgtgtgtgcgtgtgtgtgtgtgtgtgtgtgtgtgtgtgtctgagttggggggctgttatctaaatggtcctaggcgacccctcccgcagcctcttcccctgggaacttggggcagccggcaggcctcacacttgagtcctcagccaagtccagctgctgcagttcagtctctcagtcccgtcctgaccccttcctgccccccactcaggttcccccacctccagggagtcagaatgtgcctgagatcacattacaaacattccctacaagggggtgggggtgggggggttcagcttggcatccaggacccttgactccagcatgggtgggggcagctgcagaccccaacccatgcttgcctgctccaagccaaagtgttggccccagccccacacagctgttctagctcacagtcctggggaggccagctcagggggcccttttccggggtggttagggacctgacctcttctactttgtggctgattggccacaggtgggagcctgagagtgatgggaatccagcagctcctaaagtcccctgttcccctgcctcccctctcccacatagggcagccaggcaagggcaagaaggacctgtgaggctggggtggggactgaatcaagggttccctttcttcccttgggctctctgttgtctcatccgctcaggtgaatggggatgcgtgggccctggatactatggtgcatcactgttttctggggttagggactaaaggagatagagtgggccagccaggaggctgctagttgccatgggaacaccaggtttgggggagagtccactctgtgactattagaggagctgagatacgggggtgctcaccagccacattctgggttccttaccccgcagaccatagcagcccctcttgggcgtgtttcacgatcattgttttgggtcagggtgctagcagccaggaatgtaagctccttcagctttttacttctaaataatgctgtgtttggcatgctaactaataggcaggcggcaccttgctacttacaatgcattctcatatatgatctcatcgaatgctcccaacaaccctgggaagtaggtattggtcccattttccagataagaaggcatatgcccggacaagggaagtgacttgtctaaggccagtcaatgacttgcctatgggggcagagctgtgttgtgtgccattcattcctgctgccttgaaatgtaggagagacaggaattcaaggtggggtttgggaagaggccctggctccctgcccctgagttcccctcttacctcgcaggtgtgcaagcatctgtccctgtgactcaggccctgtctgtgtggggtgagcagtgctccaacttcctcatttgacttttctaggcctaccttccagggctgactgcttgggtgacctgaactaaaggcagccaactcactgcctggcacactccctgcggagctctgagtggcacctttggttcctctctgagctaagaatctctcttctcagggaccccacagaaagcagacatcgacatcgaggagggggggtattaaattcataatggacacgagccttagccaggtggggcagagggaagggcatagttcagtgtagatggggagggtgacttcctccaggactctcctggcttccctgcctctgacagagctgtgtgtgccaggacccagctgctgttcctgcccacccacgcctgggcgggcactgctgggacatgccaggcctgctcctgccagcctcgggggctgggtggagctgggggagttaaagaggagcctttaatttgggggctccccaccctagctgggatgagaacagacttgagctctggcttggggtctgtcctccattggtcttgccaccctgggaggtgcaggtgcagtggtcgtggggtcactgaatcgaggttgaggctagaggcttctaccagacttgggcttgcatggcctagaaccaggctccccctttggtcattctctgaccacaagttgctagagcctgagagcagggtgacagggaaagaagtatagacctggtgggatgtgggcagctttctgggcaagaccctcctagctgcaagctctccctgccccctgtaaattgtattcacatgggtggagaagggcttatccggagaaaacaaggagggggctgttggttagttggtttctggccagtccagggccttggaggctactgtccccaaccccttcaggcttttcatatcccaggattctttgtggcagtgatggcatcgtggtgcttctaagctaggtagaaaggctgaaggtagaacttgggttagggtagagggggaagagctggaatagcttaggccgcctcccccaagtccttttactccctggggtggcgccctggggtcccagggctatctgaggctggagagggaaggcctcaggggttaccatggtgacctgcttcaggcttcctgctgagccatgtcaatccctttatttttcagaaaagggctttgtctgggggtggccccagacagaaaagcttggcttggtcctagggtggggggaagtaaggtggaggataaagagtttcacttcgggatatctcttcctcctcttcccttactcctactcctaatctggtaagaggggagaactgtagggtccccctttaaagtatgactagtgttctacctagctttggccttcactctcactggctatacacccatcccttatggcccgttaccactctcttgagcttctgacaggtcaagacgaggtttgcccagtggtcgggaagatgctaaggttaccagtatgggggatcagggtcagggaaggcgggtctcatcaggctccgctcccttctgcacttcaggggaaggtgagtttccctctgccagctgccatgcaaatgaactaatgaatatttatgaagtctgttcactgaggttgaagagactctgaggggttttgggggcaatagttctctcttctcccccctcctccatcatgtagacatctgtttcctcaatgcctctggcttcaaggtagaaccccaattagctagaagccctgttccaattccagggctctggaacctgggtggcaatgggagactgcacttggggtagacaggactccctggtgagtaagccagaaccgagtggttagaaagctgagctggcctgtctccctttccgtgccctctatgtagctgcatatatatgtgttgttaagatgcaacagtacaaggattcaggtaatgttttagggcctcttagacccatcgggttattgtcctgggtaggtttagacccctcttttcaatgggaacattcatctgatcattcattccctcacatgaagggcctggactctaaggttcctgctggctctaagatgtgagcagttgtctaatcctgccatctggatggaaccgttgtgagcactggaaagggaaaaaatgcctggagaattctagaggctttggggaaacttgttggctttgtatggtgcatgggacaggggtattccatctgaaatgtttatccaggcttccatcccatgcctacttcctttctgggccctctatagttaggtaccagtggggaggccatctcattctggcttttaccctcctgcacatcaagatggcagctcccaatttggtggagcctcactcgacatggaggaaaggctgcttttcttcgtccacttcatccatgtggtcagtttccctcttcgcctacttgggtatcatttccctccctcagatgaggacacaggtttggcattgcaaaggcatttgcccagagttcccagtaggccggtattgcttgtagtacctttggtgtaatgggccctcaggaaatggaaccactcttttctcagatgattgtggtagcctgtgaactggtgcatgacactgtcagcttcattctctttaagcactgcctgaagccttccattgtccttcctgctctgagagcctgtctccaatgggatgaaacccaccctgcttgctgtgacccttgaagcctttcagtctggccccaggtgaacttttcacctcttcttctgtttctctcttctcactcccagccaagctggaccaatcactggcctgggctttgtgttgtagccactgctgtctactgtctcagtgtgttgacttcttattcctcacctaagacccactttcatcctgcctttcctgtggatacatctctgaccatcctggtcagatgagctatctctttcttctccctgcctccagcccttgctgcttgaatcatcatcctcacacatacctacagatagcctggtgttgtctatcactcgagtatgggttatttacttttctgacccaaactggacagtaaagtccttgacgatggagccatatcttctcttcctgtttcccctccaaaatatgagagtgagctcataggtacttagtgttagtatctgacctcctgcctcttgggagactgcttctaagaggcagtcaaacatgttgaacgcctattgtgtgctaggtgttctccatgtgctgccttgtctccccaccacaatattggaaggtaggggctcttgccacccccactttacaagagaagaaactgaagctcagaacaggcagctcatccaaggtcacagagttagtaagggcctagctttggaatctgattctaaagtctgtgttctttctcctacatggttctgccttgctctcagcaccagcccatccagtctcagaaatggccaatggagcaccattttctttctgtgtgcttaggcaaggacagagtcctatggataggtggtcctgggctgctgaccctccctgctgtcccccagtgcctggccttctggattagaatatgaacctggctcaaaaggcatttgtccatctcctctcaggagctggagtaggagcaacatagaggtgacaggttaggatacagatgaggccctatcttctatgatctgttgtctctggttgagccccttctcttctcctctgttctttttaagaatgagatgaatcaagtttaggaattcaggctcttgcattttgagggtgggatgaattgccagtaggacaataggcagtgggagtgagcagagctgcacctggccagagactgtggccatcatccctttgctccaggcgatgcctgttcctatctttccatcatgaccaagattagtaaggatgggggagaagacatgggtcccagacagattgagctcccccagcctttggctgggagctgcggggagtggtgactaagacatgtgtgggcttgctgtgtgtgtgtgtatgtgtgtgtgtgtgtgtgtgtgtgtgtgtgtgtgtgtgtgtgcgcgcgcgcgcgcgcacgtgtgtatgggtataggagaggtagtagcagcggtcatgaaggaatctttgttgggggtgggggtatataagactgccacctccaggtagcatgggcctgacaccttggtacccagcccattggccacgtcagccccctgcggaaatgccacattaggacaaagggctcccccagccaggcagtgctccaccctgccgagcagtcagagcctggcagccttgcccatgggccaccccttccacactctcctggtagtgtggttctctctccccacccccagcctgaggatggaggaagggcagaaggcttgctcttgccatctccacccagtaggcccagcccggctcttgtccgcttccctggttctggaatggcctggggccacccccaaccctgaggctgaccatcttcttccttctgggcaggttcctgagtgggaagggcttggtgatctatccgaaaattggagacaagctggacatcatctgcccccgagcagaagcagggcggccctatgagtactacaagctgtacctggtgcggcctgagcaggcagctgcctgtagcacagttctcgaccccaacgtgttggtcacctgcaataggccagagcaggaaatacgctttaccatcaagttccaggagttcagccccaactacatgggcctggagttcaagaagcaccatgattactacattacctgtgagtcccgcccatcccatcctctggctctctccctgggcttaactctttcctctcctgtagtagtgggagcttctaagtggtgcaatgctattgcatgtagttaagaccctgctggatctgatcccctttgaagactggcatgttctcctcttagcctggccttggaattctcgccccaacatttaccaagctcaccttggctccaggggttgggcaggagaggtctccaattcgtgttgcttctctcttattttctttgcccacctaagttctaatattgggaatggtaacatatgccaggccctttgggatcagccagctattcagcctttttcttcaggggaaaccaaggccccaaaaggtgaagggacttcttgccttagatcacacagtgagttagagatagggtcaggactccaacccagttctcctgattcctactccagaattcctttcagtctatgtagaagcccccattatgatcccagtgaggaggcagaccttaccgaggggccatggcctgctcgtgacagaggagcagtgcccctgggggtggggcttgttcttggcctgggctggactaggccattttgttcctagtgggagggaagaaaatgaaaaggttcactggtagatgggagctgcttgcttctcccgactgcagtttctctccctgttggctgaagcagaatgggagtttctgggtaatgctagtagacctttctctcctcctgacttctctgacttctctggcctcttcctgcagcaacatccaatggaagcctggaggggctggaaaaccgggagggcggtgtgtgccgcacacgcaccatgaagatcatcatgaaggttgggcaaggtgagtgcctagtctgagggtcccctcaccccaccctgtttgacctttggaacagatgttcctggctgggtgcatgtgtattaggagtgggggagcaggcgtagggttacagtatccaggccattcttggcccacccttgatgactgagggcacctatgctggccgggtccctgcctctcacctgttctgtctccattcttagatcccaatgctgtgacgcctgagcagctgactaccagcaggcccagcaaggaggcagacaacactgtcaagatggccacacaggcccctggtagtcggggctccctgggtgactctgatggcaagcatggtaagtgtatgtgtttcccagaggtcaggagccattgctctgtcaccttgttaggccctgtccctgaagaaatgcaagctgggcctggcctgaaatctgctgtgtgtccctgggacccctggctgactgttccttcccctttcccttcctcagagactgtgaaccaggaagagaagagtggcccaggtgcaagtgggggcagcagcggggaccctgatggcttcttcaactccaaggtggcattgttcgcggctgtcggtgccggttgcgtcatcttcctgctcatcatcatcttcctgacggtcctactactgaagctacgcaagcggcaccgcaagcacacacagcagcgggcggctgccctctcgctcagtaccctggccagtcccaaggggggcagtggcacagcgggcaccgagcccagcgacatcatcattcccttacggactacagagaacaactactgcccccactatgagaaggtgagtggggactacgggcaccctgtctacatcgtccaagagatgccgccccagagcccggcgaacatctactacaaggtctgagtgcccggcacggcctcaggcccccgagggacagtcggcctggaccggacctctcctttcgcccccacaccccctccccttgccagctgtgcccacctttgtatttagttttgtagtttcttggcttttataatccccctttttccctgccccctgggcttcggaggggggtgcttgtgcccctaacccccatgctcttgtgccttccccctctggccaggcctctgggctccgtgggggcgccccttcttggaaggcagggctggacactgatggacagcaggcagggagacagtcccctggccctgcccctccctcgccccccttgccaccttcccaggactgcttgtccgctatcatcactgtttttaatgcttttgtgttcattttttagctgtcaactcattttcatctgttttttgaagaaaaatggaaaaatgtaaaaggcagcccctccccaggctttgtgagcctggcccaagccagtacaagagggcctggggcacgatgtggtcagccaggaagcataggatgccatttcttttatagattccttggtatttctggtggggtaaggggcaggccagggctgttcacgcccatgagggaagaggaaagtgccactgggcaaggtgtcccaccctcccctcctgaccctcctacgaggcttatcctggcaatggggtagtcactgccacccttccacacacacacacacacacacacacacaaaaaaaaatcccttccttgtgggattcttgggcatctcctgcctccctcactctcacggtaattaatgtcttaattggctgttgcctggggaacaggagagctgctgcaggcagatgacctcatggggggtggagggaggtgaggtgcccaggtggctatttgccctgcagagctgggagtttcacccccaccccccaccctgttctctccttacctttggcatcctttggcctggtggggaaacagaggcccagggtggagacctaagcgggtataagaccaggtggcctgctccttttctgggccctagcacaggtgggtaacccccacccaacccagctcctgctgctgtcccagtcttgggctggggcctggaaagaggaagaggctgcctggggctgggccagcccgctgtgcactttgaccccagttccttgccagcacggctgctaacagactgccacttgagtgcgccttgcaggcactcccagagcagccatggaaggagctggccctcacaccatccacctccacactgcctcctggccagctgcccaccccagtgccaggtgggagagggagcagaacagccagccccttccaggtggcagtcggaagggtttttgtttttgtttctgttgccatttgtgtaaatactagtctttttggaaaaaaaataatgtaaagatgttttgtataaactctgaattattttcttgttgcttttttcttagaaaaaaatgagaactaaaaaaaaaaaa

SEQ ID NO: 4669 - DNA, 30367 bp, human
ttctcccccgccagctcgccagctcgggagcttcttgagagcagggtccatggcaggctttgctcaccattgcgtggctccaggctcagtgagtattagttaaatgaacaaaaatgaatgcatgaccatccatgcacttgggtttttaaaagctttcatcaaaaacaaggcacctggcagcctgtagtggcttgggggagggcgaatttgaggactcgttgctcctggctcacctctgctgagtggcgtgggtggccagccccccttctcctctctcccctgctgcctggggaagctctttagaaaacaggcaagacagcctgcacggtcatggctgctggcaggagggggatgctggagacggtgtgacaccctcccctaccaatccccccacccctgctccaccatgcacaggcacactcgaactccctcaccacctccttctgatggaagccatctcaaatggccagtttttgctttcagaattaccagaaacaattgagcagcctattcaattctaatgctctgttcacaatctcaccagtcagcccctttactctgttcccattgccaccatgttaatcccactcaccaccatcttccacctgagctgctccaacagctacctccctgccccctttctgtccttttctcttccccctcgtgccctccctcacgccatcttccatgaaacagacagaaggagtgtcccaaacagaaatcatcccacgttattcctagccagactcacgacagaggcaggtgcatttttactatttttgtggcatgacagagtctgtgtaagtcactgaagcgcctagaggggaagcaggtagagctactagtccattaatttagtctttaaatgtttgttcccttaaatgtttggctttggaccacgcatgagctagtgagcccagagctcacaaggatgggaccaatatgagtttttaccctaatggaaggaacagaaaaaaaaaaaaaacaatatgtgatctgcactttgtagagggtgctatgggaatgtacagggaagtatgtttgtgcagaaccagatgaaggaacatttgagctgggtttcctatcagaaattgttggttgcaagcaacagaaagcatctctgattaacttaggagagaagggaatttatggggttggaggggtaagctatagggagcttacagaatcaagggaaaagctagagaaccaggtatggaaatcgacataagcaaaggcacttcttggggaggggttgggaaggaataggaagcaggaatggtttgatcaggatgttgccaataacatgaatgaagtctgtttcctctattcttatattgcttattccagattcaaagtccaatgagactgtccagtcaccaagcttagtcccatgctcgcctcctggctatactgggctgagggggggaaggcaacttccctttggcttctatggaaggaggcatgcatggatttattgtttcaccaacattacccacaatcaggcagagacaattcactaaactggagcctaaggaaaggggaggaatgaaggctgggaagccacaaaccaacaaatgtccactctctgcttgatggcagcaaaaaaaaagaggaagagggcattctagccagagagaaccgaatggacaaagaaagagctgaagcctgctgtgctcctggcaggcaggcagcaatgtgtgactggggcgtaagaggaggaaggcaaagagccacagatgagatgggaacagggagaagacagatcacagtgtgccctgtggagtgggccctagggagccagtctctgggggtggggggtgaccacattggcattttagaaccttcactctgggggtgtcaagaatggatcagagatggcaaagttggagatggggagaccagcaaggaactcttgtaggcaagagatgatgaggcctgaattccaacattggtgatgaaacggaaagaagacaatggattcaagagcaatgcaggacctagaatcctgaagtttgagggggtggaggatggagaggagtaagagatgactgtgtgtcaagagggaggagtgagtttgggagaatttgtgctttcttcatgggcttcaagaagcccacaaagaatgggtgttctctcagcactcattcaatcagtagttaatgtcagcctggccccactagcatatactctattgaaaaaggtggggagagagtgagaactttgtttttttgagatagagtctcattctgtcacccaggctagagtgcagtggtgcaatctcggctcactgcaacctccacctctcgggttcaagtgactctcgtgcctcagccttctgagtagctaggattacgggcgtgcgctgccatgccgagctattttttttttttttttttagtagagatggggtttcaccatgttggccaagctggccaacttgtgacctcaaattacccacccacctcagcctcccaaagtgctgggattacaggcatgagccacccacacccagccaagagtgagaactcttaatgggccctctcatactctgctggtgggaacatacactgatgcagttactctggagaacaatctggaagtatgttttactgttttaaatatgcatacctcagcacgttgatttctagaaatttgtcctaaagaaataacaagtgtgtacagataaacataggtacaaggatggctcaacattgtttataaaagtaaaaaactggaaactacctcaatatgcatcaacagggaaactggctaaataataagccagtagggacagaaaagagagaagacactgaccacatccctggcctctgcagcctgacaggcctcagtggaggagaagggtaaagctttcatttttagtgaagtttgggttttgtctgttccactaggctggacatgttaattcctggaggtaattggaggattttttttaattatctgaaagcgtctcaaaaagttctggctcttcaggagatttcatccaagaagtaggggagaaataggtcacagagagtgtttaggaagaaataggagggagaaaataagttttctgcttgtggatttcaacccgtttactaaagttacaataacaaccattacctctggggaattctgattgagggaggcaagacttttacttaatactttaaaaacttttgcattgtttgaatgttttacaatgtgcccaaatcacagaaataaaaagatagtaaaaacaacaaagatactcgcatttgtggagagagtggagatgctgacaagctccctgaacccctggagcttctagagcagggtttctcaacctgggcactattgacttgttgcaagggctgtcctgtgcattgctgggggtggggggcagtgaggcagactgttagcagtatccctggcctctgcccacgaggtgccaatagcacacccccaccctgagttctgacaaccaaactgtctccagacattgtcaaatgtctcctgggggacaaaatcacccccagttgagacaactgctctagagggattattcagaatacgtgggtgtcttctgagcctctgggcctggtgacctcattaatcctatctcctaatggctccctgccagcacctttccatggctccattggtctgggagtcagaagatgtagcttccagtttcggttctgccacttactagcgatgtgatcttgggccttccagagcctcatttcctcatccctaaaatgggataattaacaatgacatggctcaaggacaaccaggttctccctttcaactggatctttccctactgcttttcaggtgcccaggtgtctcccactgaaaccaagaaaccaacccaccttccaggaccttacttccttctgcagctacttccctgcctctctcttcttcttcacagccaaacttcttcaaagagtcatctcactcttttgaaggcatttcacactcaatgtgtcctaaactgatctcatgatcttcctccccaaacctactgtcttctcctgtcccttatcatagcaaagggacccccttacatctagttacacaagcctaggagtcattttcaacatcttccacattaccaacctcatagccaatcctgctcgttttacttcctaagttgctttggctttcaagattatttatttctaaacaggaaatacattgaaaaatcaaaataaatataaaacgagatttagtaaggagtctcacccaactccattaacttcagcactccccctaaaacacacacataaaccacctttatttggggggtgggtttccttccagtgcatctttatggaaagacaaacaatagatattgcttcctttcttccacaaaatacaatactctacatgctgttctgtaccttgcatttttcacctaaaagtatattttgtcaatctttctgttcagtattagaaatcttttgctctgtttttacaaatagtattctactgggtggacctaacaacatttcttttaccattcccttatttacaagtgccagttataggaaatctgctattctaagcaatctctaaacatcttttcaacccatccacttgtttcagtctcctttgtctccactctagcacaagctaccaccatcctctcctggactcagcagaatagcttcctaaatactctacccaaatcatctcttgctctatcttcacatagtggctggactggtattttcaaaacatgactttgatcatatccttgccttgcttaacgacctgctgcagctttcttgtggtttcagggtaaagacaaaactcctccttatggcctgtgaagcctcattgagtctggccctgcctcacccacctctccctgctcccctgaccccctctgccccctccttctccactccactcccagtggccaccttttagttctttgcatatgttgttccttctttttttttttagacagagtcttgctctgttgcccaggctggagtgcagtggcgcgatctcggctcactgcaaactctgcctcccgggttcacgccattctcctgcctcagcctcccgagtagctgggactacaggtgcccgccaccatgcccggctaattttttgtatttttagtagagacggggtttcaccgtgttagccaggatggtctcgatctcctgacctcgtgatccacccgcctcggcctcccaaagtgctgggattacaggcgtgagccaccaagcccggcccatatgttgttccttctgcataaaacactccactctgctccactcaccaggttcctttctatgtgtccttaagatctcaccttctttgtccactcctcaggaagccttccctgagctccctgctaggtcaaagccccaaattaaaggatctcattagcaccgcgtgcttctcctgcataaccctagtcccagttgtaagttcacattcatttgggggacactttgataaatgtctggctcctgttcccatgtggactatgaggtccatgagggcagaggccttacctatctttgctttccataaaggccctgcatctagaaaattgttgaccaaatgaatgaaaggatgaggcatataagggccccagcagagaacctgacacatagtaggtgctcaagaagtgttgctttcctctttcttgcattcactgtctttgctctggagcctgtaatgggttgccttctatgtgcgctactcaacaacgctgctctctaaacactcagcctgtggcctttgcttgggcttctcctttcttgatatgactcatttaatggctgatcatttcttcctcctgaaaatcctctcttgtcttggcttgatgccctgggatccctttacccatggtggcttcctctctactttctcttcctctgcctaccccgagatgttgggattcctcaggttttatcccaaaccccttcccttctcattctatacactctcttttgagccatctcatctatgctcatagcttccatcaacatgtatgtcaaactttgagtctcccgctcaggtttttgtaatatgcctcaggtccccgtattaaatgccagcctctgcctctagaatgtaagtggagcgagacagcagagattgtgtctatgtttgcttattacagtgtccccagcccctgaagcagtacttggcacatagtagtcacccaataaatacatattgtcaaatacataaatggcagggcccatgttatgatggtgacagctgccttctccagaggcagcctttttcttggcaaggcagtggggcagagaaagaggctgggtgctaaatgtcatgtcctggcttttctcatgctgggccttagcagatatctcacacccacagtcaggatgaaagatgaaattccaagcaggatttgcacccaggagccagcagtctctgaatcagcaaactgtcctatggggttgtttcaccccatttgcaaaccataaggcagcctttgagagagaaggcagctcaacacaacatgtgctagcatcatgtccagccgagtagcctttaaggggagcaaatagctggccacatcgtgtggcaatgttgtcagaggggaggagggcattaggctgaggctgcacctgccaggatatggacatgaggttgaatcctcctgccccactgaagaggggagccagaccactctgctcccaaacccagggcctttccaacaaaggtcaagggtggaggaaagccaggttgagtgggcagaggaattctgcttatagccctgacacactgcctgtggcacagcctcctacaacagactggcctgtaaggccaggtcctgcccggtctgcatgagaactgacacaaaagtacagaccgttctaagtcagagctgaggtggccctttgaaccccagatccacccacctcatgattccgttggaaaagctgaggtttaggttcaggcagagactgtcctgtagttggtaactagcaagccagggcgtctggcttatctcttagcctttagcctgcttggccctacagacttgatagtttcttcctgcttacattttagagggaagagacagaccacaattttaaaaagaatatgcaagtaaaatatgtagcatgaaagatggtggcaagggttatggaaaagaagaaagtagtggagggggaatgagggtgctagggtttgtgattttagatggcatcatcaggggaggcctccttaacaagggagcactggagcaaagtctgagggaggtgagtgagtgcacttgctctctctacagtgtactgtgaggacacccaagacagagcccgaacctccagactgcccccaacagggccatggtcagagggcctcctgggaggtttgcctatggattttggcctggccacagggacaggaataagcatatcttctgaaactgaggctggacacagaaccaaaggcctatgacaccctaggtcaggtaatattaataacaacagtaataataataataatagcaccattttatctgcattgagcacataccatatgccaggcactgtttctagcacgttacgtgtgttatctatcttattccattcacacaatgaccctatgaaaacagtgctgttctaatgcccatttcatagatgagaaaacaaagtctcagagtggttacagaacttgcccaaggtcacaaagccaatgagcagcagagttgtgctttgatcctaggtctttggactccagagcccatgtttcatagacagaagcaggttttagccatctgggctggaacgtttgtctagaaacagagggtagatgagatgatctcttgggttctctgctgtggtcataagggccaggcagctcagaggcagttgaaagtgatgtctaatatggaagccaacctgggataggattgtgtctgaggcctctacagaagaggtaggcttcatcttctctggaatgtgagctccgtgaacgcaaagccttttctgtctggtctgctgctctatcaccactgcctgacactagtcagtgatcaataaatattggtgtaaatgagtgaatacaagaatgaaccaataattcactctcacttatcgaaggtgggcccagccagacactgccatctttccaaacaaccagggcatctggacttgtgtctccctgagaatgtgaggcaaagaaagaaggcatggcagaactaggagcaaaggagatgctgctggggtcgggagccaggacagagcccagagctgaggactgggacagtgatgggtgcagagaggccaccctttgtgaacacagttctgggtgctttacatatgcctcctcatatcatccttcccacagctttgggagatagagattactacctcatagaaagatgaggagactgaggcatagagaggctaaatgacttgccatgaatcatacaagcattatggggtggagctgggtttaaactgagattggcaaggcaggccaattgctttgtgtggtccctaactggggtgcagttagaaactctttcccctctgctgtctaccttcccccatctcaacctcccaagctcctttgctctgcagctgtccccagacctcagcctgggagctggaccctgcctcttcagtctccctaaagagtggagactccaatgcaacaggtcttccctccctccctccctccttccctccctccatgtaccctagaggtctgaggtcagggcaaagccaggaccagcagtaaagaacagacatggagtgagacagatccagatttaagtcctggttcttccacttaatacctcagagaggaagaactaccttgctgagcctcagtgtcctcctctatacatatgggataatatcacccatgtcatggcgttgtggggactaactgaaatcacttaggggaaggaactggattccaggtgagctggagacaggaagaggcagtcataatagtccaccacattacagcttacacagcacgtttccattaatttctaggctcccctttttttctgtataaccattctattgggtaaagttattgtccctcttctgtaaatgagaacactggggcttggaagtgacttgctaaccaaaggcatgcagtctggaagtcacaaggcagacattctaagctagatgcatgtgacacccgagtgtgtggggagcccccttcaccttccaaggcgagcactcctttaccctccgatatcaagtttggtggtgacagtactcatcttgtaaagtgctggttctcctgatcctctcctccaaagcaagactcagtggtgcactgagaggatctcctccaggccacagccctacctcactctgcagtagcagcaatgaggaaagaaaaatggttgtcccagcacaggatgggagagtgaagcatggtcacaatgagggccagagaacgagcaggaggtaagcaggaaccctgaagtagtgcacctcaaacctaggaaaaaccatgtctttggccatctttagaggcggcttaccagagaacaagacacttccccgtcgtcaggtcatagcagtcatcctctgtgcgtggctctgtctcatattgtgaacttgttctttgtgtagaatgggtctcttttctgctgtagcccatgaggtttttcccttatctttgatggtctgtgaatttcccacaaagtgtctaggtatagacttattttatttatttggcttagtccttggcccgccctttctccctgaaactcatacctcttttcctttctgaaaaactctcagctattatctctcaatgattgcctcctcaccattatctgtttggagcttctgttagacttaggccagagcccctcaatgccaaccttcatgcctactaactgctctttcaaagtttgtttctatgctggtgtgaatccctcagcactagcctacaattctctaattctttccatgactgtgtccaggctagagctatcgcattcattgaagtttgctttctttttatttcgataactatatttttgacttccaaagtttctacttgattttctctttttatctctcttcctgtttttgtgcaatcctattttgtccttttaaggaatatcattccttcatttctctctgtgtgcatcctgggcatgcttattttcaaaatctgtcagcctattctctaaaactcatctggagtaaatttatgtgctgattgtagattttgctggctctccctgagcattagatttctttatgtgttttggaattttggtttggagagggagtgttggtgttgttttgtttgtgtttgtgtcttattgtctttctctctcagtgcttgcccctccctatctggtggtttcatggtggcctccactggcccctccacacccctcagcccagaatccgattttatgacactcaggtctcttgccctataggacatgttgggggcattctcctgcttcagtgtagaaccttggggctcggttcacttccttgtcatgaggccgagtctgcctccacccagctcctcatggcccaggctgccttgtagtcagaactcccagaagcagctggaagctgtcttttccagctcgtaaggggagagccctgcccctcctccccctggtttctgcctcccatcccacaatggagcacttgtagtactcacaggagctgagtcccggccactcctgcccaccccccaccacggcgcccgtgttctgacccaggggccggcaggctacagctgtgctggttgctttgcatttctgtgtgtgctctatatctcatttttttcagcctgattctgtctttggggttttctctttttacagtgtattgatcttccatcactctgtgcttggtacagaggggctctgttgccatcttaactggaaatgtactctaattgtgtactgtatgtaccataaccagaaattatttaaccaatcccccattgttacacttttatgttgtttgccatttggggctagtacaaacaagaaggcaataaacatccttaatgcacttgtctaattcctaatgcgaagttgtgagatcaaagggtagccatgtttccatttgatacatatttcattttgtaggtactaccccaaccatcaccaccaccaccaatacaccatcgctggcatctggtttgttgaacagaacaagggaaaccctggaaataaatgagaccgtgctgtcgtaaagtctaacttagtgtacacaggtgaggcattcttagacaacttcttccctgtttccatctcttttggagccccagctccttctcatgggttatttcatttaatcttcatgacatccctacaggatagggaaatctcattttgcagaagaggaagccaaggctcagagaggtaagacgacctcctaagattttactgataggaagaggagtccacgtgaagttgaggagaaaggtggggtgctccccagtccactgagctgcagaaggggggccttctggtcttcactgatccatatgtttaggaatttggctgcctccatgagaccatggtacagcgattgtgggcaactcctaattgtctgggtttaggcacactggggcagcctccactgcgtgtgggacaagtgctggctttgcaactcaggctcagcccctctgtagttaagtaatgatgagctcctccttatcctctcatttttcaacgggagatagccgggtatagtgagagcacacaggctctggattcagttaaaaaccagctctgccactttcctgctgtttgaccttggcaagccacctcacctctgtgggtctcagtttccacatctgtaatgtggggtaataaggcttctcttggagaggcattgttaagatgaaagaaagaccggtgtgcctggcacatagtagagattcaaataaagcctgtttctgacaagggtgaaaggtcacatagctaagcctgctcagccaatcagctggggccacaccctgtcctgactccacactcagtgttcttcccaatgcaactgtctgggcctccttcagctatttgtttcattgtcctgtcctaccatgttccctcctgccaaaaagaaagaaccatcccaaggagctgaagctctggcctctgtgcatgctcccacagcttctgctgggctgcctgacaggagcatgggccctgaaagcttcacacgtgtccccggaccccaccacaggtgtgagcctggatgcatgactctgcaagatgctacacaccaagaggactggaagtttgagattactgtggagtggtggctgctgatggggcctccggcctgcccactgcctaggcctgtagccctcaaacaagtctcccctgctctcttggaggcactgcccgcagcctgttggaagatcacaaaaagcaagaattggcccttcctcctctggcagagcctgcatagcctctgggaggcaattagggcttgggcctgccttgggaattcccaagggtacccaaaaacacttcaaagtcacaagcccatctgcctgcttcaccctgggggaaaggggcaaggggggcatattgcaatcactccccagatgggaagctgaggagaccagtctcaggcccacggtggcctgggatggaaactctggccatgtggggttcttcctttgcacagtgctgtggcacatggagatatctggttgtgggctcagtgtgagggaatggggtactggtgagcagaggtgaggcagggatacttggagtcccaagtgcctgcagctctcacagcttacaacctgggtctcaagataggcagaaagactctgtcacagggaggtggcactggaacctcatgagattagaactgaagaccaaggcccttccagcctggtcactggcacacttctaaggtgctctctgcccatcactggcggttagtgctcctagagctctgtgccaggcccacctctcttccatccttcacatgcctctggtgtgacctcatccacccctcagattgcagctaccacctctgtgctaataagagttcagatgaagtgagtgctaactctgtgccaggcactgttctaaacattgtgcttgtgtcagttcatttaatcttcacagcaacctaatgaggttgaccctaatactacgccatcatacagatgaagaagacaatgaggtctgggaggctatggaacttgctaggaagaggctgatgactcccaaactgctctctttcgagctggtttctcttctcatctcctttcttcctgttactcatgacacacctaggctggaatgtcccacaagctcctcagacccaccacagccaaaactgcactgacatttctcctgtacccacaccccatctcaaaatcctccttctcccagaagcctcatcccccacagttactctcccatctactacatccctgggtggtatatcttgcattcctttctcttccccctgcaacaccttgagggtcttcagtcctacccactcacatttcttcaatctccctcctctttttctccttcctcagtgatccttccccctggggtcttcttcttctccttcttctttagttttattttaattaatacataataattttgcatatttatggggtgtagtgatgtttccatacatgtatacattgtgcagtgatcaaatcagtgtaattcacataaccatcattgaagcatttatcatttctctgtggtggggacattcaaaatcctctcttctagatattttgcaagatacactacatgattgttaactgcatggccttgctgcacagtagcacaccagaacttactcctcctgtctaattgtaacatagttacagttggaacaacttctccacatctcccctccccagcctgtgggagccattgttctactctctacttctataagatcaacttttttagattcttcatctcatatctctacttttgtcttctcccctcacatttatcttccacactgccatgggaagggcccatggcccatcccctgctcaaaatccttctatggtttcccatggcctacggtatcaaggccaaattcctgatcctaacatgcaggggcccccacagtgggaacaactatctgttgaacttcaccctttactttcccagccactccctctagccaatctggcctccttgctgtccttctaaggtacctttcaatgccttgaactcctgtctttggcatactccatcccatccccacactcctctacacccttggaatactctccttcttcccatccacctgttctgaatgtccatcccaaatgtcaccttctcggtgaagccttcctgtcctctcctgttgaaagtactcttggctgtgttgagactgcagcagtgtaatatggagatcggacagaccatgagatttggagacaaaactgagccatgggacatctgagaaggccctttaatcactctacctcagtgtccttccttataaaatgcagccatgaatacctctcccctgggttgtgtgagggtggaataagaggcagcaggcaaaccttggcacacagtgaacaggccttgggagagcccatcacctcttcccaggggcactccatgtccacagccctctgcgccacagcacactgccaaggactgttctaccacccccgacccctgagattgtttctctatctttgctttcttcctagcccagcatgcagtagtcctcagaaatccctgagggaggaaagtcctgacaggaaacctttctgggcagcctcagtttggggcctgatggtagagattttccccagtcttaacgagtgaggcctgcatcattgtattgtacaggtcaaggtgggttgttctggttccactgagcactgaggactccaggagtaacaagcccccatccttcgttggctggagaggctgtcatgacatggtcatctcccctaagaaagggaacttggcctgagaagcactgggctctgggagcaaggcatgtgagctctggtcacagaaaacctgttcttagaggagacctggataccttgttcctggatttatcaactatcaggtttcttagcttttctcccctgggccatgggtccaagaaccaatggagcatttctgggtttgagcaatctgtacttccctctgttcttccccccagcctgatcaaagctcttggaccttactctcctgttcctttaacagcaagtttaggagcatggtcatgggggctagagtgcccagacaatccagctgagcccaacaagacagagaataagcataaccttatatgtgattgagaataaccttatatgtgattgagtcatcagtcacaaatcacactccctgattcagagactctcagagtagcagtgctagggcagttccatatacctttctccttgcattgcagctgggcagactgaggtccagagagggtgagggactgattcagatcacacagcaagacagcagtggaacccagacctccagactcccagcccagggccatttttcccacacctaggactctatctgagaaagtgatggtaactggtaggagaagctgggggtgggggctgcaggaggcaggaacttgaggggaggaatgtgggactggaaggtggaggggaagcaaagcccccagcgctgagtggcggcccaccctggagacatcagcccagctatcacacggcttcctctgctgaggattagcacaaacatcccccagctgtggccctccctgctggccagctgtgcaggctttgggtggcgcgccccagatgcaggaggccccaggctggaggctggactttctctcttgtgacgttgtgtgctctcccggcatccagagggcatgggccagcctctggctcatctctgctgtcaggcccggtgaaggacagtcaacactcctgactgatcaaaggcactcccaccctctggccccaggagtgccggggccgaaggggagtgggagagctcagatgccgtcctgtcatgctttgaagtccccaatgcattctggggtagaacttgctgtggagtgagacctctggaacacaaacttaacaaaaattcctgacatgtgttatgatggaggcaggagagccgagtcctgacacccttggccagacctttcacctctctgagccttgccctttccaactgggccaggaggggactggattctgcagagtaaaggccaggccagcttgccatcccgtgactctgtgagtttctctttcttctctcagaggccaggtgggcagggtggcccagaaaaggcttatgggcaggaatagaggtagtctggcaccaaggacagggtgcgtgggatagctgggtgtgggggctatttattcattcatttattcattcatccatccatggagcacctactgcattccttagcccaaggacttggaaatcgggcaccctaacatgctgctccactactcaagggacctattaatagattctgaactggctcctcccctcaccgtgcattgcctctgttctagagctaggatgggcacactggtttgtgacttttagccatcaggggccatatccagcaggggttttggttgaatctgagtccagctaagttaaaccaaaaatagatttactggaaagctttgggatggctcacagtcttgttggggaagggggagaaccaacctcagagaaagggaaggcacccaatgaggcagggaagtatgttacagaaccaagggacagtcaagctcatacactacttccgggactgcttctcctcacctgacccctcccagtggaccctgacattgggaatcatttctgaaatgcttcttttcatgaggagtatctggctgtctgtcagggggcttcaggagggagctctttgagcttctggccttcccccctccctccctgaactctctccagctactgcagcctatgcccaagctgatattgttttctaactgaccaagctctttggcttctccaaatgccccagccagccctgggctttctgaactcactatatctccaaataacttctttttcccctccatgtatgtcctttagggtcacaacgaaaggggccaacacagacatctccctcactggtcttgatcattttgtgcctggccccagcctaatttaaagccctgtaaactagtacatgtcgtgacctcagggtaaaggtgaaaccccctgccatctgctgagggggtagggggggcacctgctggaggaatggtacagtccagacccatgattgccccaggagaatcagccagaggcaagccagtctgctcaaagccctggaggctgagaggtctggtggcagcctgtcaaggagccaaccgtgcagggggctggccaggctggatgtgggaaccacactggagacttattggcgcagatccctctcatagctatgctacaagccctcttatcagatgcaaaggggatcttctgttctccacaagggcaatgtcctaccaaggtgggggtaaaactggccttgggaaattagagacattacgtgacttgctgaaggttatgtagatgataatgagcagagctgcaactccccagtcctcagtcagcaacaaagcactctagcaaagaccacattgtaccagctcccccagatagctttcaggagcccccagctcccccgccagccacctgcctcaggccttaactacttcattagaaccacagtgtgtccaagcttgaagagacctcagaggtcagtagcctagccctcccctcacacacacatatgcatacacacacaagtacaccattacagctggaaaattgaggcttggggagggaaaggagaatgccaaagattggcaagcaggttgatgggtctagaagccagatccctgggctcctctggcagccatggttctgtgtacaagcctggctacattcctgtccttatcttacaacctagccgcaacagctattcctacctgtcctcttttctccctgtcctcgagctttgcattcagggccgaacctactgctggagaagtccccgccttccacccgagcacccatggatcagctggtgcccctacagctatcctggtggaagagccaccccacttctggcccacttccttctcttttaatagcatgtgtgaagaagaagctgttggtgccaaaaagattccaagaaaataggtaggcccaggccaggcagcccaagctgctaatgcaaagaggcagctcctacccttccatcaaagccctggaatccagaactgcaaaggccccagggaggaagtaaaaggaagctgagttgctaagtggcctgcccccatcctccaccccactgcagatgcctggctggctggacaggagggcactagcagaggaatgatgataaccatccctcccatctggacggccctttcacacaccactaacaggcttccctccccttctcttgtcccagccacacaaaaggcttggtaattatccccagtagccagatggaggctcagagaagacaagaaacctgcctgaggttgcacagctagttggtggtggtattaagcacaatttgcaatccaggaatccatgtcccgtgcatattccccttagctttcacctggcttacaaacccaggccttggactcctggatctctgccccagccagagggcaaagaggatagggcacccaggctgggagggactgtaatagaagagggtttaagatgggggagggcactgaggaccaatatgacagaaaaaagcaagtctacccctgtcccaagtttccctcattgccctctcgactgaagaactttctttagcttttcttttagagcagatctgctggaaacacattctcttagtttttcttcatctgagaatgtctttacttctgcttccttcttgaatgatattttcactggatattgaactctctgggttgacagttcttttcttctggaatttaaaaaatactgtgacacttcctctggtctccatggtttcaggcaagaaatccaccatcattcatactcaggtctcttctgacttcaagggcctgctccaaaggaggccatgcagggtagcagaaagaactctggaggactgggagttgagccacagctccaccacttcctatccatgtgacatcgcatgagtccctccaccattcccaacctcagcttttacattgctgctataaaagggtgggactggattgtcacactaaagaccctgacattccctgggtctctgagaactatccaattcccaggggtgccaagctcctgatgatgaggaaagagaccccacagagacaccctctgtccctgctttccttgggggatgtggcttgagtcctgtactttttgttccctcgactgacgcctgccctggcctcacctagcccattgaggcagggagggttcttaggatgtttcaggcttcccaacccagctctcaaatcctgagcaaccaggggaaccctctctttccctctcgtcagggccattgcagagcactccttcagtgggcaggggggcaatctccaggaccatccaatgtctctccccatcctacccaccctacagtacagtctgactgctgggctctcccagacactgccatgctgttttcatgcttccattttgttccctttgccttggaaatcctttctcccttgtctacttggcaaggtcttgcagaagcaatactagctctttacttctctctgcctcagttttctcatctgtaaattagagatgacaataatagtaataatacctaccccataaagtcattgggaagatcaaacaagctactccctatgaaatcctttgaacagtggttggcccatagtaaatattcagcagacactagcttattattacagttatcattaacactattatagtgtgatggttaagtgcacagaccttagaatcagacttcctctgtacaaatcccctgtgtcaacttaaccaactacttgacctctatgtgcttcagtattctcatctttaaaaggcggttaataatagccccacctcataaggttgttatgaggatcaaatgagacaacactttgcacagagcctgacacatagtaagccctcaaaaaatgttagctgtgatgataaggatgctcatcaacaattcagcttcctttcctcttgagaaagagaggcagcaggtactcttggggaacgtgtccactggaacatgagctagggagagacatccatgcacccatgcaactcttagaccacatcacgttcctggttctggcttgtgagattccccacctctgtgacttcatgtggcctgttctctatgcctaggttgccctgtccccaggccaagttccaaggcctcacctttgggaggcctcccacagttcctgcatgttgactgaattccaggttcctgtaggacacacccaacaggccatctgaagctctatccgatgctccccaaagtctgcttggggtggagttagttctgcactacagcccttgattctagtcctggctctgccccctgactttctgtgtgacttggggtcagtgtcttttcctttctgggcctcgttttttttatctataacatgagaagtttggctcaaatggtctttaaggtttctcccagatgggtaaatcctagcattactcaccactgtcatcccagggctaagctagtccagtgcctgatgttaaacatttgatagggactcagactgaactaaagtggactgattatagaaccacagacaaatgcctcgacccagtccctcccatacctcctgtacgtcctgtcacccaggctttagccatccttggctgcccagctccccaacctctgcaactcagggcttgaggacagagcctagctgctgcctgaaggctgggctgctggggccccagcaggaatgttcctgggcttattttggtcccttaaattagaaggctggaggttctaatttacaactccctgcctggagcgggagcctgggctggggtggcctgcctcagctgccaagcatgaaccccactctagaccacaacccaacctcagagctgcctgtggctattcctgcatagcaacagcacagacaacaaaggccccttaaccttcctcttctagcggcaactatagcagtggctgctgctgccttgggactcagcaggatgaggtacagaacagggaatgggctggctaagtcaaaacactaggaaggcacagatagttcctgtgcccacactgggcactcaccctttgggcatcttggcaaggccacaggggctgcccccacagagctaggccagacagagaaatgtggccaatggaaactaaggcctgggacctagagggccactgagctttgagggaagagccagctgttttccatcttcactgaggactgagggaatagaaacaggcaggaaaaacagtgagaagaaccactggtttcaaaagaccagctttctatcctaggcatactgtggagaggtgactggacctccagccgtcctccttcaatccactctccaggctgccatcagaggtaccttgccagcaaagacctgatcggattatttctttaattaaaacatttcaatggctccctatcgcctacaggggaaaatccagcctttcattcaaggagctaaggcccttcacaatgtggccccagcctacctttctgcgccactcccaaggcctctcctaccccacacaccctacaatacagccactctggcggctggctttcccccagacctcccatgctctttcatgcctccattttattccctctgcctgggaagtcctttctcccttggctccttagcaaactcttttttatggttgaagcctcagctcaaatattccgtattcaggtacaaaggtaacagtttcctctcttgtgtttccagtgtttccctcagacttttattcattcaagcagcatgtattggatacctactatacaacaagcattgttctaggaaccagggatacagtggcaaaaatgacaagccatagaccctgccctcatgaaacttcatgtagaggagacatacagcagatcggtaagctgacaaatacataagatgatctgaaatagtgttgtgtacagggtgtactggaaaatgctgagtgatctgcttaaaggagggcatctgcggcacctgctgacttctgtggtgctgacattcccatcatggctcatctcaagctggcagtgtgaagtcattgaatactgagttgggaagagccagtgaaagccagctccagcacattggtacatactaaaaagaaaagaaaaccagttaatagaatagagagcaactgaggcacagacgcggggagtgttgctaaattcaattaggtgcggggtggggccagggaaggcctctttgaagaggtgacatttaggggatggcctgaatgacaagaggccagttatgcaaagatctgggggaagctcttggcacttttggtttttaaaaatactttttctattgaggcataatttccatacattaaagtgcactaatcttaagtgtacagctccatgaatacttacatatgtatcagcctctgtaaccaccacctaggtcgagatatagaccattttcagcactccagaaggctcttgtgtgcctcttcccaatcagtaatccctgtcccaagggaaactactattttgacttctctccctgtaggttggttccgcatgtttttgaagttcatatccatggaatataaatatagcatgccatagtatgttctttctttatgctgtatttccctcacttaacatcacatctgggagagccgcccatgttgttacatgttacatgtggccatgttctttttcactgctgtgtggtattccattatatgaccctttcctggtaccttccatgttaatgatgtttccctgtctgtctcctcctcggggcctgagacagggcagtgtaacacagcacgagcagctatgagctctgatgtgggcccgaccactgctgagctcagggatgtggagtcctcttctctgaacaggatgttcccttctgtctttgtatccatgaaacagatagtggcaagccttcctacagatgtagcaaagagttagcaagatgatccacagcaagcacttagtggaggccctggtctggagggtctgctcaagggcaccccaggtgccttctccacccttggcctgtgcatttggcaagcagcaggtatagttcgtgcatgcatgtgggggaaacacagcacacatatgattgtatgttgtgctgtgaaatgactgccgagattgctttggggatggttggggtgagggacaggtttgaggcaccagaggcacttccattgctgagagtgcccggaatgtgagctgccacagaaaggtcttcagtaccctccccactaggctggaccaggatgtatagagggaaagaaagaggcaagggacttatgacccctgccacagcgcttgcacaggaaggagtgcagagcattcttgctggggtctctgctccctccctgcactccgcttcaatttacagttgcatgaacttaggtttggagaagtaaggtcaatttcacatagcctagaaagtgttggaggagagattcaaacctaggtgtgtttaactgaaagccagtgggttgagggcatcttgtgagaccttgagggtgctgacccagcctcaaggagacagagtagctgggcaagcaggctgggctctggcctggaggaaggccttgggcctggtgctgccaactgcagaagggctgtctggggagcccctaccaacacatcccacataatggggctcacctaggcatcacatcctcttttttctccctttactcccgagaggagacagtaagcagtggaagaggagtgcctaaaaagaaacacgtgtcctcagcattccaactacagctccctgcctgcccactcccctgcacctccccctcacttccccaccagcccctgcccgtgagcagccttgtccttggtgctgccacctctggctctccccatacctccaatttgtttccagaggccttgaaggccaatctttcttcatgacagagcctcgtcctttagcctctcattatctctctctttccctggctcctgggagccccaggccagggagggagagtgatggggtggggacacaagaacatgtggctcccagtcctgactctgccacagattccctgcatgccattgggtcagtcccttctcttttctggcctctttccctatctgtgcaatgagccaatctccaagggccttgtcagccttgcgtttctcaccaggcagcagagactcattgccctaatggagagaagcagaatgaactccagctcgaggtcaagagcagacctggaggcagagaggaggccaactggactgtgttcaaaatggagggctgattcaggaataacggcataaagaggctgggatctgctcaccctgggccccttttcctgtgactgctccctcaatatgcgttcaacaagtcactatggagcagtagctctggaccaggcaatgagttaggtgcagcaaacccttggttcctcactttggccttacaattccagccatagcttctacttctcttccctacagacatggaggaatttggggcctgatcatccaaggccacacagagaattaaaaccgaaaactgggctcaaattctcatctcctaaccaccactacctccccacaccttgtcaaaatttttctccctagaatcctagactcactgtctgatccggaaggcactttaatcatgcctaagagcctggagatttataaaggaagctgtaactgggaagaatccggcctgctgggaagctgcttctcccaggtacccacaagcaagatacatggcttcactcctctgtgcccccacagtatttcgtttccccatgtaggcacatcagtgggtgcaggttgccccctttcatcatttactcacatgcttgtctctggcactgagcagagcctgtgtctcctctatctccgtatctcccaggcctgggccaggcagacatggggaagcaattcagtgggtgcccgtggtgtggaattgaccatgttgctcctgaaacacagtttctttttctctctttcttttttctttctttcttttctttctttctttctttctttctttctttctttctttctttctttctttctttgtctttttctttctctctctttctttcttctttctttctcttaccctctctctctttctccccttccttccttccttccttgcttccttccttttttgagacagggtcttgctctattaccccgagtggagtggagtggtgccatcttggctcattgcatcgttgacctcccgagctcaagtgatcctcccacctcagcctcccacttttcgggactacaggcacacaccaccacagccaggtaactttgtatttttagtagacagggttttaccatgttgcccaggctggtcttgaactcctggcctcaagcaatctacctgcctcagcctcccaaagtgctgggattccaggcgtgagccactgcgcccagcccctgaaatgtagtttcttctgtgcctgccctcagtgagtgagctctggagacaggtgctctggatttgtgcagtggttctgtcactaagcccaactttcacagtgacttaacctttctgtgccttgctttcctactggtaaaatatcagcaattacagtactgattcatggggttgctgtgatgcaccccaaatagtgtctggtacatagtaaatgttcagtatttattaccactattactactgctcccaaccctactactgcactcactactactaccgttttaacttaaggatgtatgaagctatttcctagataggcttccagaagtcgatattcctcatatatgattgccagcctaaaggctgtgaactagcctcctcttctccaattttctcatgcctaggactcacctggggatctcattaaaatgcaggttctgattcagcagatctagggtggggctagagaccctgcacttctaacgagctcccaggtagtactgacactgctggtccagggaccacactttctatagcagcccttgccaatattaactaccaaagagagctactgtctattgaaaatccagtaagtggcagaccctgtggaagtgctccacatgcattatctccttgaatccttgcatcagccctgaagggtatgtattttcatccctattctacagatgagaaaactgaggctcagataaatcaagtgactttcccaaagttacacagcttggaagtggcagagatagggtttgaactcagaccaggctgactcccaacccccatttttttccattcttgcaaacagcctccctgtggtgtggcagaccccagaggatgtctgtccccccacagagagaggactgcaacacagcacctgaagtgatagcaaaaatcactctctgggcacagctctttaacatatccgaagcacttacctgcccaccacaggcctggtaaacaggcagggcaaggacctggatccctgttgaagctggtgaggactgagagctgttggggtgggtgtgagggcacgcagagggtagaggaaggccctggcctggattcaccaagggatggcccatgacccaggagctattcctcatctctgtatgctcaggaatcctccaaggttgcagactcagggccactgaatgtcactggcccaaagcccaagatgctgaggtctcaaccaaaggacccattttatgcactgggggcaggacagcaagccagcaagaagcccctgtgttctcactggcttcttaccatgaggtaagccctcagcctcagcagagagagcctgttgcttctggcagctctgtggtccagggctgctgtgtcccagccaagcctagagacatcctcacaccttctggctccctgattatgcccattccttttcctgactaggcccataacaacctgttttcacacagtgcataagacgataaacatgtgctactctcttgggtctttcctgggtctcctaacgggaccatggatctgttgggtatctgagagacaggtttctggggtcggagattcccctagaattgtaggtaaaaccatagggggatgtgacattttagaaatggctattcgtagcttttactattcatctactgatttagcaaatattgattgaatgcttattttgtgtggggcactgagttgggcactaggagtacagtgatgagcgaaacagagatccctgcctccaggaagcttccagtctagggagcagtcagtgaacaagtaagcaaaccaataatatctacacgtaaggacagatagtgatgctgggttctgtctagtccagtgtcattcactacataaacaggcactgctaacatttttgaagggatgcctgagtgagggccagggtgagggaggggcagggcctgccaaaggtcagacccccaaaacagaccctcaggcttcagggcatgcatgtggaccatcgcatgcatgaactgtttaagtgggcatggagctaatcaacagagctgcagaagagaatgaccaccttgggcctggcatgttttttggtgaccaaaaaagccacccccacctccattcctatactgagcttatccatttccaacacagattgctcatgggggaacctcaccccacacccctcttaccccaaaggcagccgttctccctctagcctgctgggtgggctctggaccttccttgggcctcactcctgagaaggtccagctggtgggtccagctggggatttcaaggacgatggggcccatctggagggagcttggagtgagccagaggggccagtagggaggaaaagccccttgggaacagaagactgggctgggaggactctctcagaatgatgcaaagaagaaaaggaaaggccaggaacctgggctggcattcatgagcgcattctgaggcctgaaagaactctgagaggtcaccttcactcatcccaccttcatctaggatgcacttccactgtatctgaatctatgtcagtgtgcagtttctaaagactcctggctggcgagtgagccctctccctgcccactgtgccttagcactcttctctttcttctctggtggctcctgtggcccagacaccaggcactgtgtggggaaaggtaaagagtggatccacagctgaagaagtcctctctctgttctagaggacttcagtctcatgcaggagacaaagcctaaagaattttcttggatacaatgtggtcagtgctttcggtcttctgatgagggagaattatgtctgtggagggtggggtgaggggaccagcagggagagtaaggaaaggcctcccagaggaggcatcaagaagaagtgagaggctctatgggcagaaggccatcccaagcttccagagagctgcctgctctggtcaaatccccattcagatgttcaagtcccgtataccatgtttcagccaaatgcttgcccagcctctcctttcccacttcccgaagcagggagctcattccctctcaggacagagatcatttcaggacaggcctaactctaagaagttgcttccttttttttttttttttctttttgagatggagtctcactctgttgcccaggcttgagtgcagtggcacaatctcggctcactacaacctccgcctcctgggttcaagcaattctcctgtctcagcctcccaagtagctgagactacagaggcatgccaccacaccaggctaatttttgtattttcagtagagacggggtttcaccacgttggtcaggctggtctcaaactcctgacctcaggtgatccacctgcctcagcctctcaaagtgctgggattacaggcgtaagccacagtgcccggcccaaaagttgctttctccaacttttgggctgaactctgtctctttgtggcttccatccattggtcacagtgctgcctctgggggccacctaagctctgtcttctccctctgccctccaacagcttcttagaggtctgaagcatcaccatagccataacccctgagtcttctccaagcaaaacaactccacttccttcaactgttcttcatgagaccagggcccccgctttctccacagcatgcttttgcctccctggtcatgctccagtgtgactctggtacccttaatatgtggcacacagagctgacaccatattccagggcagtctgtcacctccttgttcttgaaactttacttctatactgcctacagatgcagctgaaggttccatggatgtatttggtcagaccatgcatatgacagtcacctcctcacctctgctccttgccctctcacctggttcccccttgccagcctacatttgaggactggatccaagagcaagacctaacatttctccctgtcgtatttactttgtaagcttcagcccctccttctagtctgtcaggaatgggaatgtttttgaaaacagactctgaaagccaatgagatgtgctcctcctgcccacagttggacccaggctccatatttgatcagtgaacagccacgtccgcacatgtgccacaaggcatttgtctgcaaattcatccggagaccttgacagatgcctggaggtcagaaatcagcctcctctatgctgccatgtggccccaggagcctgaaggaaacaccaagtacatctagaagttgatggttgaccgatgggagagggggcaagatgccagtcactcagtcagccaacctttcctgaagattgttggaggctccaagtgacataggggataatgcagagaacattcagagacatcatctactgcctgtgcgctctggaagtttctagtctcacaaaaaggaagaccagggaggcccttaagaaaatatagcaggctgaataatatcccccaaagatatcaggtcctaatccctggaacctgtaaaagttacctgatttggaaaaatgatcttggcagatgtgatcaagttaagggtttctaaatgcaatcacataagagggaggcagaggagacttgaaacagatggaaaaagaaaagaaaagaccacgtgaccatagaggcagagattggagtgaagtggctacaagccaaggaatgctggcagccacagaagctggaaaagacaaggaccagattctcccttagagcctctggaaggagcatggccccatcaacaccttgattttggcccagtgatactggctttagacgtctagcctccagatccgtgagagaatacatttttgttttcttcagcc

SEQ ID NO: 4670 - DNA, 30367 bp, human; identical to SEQ ID NO: 4669

SEQ ID NO: 4671 - DNA, 54193 bp, human; identical to SEQ ID NO: 3433

SEQ ID NO: 4672 - DNA, 341443 bp, human; identical to SEQ ID NO: 3434

SEQ ID NO: 4673 - DNA, 244981 bp, human; identical to SEQ ID NO: 3435

SEQ ID NO: 4674 - DNA, 341416 bp, human; identical to SEQ ID NO: 3436

SEQ ID NO: 4675 - DNA, 341416 bp, human; identical to SEQ ID NO: 3436

SEQ ID NO: 4676 - DNA, 244981 bp, human; identical to SEQ ID NO: 3435

SEQ ID NO: 4677 - DNA, 341443 bp, human; identical to SEQ ID NO: 3434

SEQ ID NO: 4678 - DNA, 423408 bp, human; identical to SEQ ID NO: 3440

SEQ ID NO: 4679 - DNA, 423408 bp, human; identical to SEQ ID NO: 3440

SEQ ID NO: 4680 - DNA, 419526 bp, human; identical to SEQ ID NO: 3442

SEQ ID NO: 4681 - DNA, 32875 bp, human; identical to SEQ ID NO: 3455

SEQ ID NO: 4682 - DNA, 32861 bp, human; identical to SEQ ID NO: 3456

SEQ ID NO: 4683 - DNA, 60626 bp, human; identical to SEQ ID NO: 3458

SEQ ID NO: 4684 - DNA, 58810 bp, human; identical to SEQ ID NO: 3463

SEQ ID NO: 4685 - DNA, 60518 bp, human; identical to SEQ ID NO: 3464

SEQ ID NO: 4686 - DNA, 368605 bp, human
atgatctcggctcactgcaacctccgcctcctgtgttcaagcgattcttctgcctcagcctcccaagtagctgggactacaggtgcatgccactacgcccagctaatttttgtatttttagtagagacggggttttaccatattggccaggctgctttcgaactcctgacctcgtgatctgcctgcctcggcctcccaaagtgttgggattacaggcatgagccactgtgccaagccaactcttgtctgtttcattcatattgcccacaaggatagcaacactatcaccaagagttactctctgtatatatatataaaacatatatatatgttatatatatataatatataacatatattatatataacatatatataaaaatatatatgttatatataatatatatctatttttgagacggagtcttactctgttgcccaggctagagtgcagtgtcgtgatctcggctcactacaacctctgcttcttgggttcaagcgatcctcttgcctcagcctcctgagtagctgggactgcaggtgcacgccaccacatctggctatttttttttgtatttttagtagagatggggtttcaccacgttggccaggctggtcttgaactcctgacctcaagtatttgtcctaaggctctccctccctttggcccccaccacctgatgggccctggtgtgtgatgttcccctccctgtgtccatgtgttctcatgcttaactcctacttatgagtgagaacatgtggtgtttggttttctgttcctgtgttagtttgctgagaatgatggtttccagcttcatccatgtccctgcaaaggacatgaactcattctttttttatgactgcatagtattccatggtgtagatgtgctacattttctttatccattctatcattgatgggcgtttgggttggttccaagtcttcgctattgtaaatagtgctgcagtaaacatacatgtgcctgtggctttatagcagcatgatttataaccctttgggtgtataatcactaatgggattgctgggtcaaatggtatttctggttctagatccttgaggaattgccacattgtcttccacaatggttgaactaatttacactcccaccaacagtgtaaaagtgtacctatttctctgcatcctctccagcatctgttgtttcctgactttttaataatcgccattctagctggtgtgagatggtatctcattgtggttttcatttgcatttctctaatgaccagtgatgattaactttttttcatatgtttgctggccgcataaatgtcttcttttgagaagtgtctgtttatatcctttgcccactttttgatggggttgtttttttcttgtaaatttgtttaaggtccttgtagattctggatattagacctttgtcggatggatagattgcaaaaattttctcccaattctgtaggttgcctgttcactctgatggtagtttctttggctgtgcagaaactctttagtttaattagattcaatttgtcaattttggcttttcttgccattgctttggtgttttagtcatgaagtctttgcccatgcccatgtcctgagtggtattgtgtaggttttcttctagggcttttatggttttaggttttacatttaagtctttaatccatcttgagttaatttttgtataaggtgtagggaagggatccggtttctgttttctgcgtatggctagccagttttcctggcaccatttattaaatagggaatcctttccccattgcttgcttttgtcaagtttgttgaagatcagatggttgtagatgtgtggtgttatttctgaagcttctgttctgttccattggtctatatatctgttttggtaccagtaccatgctgttttggttattgtagcctattagtataatttgaggtaagacagcgtgatgcctccagctttgttctttttgcttaggattgtcttggctatacaggctcttttttggttccatatgaaatttaaagtagtttttctaattctgcaaagaaagtcaatgatagcttagtaggaatagcattgaatctataaattacttaggtcagtatgcccattttcatgatatttattcttcttatccatgagcatggaatttttttccatttgtttgtgtccccgcttatttccttgagcagtggtttgtagttctccttgaagagatccttcacattccttgtaagttgtattcctagatattttattctttttgtagcaattgtgaatgggatttcactcatgatttggttctctgcttgtctattattggtatataggaatgcttgtgatttttgcacattgattttatatgctgaagttgcttatcaccttaaggagtatttgggctgagatgatggggttgtctaaatatacaatcatgtcatctgcaaacagagataatttggcttcctctcttcctatttgaataccactaatttctttttcttgcctcattgacctggccagaacttccaacactatgttgaataggagtggtgagaaagggcatccttgtcttgtgccagttttcaaagggaatgcttccagcttttacccattcagtatgatattgactgtgggttgtcataaatagctcttattattttgagatatgttccatcaatacctagtttattgagagtttttagcatgaagggctgttgaattttattaaaggctttttctgcatctattgagataatcatgtgctttctgtcattggttctgtttatgtgatggattatgtttatcgatttgcgtatgttgaaccagccttgcatccccgggatgaagccgacttgatcgtggtggataagcctttttgatgtgctgctggatttggtttgccagtatttttttttttttttagacggagtctcgctctgtcgccaggctagagggcagtggcgcaatcttggctcactgcaacctcttcctcccgggttcaagtgattctcctgcctcagcctcccgagtagctgggactacaggcatgcgccaccacgcctagctgatttttgtattcttagtagagacggggcttcaccaggttggccaggatggtctcgatctcttgacctcatgatctgcttgccttggcctcccaaagtgctgggattacaggtgtgagccactgcgcctggcctggtttaccaatattttattaaggatttttgcatcagtgttcatcagtgatattggcctgaaattttcttttttcgtgtgtgtgtctctgccaggttttggtatcaggatgatgctggcctcataaaatgagttagggagtagtctctctttttctattgtttggaatagtttcggaaggaatggtaccagctcctctttgtacctctggtagaattcagctgtgaatctgtctggtcctgggatttttttggttgctaggctattaattactgcctcaatttcagaacttgttattggtctattcagggatttgacttcttcctgatttagtcttgggaggtgtatgtgtgcaggaattcatccatttcttctagattttctagtttatttgtgtagagatgtttattgtattctctgatggtaatttgtatttctgtgggaccagtggtgatagcctctttataattttttattatctatttgattcttctctcttttcttctttattagtctagctagtggtctatctattctgttaatcttttcaaaaaaccagctcctggactcaatgattttttgaagggttttttgtgtctctatctccttcagttctgctctgatcttagttatttcttgtcttctggtggcttttgaatttgtttgctcttgcttctctagttcttttaattgtgatgtttgggtgtcaatttcagatctatccagctttccgatgtgggcacttagtactataaatttcccacttaacactgctttagctgtgtcccagcacaacaaccctggtatgttgtctctttgctctcattggtttcaaacaacttcattatttctgccttaatttcgttattacccagtagtcattcaggagcaggttgttcaatttccatatagttgtgtggttttgagtgagtttcttaaccctgagttctaatttgattgcactgtgttctgagagactgtttgttatgatttcctttcttttgttatgatttccgttcttttgcatttgctgaggagtattttacttccaattatgtggtcaattttagaataagtgctatgtggtgccgagaagaatgtatattctgttgatttggggtggagtgttctgtagatgtctattagctccacttggtctagagttgagttcaagtcctgaatatccttgttaattttctgtctcgttgatctgtctaatattgacagtggggtgttgaagtctcccactattattgtgtgggagtctaagtctctttgtaggtctctaacaacttcctttatgaatctgggtgctcctgtattgggtgcatatatatttaggatagttagctcttcttgttgtattgatctttttaccattatgtaatgccctcatcttttttgatctttgttggtttaaagtgtgttttatcagagactaggattgcaacccctgctttttttttgctttccatttgcttggtaaataaccctccatccctttattttgagcttctgtgtgtctttgcacgtgagattgatctcctgaatacagcacagtgatgggtcttgactctttatccaatttgccagtatgtgtctttttttttttttgagactaagtcttgctttgtctcccaggctggagtgcagtgggtcgatctcatctcactgcaacctccgcctcccaggttcaagggattctattgcctcagcctcccaagtagctgggattacagacgtgtgccaccacgcccagcaattttttgtatttttagtagagacagggtttcactatgttggcccagctggtcttgaactcctgacctcttgatccacccgcctcagcctcccaaagtgctgggattacaggcgtgagccactgcgcctggctagtctgtgtcttttaattggggcatttagcccatttacatttaaggttaacattgttatgtgtgaatttgatcctgtcaacatgatgctatctggttattttgctcattagttaatgcagtttcttcatagtgttgttggtctttatattttggtgtgtttttgcagtggctggtaccagtttttcctttccatatttagtgcttccttcaggagctcttgtaaggcaggcccggtggtgacaaaatccctcagcatttgcttgtctggaaaggattttatttatttttatttatttatttatttttgcttatgaagcttattttggctggatatgaaattctgggttgaaaattattttctttaagaatgttgaatattggcccccactctcttctggcttgtagggtttctgtagagagatccactgttattctgatgggcttccctttgtgggtaacctgatctttctctctggctgcccttaacatgttttccttcgtttcaaccttggagaatctgacgattgtgtgtcttgatgttgctcttctcaaggactatcttagtagtgttttccatattttctgaatttgaatgttgggctgccttgctaggttggggaagttctcctgggtaatatcctgaagtgtgttttccaacttggttcctttctccccatcactttcaggtacaccaatcaatcgtaagttggatcttttcacatagtcccatatttcttggaggctttgttcattccttttcactcttttttctctaacctttttttcttgctttatttcattaatttgatcttcaatcactgataccctttcttctacttgatcggatcggctattgaagcttgtgcatgcatcacgtagttctcgtgccatgttttcagctccatcaggtcacttaaggtcttctctacacagtttattctagttagccattcatctaatctttttttcaaggtttttagcttccttgcgatgggtttgaacatcctcctttagcttggagaagtttgttattactgaccttttgaagtctacttctgtcagctcgtcaaagtcattctccatccagctttgttccattgttggtgaggagctgcgatcctttggaggaggagaggcactctggtttttagaattttcagcttgtctgctctggtttctccccatctttgtggttttatctacctttggtctttgatgttggtgacctacaaatggggttttggtgtagatgtcctttttgttgatgttgatgctattcctttctgtttgctagttttccttctaccagtcaggtccctcagctgcaggtctgttggagtttgctggaggtccactccagaccctgtttgcctgggtatcagtagcagaggctgcagaacagcaagtattgcagaacagcaaatattgctgccttatccttcccctggaagcttcatcccagaggggcacccgcctgtatgagatgtcagtcggcccctactgggaggcatctcccatttaggctacacgggggtcagggacccacttgaggaggcagtctgtccattctctgagctcaaacactgtgctgggagaaccactgctctcttcagagctgtcagacagggacgtttaagtgtgcagaagtttctgctgccttttgttcagctctgccctgcccccagaggtggagtctacagaggcagccagccttgctgagctgcggtgggctctgctgagttttagtttccccagctgctttgtttacctactcaagcctcagcaatggcagacccccctccccctgctaggctgctgccttgcagtttgatctcaaactgctgccctagcagtgatcaaggctttgttgtcgtgggacctgccaagccaggcatggaacacaatctcctggtgtgctgtttgctaagaccgttggaaaagcagagtagttgggcaggagtgtcccgtttttccaggtaccgtctgtcatggcttcccttggctaggaaagggaaatcccttgccctttttgggtgaccccttgccctttttggtgaggtgatgccctgccctgctttggctcaccctccgtgggctgcacacactgtccaaccagtcccaatgagatgaaccaggtacctcagttggaaatgcagaaatcacccgtcttctgtgtcgatcacgttgggagctgcagaccagagctgttcctatttgaccatcttggaatggaatcctgaattaacctctttatcagtatataatgacctttgtctctttttagtttttttcatgaaatctgttttttctgacataagtatcggtactcctgctcttttttggtttccattggcatggaatatctttccatccctttattttcagtctgtgtgtgtctttatatgtgaagtgtgtttcttgtaggcaagggatcaatgggttttgttttctcaatttagccactctatgtcttttgatttgagaggttaatccatttacattaaatgttattattgataagaacttactcatgccattttgttatttattttctggttgttttgtggtcttctcttccttctttccttcctgtcttccttcagtgaaggtgattttctctagtgatatgatttagtttcttgctttttattttttgtgtgttcattgtatatttttaggtttgtagttaccacgagtcttgcaaatactatcttataacccattattttaacttgataacaacttagcactctgcataaacaaacagggaaaaagaaaactaataaaaaccttatgccttaacttcatcctcctgctttttaacttttttgttgtttttatttatatcttattgtactatttctggaaaagttgtagttgttatttttcattggttcattgtttattcattctacttagagtagtttacacaccacagttacagtgttataataattgtgttataacagtgttactttttttttgtacttactattaccagtgaggtttgtacctcaagataatttttttttttgagatggagtctcactcttgtctcccaggctggagtgcaatggtgcagactcggctcactgcaaccaccgcctcctgggttcaagcgattctcctgcctcaccctcccaaatagctgggattacagatgtctgccaccactcctggctaatttttgttctttttagtagagatggggtttcaccatgttggccaggctcgtctcaaactcctgagctcaggtgatccacccacctcggcctcccaaagtgctgggattacagggatgagccactgtgcctggcccagatgattttttattgctcattattattataagagaggatcaaaatcctctctttagcatttcttgtaaggcaggtctggtgttgatgaaatccctcagcttttgtttgtctgggaaagtctttctccttcacatttgaaggatattttcactggatatactattctagggtaaaagtttttttcccacagcactttaaatatgtcatgccagtctctcctggcctataaggtttccactgaaaagtctgctgccagacatattggagctccatttcatgtgatttgtttcttttctcttgctgcttttaggatcttttctttatccttgagctttgggggtttgattattgttacatgccttaaggtggttttcttgggttaaatctacttggtgttctataacctttttgtacttggatattgatatctttctctaagtttgggaagttctctgttatccctttgaataaactttctatccctatgtctttctcttcctcatctttaaggccaataactattagctttgctcttttgtggctattttctagatcctgcaggtgtgcttcattgttttttattcttttttcttttgtctcctctgactatgtattttcaaacagcctgtcttcaagctcactaaatctttcttttgcttgatcaattttgctattaaaggactctgatgctttcttcagtatgctagttgcatttttagttcagaatttctgtttgattaatttaaagtatttcaatctctttgctaaatttagctgatagaattctaaattccttctctgtgttatattgaatttctttgagtttcctcaacacagctattttgaattatctctctgaaaggtcacatgtctcttgtttctccaggttggtccctagtgccttatttagttcatttggtgaggtcatgttttcctggatggtgttgatgctagtagatgttctttggtgtctgggcattgaagagttaggtctttattgcaatctttactgtctgggcttatttgtacctgtccttctttggaaggctttccagatatatgaaaagactttggtgttgtgatctaagctgtatctgctttagggggcaccccaagtacagtaatgctttgtttcttgcagactcgtagagataccaccttggtggccttccataagatccagaagcattctctagattacccagcagaggcttttctcttactttctcccagagtctccctctctgttctggaagcctggatctgggggaggggtgacagaagcatccccatggccaccactgccaagactgtactgggtcaaacctgaagccagcacagtactgggtctcccccaaggcctgctgtaaccacctttgtaaccaaggcccgctgctaccacctttgttcactcaaggccctagagctctacaaccagcaggtggtgaagccagccagccttttgtctttctcttaagggtatggagttctcccaggccctgggtgggtccagagatgctgtctgggagccgggacctggagatggaaaccttagacatctacctggtgcactaatctactgtggttgagctggtgttgaaacccccagacaaagtccttcccactcttccctcctttttccccaggcaaaggagtctatccctatgcccaccactacaggcccatggggagtaatgccaggctactgccgatgtttacttaaggcccaagggctcttcagtcagcttctggtgaatcttccaggcctgggactcatcattcaggatagtgggctcttctctgacccaggttaggtccagagacggtgtccaagagccaaggactggaatcctggaccccaagagcctgcttggtgtttttccctactgtggccaaggtggcacctaagctcaagacttactcctccatctgcttttcttaagcagaaggggtctctccctgtagccaccacagctgtgaatgcactgccttgaagggaaggatacagacctggtaggattcatcacctgctaactaaagagcccttgggccctgaataaccatcaatgataaccagggagtacatacccactgtgggccttgctgctgtgggccttgggcgagactctgagatgtgttggcttcaggtgtgaaccagcgcattcacagctatcctttagtctctaaagtttagtgttttgaatgtgactagataggtttcctcaccagaatcaagttggaaattcctttgtgattagcatgatattgtcagctcttgcctccctccacccccagccaattgccttccaaaacttaacattgctttatcttccgatgagcccagtttgtaggtttaggtttgctctattctctgagcctgttctattcaaaggaagaaagaatagtaccattgtagagtagggaagctgttggtttggattaagttatactggccatcagatttgagctttaacatactaggggcatattctatgcacctgtttagctttggagttgtatcatttctttttttattgtggtaagaacgtttaatatgagatttgctgtcagcaaaactttaagtatacattattgactgtaagtatagtattgtatagcagatctgtattgcttattcatcttgcttgactgaaacattatgcccgttgcttagtaactccctattacccctttcccccagcccttggaaaccaccattctactctttggttctatgaatttgactattttaggtatttcatgtaagtggaaccatgcagtatttgtcttgtgactagcttatttcacttagtataatgtcctcaaggttcatccatattgtcacatattatggaatttccttctttttgaagactaaatggcattttattgtatgtatataccacattttctttatccattcatttgctggtggacatttgcatcatttccacatcttggctattgtgaatagtgctacagtgaacatgggagtgctaatatctcttcaagaccctgatttcaattcatgtggataaatacccagaagtgtaattgctgtatcatatgcgagttgtatttttaattttttgaagaaccttcatactgtgttccatagcagctgcaccattttaccatcctaccaacagtgtacaagagttccaatttctctacatcctcaccaatacttcttattttttctttctttctttctttctttctttttcttttttttttttttttgtggcagtgtctcactcttacccaggatggagtgtagtggctcgatcttggctcactgcaacctctgtcttacaggtttgagcaattctcctgcttcagcctcccaagtacctggcactacaggtggtgccaccgtgcccagctaatttttgtatttttggtagagacggggtttcaccatgttgctcaggctggtctcgaactcctgacctcaagtgatccacctgcctcggcctcccaatgtgctgggattacaggcataagccactgcgcctggccttattttctattttttgatagtggttatcttaatggatgtgaggtgatatatcattgtaattttaaattttagtttgcatttccctgatgattagtgatgttgagattttttccatatacctgttggccatttgtatatcttcttggagaaatttttggtactttaaaatattttctatctctgttgaaattctcactttgttcatgcattgctctcttgacctcagtgagcatcttcatgagagttgttttaattctctgtcaggtaaattatataactctatttattagggttggtttatggagattatcttgttcctttgtttggaacatctttgcctggtttttcattttccttgacccactgttggtgcctgtgttaaggcacctctctcattcttcatgggcttgtcttgtacaggagaagggcccccccaattaggcttggcagagattctgggggcctctaccacctctttctctccccagagagaagctggaagctatagtttttgtctgcttgttctgggctgagccagagtggagagctatggcatgtaccagctcaagccactgtctcccattctcccctgagcagctagagtttgccggacccatctgagcctcaaaactagagagatatatgcaagttcttttggcagccctggagaagttggggcactagaggcacagatcaactcttttccctccccaccaggaagcagagagctggagcttttcatctgtggaggtgtatcatttctgcttgtcatgattttcatgaggttagcctgccctgcatccatccctagttaactctccaggatcaggacactgctcagaactacaatacactgctgtgaatagatctgttggaactatggtacatacagttccatctgacttctgctttatgacttgctgcttggattctcttgtaccatatccaatttgtcatttgggacttcctggaacattatataggaaaaattattatctttgtgaccgtggatagaaattacgatttacaatgtaattttagtctatgactaaacctgtttgcctgattttgccagacccttttgacactgttttggatattttggctgtcctcattcaaaccaacctctgcagtttgaatagttttctttagcccacaatcagagctatagtgtagtgctctgaatgcttttggctcatttctttcctttctgctgtttttcagttgtctgagtgtcctagcttatcacttgttccagatccttcctgatagaaccagtatagtggaaagtacaggatttcaaatcagaaagcctgaattcaagtcctagcttactactttctattttatcaccatcaagaagtcactttatccagcaaaaaggcctgatttttaaaaagtcacttcattttgttaaaacttagtttccacatcttatgaaataaaaatatcttccttacagaatagattgaagattaaatgagaatgcatatgaaaaagcttcgagactggaaagcaatatgcaaatgttaattttattgtcatttctggttcttttctcactaaagaagttgcatataattattgtgacttggagtaaaatcttgaattgattttggcaggtctttgagctgctttggcttttgaatgactggttgagctgatggaggtcacagggaaagacttggcaggacagttgatagatttttgcatgttgtaacagaagctcccttcctcaaggacagggaaaatgtttattttctattatacggtacctagaatgttatctacttaatcagaattaattgatacagattaacgtggctgcctcaatcgagtgaacccccagttttaactagaatgcatctcatttaaattaaatggactaaaatctgttgtaaatcatagtttctttttgtagccaggaagataatttaataatttttttcaaaacgtacaatcttgcttgacaaaaccttaatacagtttgctgtcttctcatctcaggagtagactgcattttgtatttgagacagtctctgccgcttaggctggagtgcaatggcgtgatcacaactcactgtagtttcaacctcctaggctcaagcgatcctcccacctcaaccacccgagtagctgggaccacaggtgtgggctaccatgcctggctaattttatttatttatttgtaaagatggggtctgtctatattgcccagggtagtctcgaactcctgggctcaagcaatccccttgccttggcctcccaaattgctggaattacaagcgcgagacactttgcccagctgtagactgcatttatagaagttcttttcatcggatgcagtggcacacacctgtaatgccagctacttggatgggaggatcacttaagcccaagagtttcaggccaggctgggcaacatagcaagaccctgtctcaaaacaaaaacaaaaacaaaaacaaaaaatagaatttattttctgagcttctcccagatgcaaatctcttctttatagtgtaactctcaacctttcagctatgtgatctctatcacttacccagctttgctgactgcattttatccttaaaggactgcaatgctgtcattgcctcagctggtgtcggtgaaattgctcagctgaataacactgaaaatatgttttgaaaggaccagaattatttagacaaaaatgagttaataaaacattaaccacttaagagaacattcacaaatcaaaatatatgtcttcatagtctcataaactatgtaaccagaaactattattggtattctacaataacatcttaggatttttttttttttgagagacaaggtcttgctctgtcacccagctggagtgccgtggcatgatcatagcttaactgcagcttccacctcctgggctggagtgatcctctcacctcagccaccgagtagctggaactacaggtgtgagccaccacacccagataatttttaagttttttatggagatgaagtctcactgtgttccccaggctggtctcaaactcctgagctcaagcaatctacctgcctcagcctcccaaactgttaggattacaggcatgagccaccacggctggccaggatgttttttttaaaacgtatattggtggcatgtgcttgtagtcccagctactcagcaggctgaggcaggagaattgcttgaacctgggaggcggagattgcagtgagccaagatcccccactgtacttcagcctaggtgacagagtaagactctgtcttaaaaacaaaacaaaacaaacaaacgaaagtttatattggggttttgttttcttctcaaaaatatttttaaaaatctgttctttaaacaatatttgtatttttaaaaacatcaattttaaaatctccctgattctgttaccaatattttgagtaagggctatataaatatatgcccctcagcccaatacttacctaatcttagaggagtcaagatatttaacatcagtctttccattaaacaacttatgggaaaaagaaagatagagggtttcttttttcttttttctttttctttttttttttttttttgagatggagtcttgttctgttgcccaggctggagtgcagtggccgatctcagctcactgcaacctctgcctcctgggttcaagagattctcctgtctcaccttctggagtagctgggactgcaggtatgtgccaccgtgcctggctaatttttgtatttttcttttcatatatagtttttcacctaaagtatttaaaatgtgtgaattttaaatactttttaatttgctttgtgacgtctttattggaatctatagtcttatgtttagctagaattttaatttttaatttttatttttatacgtacatagtaggtgtatatatttataggatacatgagatattttgatacagacatagaatgtgtaataatcacatcagggtaaataggatatccatcacctcaagcatttgtttaactgaaatttttgtagctgatttattttttactgtagcaaggtaaaagttctgtttattttagcagcttaaaaatcttttagaaggtgcttttatagtactgttatgaatattaacatttttgctaatttgaggctcaagaatgttgcaagaaattagaaatatgtagcttatggacatttctgtcacgagtttgaaaaaaacctcaattttgataatatgaagggcatcaattgtgattctacatcatgcttattgtttagttttagttttttttttttttttgagacacagtcttgctctgttgcccaggctggaattcagtggcatgatctgagctaagtacaacctcaacctcccaggctcaagcaattcttatgcctcagccaccccagtagctgggattacaggcgggcacaccacgcctagctaatttttgtatttttaatagggatggggttttgccatgctgagcaagctggtcttgaattcctggcctgaagtgatctgcctgcctccgcctcccaatgtgctgggattacaagcatgagccactgggcccggtctagttttagttttagtttttttttttttttttttttttttggatgatgtcttgctatgttgcccagcctgtttcaaactcctgggctcaagggatcctcctgccacagcctcctgagtagttggtactacaggcgtggagcatcctgcccagctaatgcttgggtttgaaggaattccatggcctggtaagattcagctatttggagtctggagctcagaccatttagaaaatggtgacatcatttgtgcagattcaatatctggttaatgttgctaattgagcatgtcatttttttcttgcaaagtaagttcaagacttcagagccagcagttagctatgtctgtctaatgcttgaaaatattagtaagtttttcagttttacagggcacatattcagaacttctttcagaatttctacattttctggttttgaagacactgttaagttcagttttgcagggtttttgtttgtttgttttagagaaagggtctcactctgtagcccatgctgcatggagtacagtggcaggatcgtagctcactgtagccttgaactcctggactcaagtgatcctcctacctcagcctttggactagctagggctaaagacgtgtgccaccatgcttggcctgttttgtacttttaatattacctaataacattactatttgtgaagtcaatgcattttactttctgagaatgagtaatgattaagttataaacaagtgactcccaaagaatgcaaattttatttgaaaattatactctagcttaaagaaactttaaatctccagtttggttttactctaaggatcaagttccttcatgctgtattcatttggccaatgatttagacatagatttaaaaatgatttgctacatttagccaatggtaatagttcacagcacatttatcatccattgtcatttcagaagttgttgaaaacctggttacaaatgataattcacctaacataccagaggcaattgatagactcttcagcgacatagcaaatatcaacagggagtctatggctgaaataacagacattcaggttagtataaaaataattctgtttatgataagtttcgatgattcttcattttaaccaatgtattatataggtaaaaaagtagtcttcatgcttaaccattgctaaacatataaaaatctatttttggatgttcacacctaatttagggggaaaaattttagaaaccaatgggaacatatgtgctcgtttaatatttattatttatttatttattagcaatgttatttattattaatatttattaacctccccaggcttcagttttctcacctgttaaatgataatagtaatacccacctccaagtgttgttatgaatagtaaacaaaataacatatataaggtcctgggcacatactagttctcttttccttccctttgcaacaaagtagtggagccacccagtagtggagaactcagttgactataagccttcagaagtgctttttttgggggtaattttctaatgtttaaatgaaggtctgttacttacttaatatggaagctgtcttgaggcttgaaacacttttgagaatatttaccttgggcaaatacttccattttggtgactacttgtatggaaaggtgagaggaaagtttactgtaaatctctcttcctctttatatatataagtatctatatatgtatatatgtgtttatgtatatataaatacctttatttagatataatttacataccatgcaattcacccatttcaagtatacaattcaatagtttttagtatttcacagagttgttgtgcacctatcaccacagttagttaattttagaatattttcatcacctcaaaaagaaaccgcacacccgttcacaaacactctccatttcctcccatcctcttccctccctcaccctcagccctaggcaaccactaatctacttttggtctctatggttttgcctaatgaggacattttatataaatagaatcatacaatgtgtggtttactgactgttttcacttagcaagatgttttcaaagttcatccatattgttgcatgtatttgtacttcatacatttttatgactgaataatatcccattgtatggatataccatattttgtttgtccattcatctattcatgaacgttttcattgcttccaccttttggctattatgaataatgctgctataaatactcatgtacagatttttatgttttcatttttcttaggtttgtacctaagaatgaaattgcttccaccttttggctattatgaataatgctgctataaatactcatgtacagatttttatgttttcatttttcttaggtttgtacctaagaatgaaattgctgggccatgtgttaactctaaacttttttttttttttactttttttaaattttaagttctagggtacatgtgcacaacgggcaggtttgttacatatgtatacatgtgccatgttggtttgctgctgccagattgttttccaaagtggccgcaccattttacattcccactagcaatataagagggatccagttggctgggcacggtgactcacgcctgtaatcccagcactttgggacgccgaggcgggcagatcacaaggtcaggagatcgagaccatcctggctaacacagtgaaaccctgtctctactaaaaatacaaaaattagccgggcgtggtggcaggcgcctgtagtcccagctacttgggaggctgaggcaggagaatggcgtgaacccagaaggcggagcttgcagtgagccgagattgcaccactgcactccagcctgggtgacagagcgagactccgtctcaaaaaaaaaaaaaaaaaaaaaagagggatagagggatccagtttttccacctccttgctgacatttgtcattatttgtctttttgattatagtcattctagtgggtatgaagtgttatctcattgtgttttttattgcggtaaaatacacataacacaaaatttaccatcttaactatctttaggtgtatagttcccttgtgttaagtatgttcacattgtgcagctattatctagaacccttttcgtcttgcaaaactgaaactctatatccattaaacaactcccccttgccctctaaaattcttacgaattttgggatcagcttgtcaaccaccattctactttctctctctataaatttgactactctcagtacctcatgtaagtggaatcatgtaataattgtctttttgtggctggtttatttctcttagtataatgtcttcaaggttcattcatgttgcagcatgtgtcagaatttccttcctttttaagactgaataatccattgtatgtgtgtaccacattttgtttatccattcatttgttgatggacacttgggttgcatctaccttttgcctattgtgaataatgttgctatgagcattggtatggaaatttctgttcaagtccctgcatttaattcttttggatatatacccagaattggaattgctgtatcatatggcaattctgtttttaattttttgaggaaccaccatactgttttccatagcaactataccattttacatttctattagtagtgaacaagggtaccagtttcttcacattatcaccaatacttgttgttctgtttttttattgatagtagtcatcctagtgactgtgaggtggtatctcagtttttgtttttgtttttgttttttttttttaagacaatcacactctgttgcccaggctggagtgcagtgtcaggatctcagttcactgcaacctctgcctcctggtttgaagcagttctcgtgcctcagccacccaagtagctgggattacaggcaggcgccaccacacctggctaatttttgtgtttttagtagagatgtgtttttgccatgttggccaggctggtttcgaactcctggcctcaagagatccacccacctcggcctcccaaagtgctgggattacaggtgtgagccactgtgcccggtggtaaatctctttttagatcataacctcttactgtacttagctgttagtgaaaacaaattataagattccaagagtttgggtttgtttgtttgtttgtttgttttttgagacagtgtcttggtttggagtgcagttgcatgatctcagctcactgcatcctcgacctcctaggctcaagtgatccccctcagccctccgagtagctgggactgcaggcatgtgccaccatacccagctaattttttgtatttttcatagagatggggtttctccatgttgcacaggctagtcttgaaatcctgagctcaagcaatctgccctctttggcctcccagtgttagaattacaggcatgagccataagagtttggtcttatttttgaagaagatctgcttggttttggaaatgccttgaatttattttctttctggaaagtctaatcttcatattatttacttctgtttgcagcatgtatttaccatgcttatcattatacatttatgtaaacctaagacaaaacctgccacatcttaggtgcttaatatatatgtgttgaataaatatgttttctgattatgaagtatttacagtcatagtttatcttatcctttctaacacaatatgagaaaatacaagaatttatttaaaatcataaagtaacataacttcacagaaagtttaaaaaaatggatacaaaatcacatgcaaacacaccacttcaatataactactattattttaatgtattttctttaatagttttacagtttaaatgttatttagctataattatactgtacatgtaatatttctggcatcataaaaggcaatttgctctgttttcccaacattttaaaataaacattttcaaacagaaaagttgaaagaatattacactggacacctatgtaacagccacttacattctacagttgtaaacattttaccatattcgcttcatcacatatacatttgtccattagcgcatcttattttttgggtgcattttaaaatgagttgctgacaacagtacacttcccccctaaatgttttagtgtgcatatcattaactagaatccaatattttattgaagttcttctttggggtaagatttgcatatgtacaactttctgtacatacagttttgtatctttccttctttcctttttcactagacatgtaataaatattttcccgtgttaaaaacatagttttcatgaccactattttattttatttttgtttttatttttatttttttgaggcagagtctcgctctgtcgcccaggctggagtgcagtggcacgatctcggctcactgcaacctccacctctcaggtttaagtgattcttctgcctcagcctcccgagtagctgagactacaggtgtgcaccaccacacctggctatttttttttttttttttgtatttttagtagagacggggtttcaccaagttggccaggctggtctcgaactcttgacctcaagtgatccacctgcctcggcctcccagagtgctgggattacaggcgtgagccaccatgtctggccatgaccactattttaaatggatgaatactattccatcaaggaaggttatcataattcacctatttctttattattggatatttatattgtttctcatattgttcctcatttttcactattataaataatgatatgaagaacactattaagtgcaaagattatccccccacacattttcatctatttcttaggataaagtctcaaaagtgcaactattgggacaaaagatatgaactttatttgtttatttatttatttactcatttatttatttttattgagacagagtctcgctctgtctcgcccaggctggagtacagtggcatgatcttggctcactgcaacctccgcctcctggggtcaagtgattctcatgcctcagcctcccgagtagctgggattacaggcacctgccaccacgcacgactaatttttgtatattttagtagagacagggtttgaccatgttggccaggctggtctcgaacacctgacctcaggcaatccgaccgcctcggcctcccaaagtgctgggattacaggtgtgagccaccgcacccaggcgaacatttttatatgttgccaaattgctttccaaaatgccaaacaagtagcttctttaagctatttagtctggatgctcatttcccatcataatatgtcaaatcatttgttcttctgggtaatttggagtgcagttattaactccatgtgtttttagtgatacaaatgaaataatacttagtatgaaagtcagccgggtgtggtggctcatgcctgtaatcccagcactttgggaggttgaggcgggcggatcacctgaggtcaggagttcgagaccagtctggcctacatggtgaaaccccatctcaagtaaaaatacaaaaattagccaggcattatggtgggtgcctgtaatcccagctacttgggaggctgaggtgggagaatcacttgaacccgggaggtggtggttgcagtgagccgagatcacgccattgcactccagcttgggcaacaaaatgagactctgtctccaaaaaaaaaaaaaaaaaaaaaaaggaagtcatcatttgatcaactgtggcattgaggatactatgtgatggagatggacatgataattagccccagaataataagtgaaatgacaaccatgctgcattaggctgtttgcattgctataaaggaaatacctgaggctgggtaattgataaggaaaagaagtttatttggctcatggttctgcagatcatataagaagcatggcactggcatctgcttccagtgagggcctctggaagtttccaatcatgttggaaggggaaagggagcaggcatcacatgatgagagaggaggaaagagaaaggaggaggtaccaggctcttttttaagaatcagatcttgcagtaactaatagactgagaactcactcattactgtgaggacagcaccaagacaatgagggatccatccccgtgacccaagtacctcccatcagccccacatccaacattggggatcaaattttgatatgagattctcaggggaaaaatatccaaactatatcacatgttaaataaatcatctgtttaaactgaagctcatcagaaaaatgtgaaatggtaagtgagaaaagtggcatggaagaaaagacttaaaactaacatacattttgtaccactgctgtgcataaattgggttaaagaaaagaaataaaacaaagaataaatgatacaaagtaatataattaattgccaaattgtatacaacttaatgaatatatgaattcaaagaagaaagaacaacgtagactgtaatggttgctgaaagcttcatttatgttgttggtgagactgaaatggatttgagttacataaaaacaaagggaggaggtatatcaggtgaaggtatatcaatagtatgaataaagacacattgataggaatgaacaagttgtgttcaggaaatagataattactctaacagtgggtaagtttttgcggggagaggtagaatgcgactagattatggagggcctggaaatgacccacaatagttacataagcatacaacattcaagaatgaaaataccgttggaggtggccagtattttaactaactaaggaaatgtttctctttgaccagattgaagaaatggcagtaaacctatggaactgggcacttaccataggaggaggttggcttgtaaatgaagagcagaaaattagatgtatgtatacatattgtgacatgtattatgaggcgtgttcttactatatattgggtagtattcctgcagtttaaataatgttttgacccattcttagatagagatttgttaaaagacaaacaaaacaacccaggaacaatggtttctcaagcaaatggcctccctcagttttatgatttttttttcagaggttagctccttattaacaaacgtttaaagatatcactgcaagaaatagtcaggaggtgaacaacaaagatgattaaaaggtgggacagtgagaacttaaagaaatgttaaaggacatggattatttctcatggagatgatcaaaatcttcagggttctgaaggaccatcaaatagtagtttcccctctattaataatagaataagtgttgccatatgacatattcagattttaaaaagtgtaaagaatagtttcctcaggagatggattgataaacattggaatgagttactgagaaactatagaaatgatttctacctgtgagagcaaacaacaagaacaaaaaaaccaaaaatctcaaactaaactcatcttcttggatgctttgaatgtggtccactgtctggcaatgttctagtgctttagctaaatgggcaaagtctagtgtgctgacagttagtgattttcaacaggcatagtgacagcaaatgcatttatgggaagtatattgccaattataaaggatacattgaagtaacataccaaagggtgaacctctggactgcttgacattgtaaagacaaatgacttttgtctgtatgcaacaaatataatttactactaactatttatctttgtgaatatgaacaaaactgtatacaacttccgtgtagatatagggtaattgtgcttaatataatcaagaatatacttgctcatgagtccactctattagcatgtttagagaacagttctagctctttaactcttagataaattgatatcattgctcccaggagcctcagatcctgtagttatggggaggtaagagctaggaatttatcagtggaagaaacttagtacacaggtgaaccgtgtgatattaaagtgcgttaattcttaactcctaccattctgcatatgaggaagtattgctttagctgtttactgcttatcagatagggatatggtagatgaagtgggtgtcacagcctcttcccatgtactgtctcatttctttttttctttttcttttttttttttaagggacggcaaggggtgagggcagaaccacacagtgttgatggggttagggccagggagatgagagagctagggaagagaaaagagactgttaaaaaaaagggggggtgctgtaagaggaaaaatactaaatgggtggggaaagtggagaaaaaagggggaagcaagaagaggagaaaggcaagaggggagagaagaagagggaaaagcaagagataagagaagaaaagggaaggataagagaggggacaagagacagtaaagaagagagtcccatgtactgtctcatttcacgtagcagttcttaatcagatatttgggtgcttgttatgtgtatcatactttttttgatacagtggagaatagattatcagcgcaggaggcctccaaattaaaataattttgtttcaaaaatatgtttattggaatatattttgtttccttaaaaacaaatttagtgtgcctggatgtgatgaaataagtcatgaagatttataagctataattctttattatttggaggaattatggaacaatgaacaggaaagtcagaagtagatgaatgacttgtaagttttagttttagacctgttgcatttgagatgacaataaggttggagatgtgagactagagcttatgagaaaggtcaggactgagcctacagatttggcaatgatttacacagaggtggtagttgaagacagaagagtagttgagttctttgaggaaaaaaataaagagcagtggttcttaaatattggtataaatcagaatcaggctggtagcggtggctcacgcctataatcccagcactttgggaggcctaggtgagtggatcacctgagatcaggagttcaagaccagcctggccaacgtagtgaaaccccgtctctattaaaaatacaaaaattagtcgggcatggtggtgtgtgcttgtaatcccagctacttgggaggctgaagcaggagaatcgcttgaaccctggaggtggaggttgcagtgagctgagatcgcaccattgcactccatcctgggcgacaagagtgaaactccgtccctccccctccccccaaaaaatcagaatcacctgtgaagcctgtgaaaaatacagatgcccaggcccttccattggtggttttgattcatttaggttcaggatgaaacctgggcatgtctataatttgaaaaaatgtctcaggaattctcatgcacaccaaaatttaagaatcagtggtattgagagaagaacaaagtagtgagattttaactctgaatctaccagcttcaaagttaaaataaaaagaatagggatagatgaccaaaaggaacagtcaaaaaattctacaggagattggccaggcacagtggctcacgcctgtaatcccagcactttgggaggctgaagcaggtggatcacgaggtcaggagattgagaccatcctgactaacacagtgaaactccgtctctactaaaaatatgaaaaattagccatgcgtggtggtgggctcctgtggtcccagctgctcaggaggccgaggcaggagaatggcgtgaacccaggaggcagagcttgcagcgagccgagattgcgccactgcactccagcctgggcaacagagcaagactccctctcataaaaacaaaaaaaaattctacaggatatttattagtcatttattgagtgcattctccgtatagggttctcgtaccatgttatggtacatagtaaatgaaagggaaaaggtaagataccagaacaaagataccaatcttaaattatgcttgaggatttcggaaggaatagtttaaagctagataaacaataatttaaaaatttataaatgtcagagggtataaccccgtgtttatctaaagtcaattcaatttcaggctgtgggtagagcagagtaaagcggatgttcaaaggtatcagtcaccaattatgtaaccaagatgtttataatatagagaggtcaagaacaggctggtgagaagacaagatggagcaacagcaacaaagaaaacatctttatatggaagtagcattctgtttcagcctcagctgcctttggcttgaagacttattggtgataactataaacagctggattatgaatgtcaggattggagcagacaaagttcttagactaagatatttcccacacaaggaccaggatatttcaggccaagagggtaatttttttttttttgagacaggatctggctctgtcacccaggttggagtgcagtggtgcaatattgactcactgcaacccctgcctcctgggctcaggtcaacctcctacctcagcttcccgagtagctgggactacaaggcatgtggcatcacaccttactaatttttgtattttttgtagatacaggttttgccatgttgcttaggctggtctgaaactccaagggagtaatatttttcaaaaaggttatggccattttgaaatgttgctatgaagttaaggaaggtgatctttgggagtgcagttttagtaaagtggtaaggatgcaaaacagattgtggacatttaaggagatgagtgggtagcaagacagtagagctagtagacagacttttcaattcaagaagcttgtcaatcaaaggaagaggagaaatgggatgcaagcttgaagcatagtggggttagttgattttttttttcaaggtaaggagatgggtacgtttgaaggtagagaagaaggaataagttgagagggaggtactcaagatacttttagaaaggggcaataattgagagatcagagtctttgaaaatactgaaggattagcaaactttggaactttggaataaagaaaggaaacattttctttttcttttctttattttattttgttttattttattttattttattttattttattttattttattttattttattttattttattttattttattttattttactttaagttctgggatatgtgtgcagaacacgcaggcttgttacataggtatacatgtgccatggtgatttgctgcacctatcaacctgtcatctaggttttaagccccgcatgcattaggtatgcgtcctaatgctctccctccctttgcccccacccgctgacaggcccgggtatgtgatgttcccctcccttgtccatgtgttctcattgttcaactcccacttatgagtgagaacatttagtgtttggttttctgttcctgtgttagtttgctgacagtgatggtttccagtttcatccatgtccccgcaaaggacatgcactcattcttttgtatgtctgcatagtattccatggtgtatatgtgccacattttctttatccagtctatcattgatgagcatttgggttggttccaagtctttgctattgtaaatagtgctgcaataaacatgcgtgtgcctgtgtctttatagaagaatgatttataatcctttgggtgtatactcagtaatgggattgctgggtcaaaatggtatttctggttctagaaaccagaggaatcgccacattgtcttctacaatggttgaactaatttacactcccaccaacagtgtaaaagcgttcctatttctccgcatcctcaccagcatctcttgtttctgactttttaatgatcagcattctaactggagtgagatggtacctcattgtggttttcatttgcatttctctaatgaccagtgatgatgagcttttttaatatgtttttttggcctcaaaaatgtcttcttttgagaagtggctgttcatatccttcgcctactttttgatggggttgtttgtttttttcttgtaaatttgtttaagttccttgtagattctggatattagacctttgtcagacggatagatggcaaaaattttctcccattctgtaggttgcctgttcaccctgacgatagtttcttttcctgtgcagaagctctttagtttaattagatcccatttttcaattttggcttttgctgcaattgcttttggtgttttagtcatgaagtctttgcccatgcccatgtcttgaatggtattgcctacattttcttctagggtttttatggttttaggtcttatgtttaagtctttaatccatgttgagttaatttttttataaggtgtaaggaaagaatccagtttctgttttctgcatatggctagccagttttcccaacacatttattaaatagggaatccttcccccattgctttttttttgtcaagtttgttgaagatcgaatggttgtagatgggtggtgttatttctgaagcctctgttctgttccattggtgtatatatatttgttttggtaccagtatcatgctgttttggttactgtagccttgtagtatagtttgaagtcaggtagtgtgatgcctccagttttgttctttttgcttaggattgtcttggctacacgggctcttttttggttccatatgaaatttaaagtagttttttctagttctgtgaagaaagtcagtggtagcttgatgggaatagcattgaatctataaattactttgggcagtatggccattttcatgatattaatctttcctatccatgagcatggaatttttttccatttgtttgtgtcctctcttatttccttgagcagtggtttgtagttctccttgaagagatccttcacattccttgtaagttgcattcctaggtattttattctctgtgtagcagttgtgaatgggagttcactcatgatttggctgtctgcttgtctattattggtgtatgggaatgcttgtgatttttacatattgattttgtatcctgagactttgctgaagttgcttatcagcttaaggagtttttgggctgggatgatggtattgtctaaatatacaattatgtcatctgcaaacacagacaatttgacttccactcttcctaattgaatacgctttatttctttctcttgcctgattgccctggccagaactttcaatactgtgttgaatgggagtagtgagagagggcatccttgtcttgtgccagttttccacaggaaagcttccagcttttgcccattcagtatgatattggctatgggtttgtcataaatagctcttattattttgagatatgagagtttttagcatgaaatggttttgaattttattgaaggccttttctgcatctattgagataatcatgtggtttttgtcattggttctgtttatgcgacggattacgtttactgatttgcctatgttgaaccagccttgcatcccagggatgaagctgacttgatcgtggtagataagctttttgatgtgctgctggattcgatttgccagtattttattgaggattttcgcattgatgttcatcagggatattggcctgaaattttcttttctgttgtgtctctgccaggttttggtatcaggatgatgctggcctcataaaatcagttagggaggagtccctttttttctattgattggaatagtttcagaaggaatggtaccagcccctctttgtacctctggtaggattcagctgtgaatctgtctggtcctgggatttttttttttttttggttggtaggctattaattactgtctcaatttcagaacttgttagtggtctattcagggattcgacatcttctggttttgtcttgggagagtgtatgcatccaggaatttatccatttcttctagattttctagtttatttgtgtataggtgtttatagtattctctgatggtagtctgtatttctgtgggatcagtggtgatagcccctttatcatttttactgtctaattgattcttctctcttttctactttattaatctggttagcggtgtatctatttgcttaatcttttcagaaaatcagctcctggattcattgatttttttgaagggttttttgtgtctctatctccttcagttctgctctgatcttagttatttcttgtcttctggtggcttttgaatttgtttgctcttgcttctctagttcttttaattgtgatgttcgggtgttgatttcagatctttccagctttccgatgtgggcatttagtgctgtaaatttcccacttaacactgctttagctgtgtcccagagattctggtatgttgtctctttgttctcattggtttcaaagaacttcactatttctgccttaatttcgttatttacccagtagtcattcaggaacaggttgttcaatttccatgtagttgtgcggttttgagtgagtttcttaatcctgagttctaatttgattgcactgtgttctgagagactgttttgatttccgttcttttgcatttgctgaggagtgttttacttccaattatgtggtcgattttagaataagtgctatatggtgctgagaagaatgtatattctgttgatttgaggtggagagttctgtagatgtctattaggtctgctttctccagagctgagttcaagtcctgaatatccttgttaattttctgtctcgttgatctgtctaatattgacagtggggtgttaaaatctcccgctattattgtgtgggagtttaagtctctttgtaggtctctaagaacttgctttatgaatctgggtgcccctgtattgggtgcatatatatttaggatagttagctcttcttgttgaattgatccctttaccattatgtaatgcccttctttgtctcttttgatctttgttggtttaaagtgtgttttatcagactaggattgcaacccctgctttttttgttttccatttgcttggtagatcttcctccatccgtttattttgagcctatgtgtgtctctgtgtgtgagatggttctcctgaatacagcacactgatgggtcttgactcgttatccaatttgccggtctgtgtcttttaattggagcatttagcccatttacatttaaggttaatattgttatgtgtgaatttcatcctgtcatcatgatgctagctggttattttgctcgttaattgatgcagtttcttcatagtgccattggtctttatattttggtatgtttttgccgcggctgttaccggttttttctttccatatttagtgcttccttcaggagctcttgtaaggcaggcctggtggtcacaaaatccaacagcatttgcttgtttggaaatctcttttgctcgtgaagcttattttggctggatatgaaattctgggttgaaaattcttttcttttcttttttttttttttttttgagatggcatctcgctctgtcacccaggctggagtgcagtggcatgatctcggctcactgcaacccctgcctcccgggtttgagtgattcttctgcctcagcctcccgagtagctgagactacaggtgtgtgccaccatgcccagctaatttttttttttgtatttttagtatagaaagggtttcactgtattcgccaggctggtctcgaactcctgaccttgtgatccgcccacctcggcctcccaaagtgctgggattacaggtgtgagccactgcaccccgctgaaaattcttttctttaaaaatgttgaatattggcccccactgtcttctggcttgtaggatttctgcagagagatccactgttattctgatgggcttccctttgtgggtaacctgacctttctctctggctgcccttaatatgttttctttcatttcaaccttggagaatctgatgattatgtgtcttggggttgctcttcttgaggagtatcttagtggtgttctccatatttcctgaagttgaatgttggcttgccttgccaggttggggaagttctcctggataatatcctgaattgtgtttttcagctgggttccattctccctgtcactttcaggtacaccaatcaatcatacgtttggtcttttcacatagtcccatatttcttggaggctttgtttgttccttttcactcttttttctctcatcttgtcttcacgccttatttcagtaagttggtcttcaacggtcttcaatctctgacatcctttcttcgcttgattgatttggctgttgatacgtgtgtatgcttcacgaagttctcctgctgtttttcagctcatcagttaatttatgctcctctctaaactggttattctagttagcagttcctgtaaccttttatcaaggttcttagcttccttgcattgggtagaacatgctcctttagctcagaggaatttgttatacccaccttctggagcctacttctgtcaatttgtcaaactcattctctgtgcagttttgtgcccttgctggagaggagttgcgatcattttgaggggaagaggcattctggtttttggaattttcagcatttttgcactggtttttcctcatcttcgtggatttatctacctttttgatctttgaggctgatgatctttggatggggtttttgtgtgggggtcctttttgttgatgttgatgttgttgctttccatttgttagtttttcttctaagagtcaggcccctcttctgcaggtctgctgcagtttgctggaggtccactccagaccctgttcacctggttatcactagtggaggctgcagaacagcaaagattgctgcctgctccttcctctggaaactttgtcccagcggggcaccagcctaatgccagctggagcttttctgtatgaggtttttctcgacccctgttgggaggtctctcccagtcaggaggcacgggggtcagggacccacttgaggaggcagagtctgtcccttgtcagagcttgagtgctgtgctgggaggatcctccttgttaggatcagctgctctcttcagagccggcaggcaggaaagtttaagttcactgaagctgtgcccacagacgccccttcccccaggtgctctctcccagggtgatgggagttgtatctataagcccatgactggggctgctacctttctttcagagatgccctgcccagtgaggaggaatctagagaggcagtctggccacagccgctttgtcgcactgtgttgagttctgcccagtccgaacttcccctcttctttttttttttttttgagttggagttgtgttcttattgcccaggctggaatgcaatggcatgatctcaactcactgcaacttccgcctcccaggttgaagagactttcctgcctcagtctctctagtagctgggattacaggtatgcaccaccactcccagctaattttttttttttttttgtatttttactagagatgtggttacaccatgttggtcaggctggtcttgaactcctgagctcaggtgatttacccacctcagcctcttaaagtgttggggttacaggtgtgagccaccatgcccagccaaaaagaaacattttcaaaaattttcagaactggaaattcaagtcagtataaatatatgattagtaattattttaccaaaagtgttttttagaatgaattaattttgttaagtgatgaataaattttacactttatgatgggcaataaaaatctgaccatttcaattaccctgtaatttccgctagacaaatctctttttcaaaggactattaattagaagtggtgttagcataggtagaatggctgctgacatctaacataaaggtgactagttcatttatttgtgaagctgttttttaaaacttgaatatgttttatgctgaaataaactagagaaataaagaggttataattattcaaacttccctattttcagggaaaatgagttatataatgaagtagtctgtatcttctaaattatactttaagaactgttatgacatctacagaaaagaatatgtttaggccaggtgtggtggctcacacctataatcccagcactttgggaggctgaggttgggaggattgcttgagcccaggaatttgaggctgcagtgagctatgatcatgccactgtattctagcttgggtgagtgacagagcgagaccccctctctacagaaaaaaatatatatatatttagaaagtttcacattttaggagagaaatcgaaaactattctgatgtccagagattttgtcagatgttgaacagctttagatcaattgaatttacaattatttttctgttaacatggtatacacaagagcatcatgtggaatcaggtatttttagtgagtctttgggacttaagaccttaagaaattaaaatttaagtattaaatatctctctgggccggttgtggtggctcacacctgtaatcccagcactttgggaagccgaggctggtggatcacctgaggtcaggagttcaagaccagcctggtcaacgtggtgagtccccgtctctactaaaaatacaaaaattagctgggcgtggtggcgcatgcctgtaatcccagctactcgggaggctgaggcaggggaatcactggaacctgggaggtggaggctgtagtgagccaagatcatgcgtcactgcactccatcctgggcgacagagtgagactccatctcaaaaataaataaataaataaataaataaataaatctcttactgaaacattcagtaaatgattcatttaataagttttaggtcatttacttttgaaaattgattttttaaaaagtcctttacaggccgggcgcagtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaggcctttacaatttttatttttaataacaacaaaactggcttccttcaattgtcttttctctttggtgtatataaaaggagaatgaatgttttgtgtttatcattgtctaattactgttttgcagtacattatgttgcttgcaagttgctgagtatgtgtgaagcctcatttgcctcagaacaaagtattcaacgactgattatggtaagtcttaatttaggagaaagtggagatgaaatgagatggttgttacttctatgaaaatggtaaagttagtgtgaaactggaagggggttgaatcttttagtgctatccttttttgatggtgttccttttcagtgttccttttataatggtatatttactacgctaaagttctcagaatactgtagtaattacggtggttcagtgaaccaaatactgaacttataattctgggttgatgatttattttttacttttctcatctctaacttgatagagtaactgtttcttcatctaagggaatggtaatacttagttctaaatgagtttttcaaatgaaaaatttgaagcactaagtaaataaggaaaagggtacaggatttgaagtctcaagacctaggttaggtctgccgcttactagctatgtgacattggaagattacttagttttctcttttgtaagatgaaaatagtaatatctaccttagagtgttatagagttaaaattagagtttttgtgaaaaatgctttgtaaactataaaatatatgtgtaaatacatagtggtagaatttgtccatgtaaaatgctatgacaacagtctgataaatcctgtatcatatataatatgataaaactgagttgaatgcagggttcaccttgtgtgttttccttctttcaaagattgtagccactccaatgccttcacacagttatattttgtccagcttttagggttgtttagagtgggacagtcagtttgaattgagctattccatcatggctgaaagtggaagtcttcctcttgcatttctgttatttaaaagattttttccttataatttttattttgagagggagtcaccctggctggaatgcagtggtgtgatctgggctcgctgcaacctccatctcctgggttcaagcaattctcctgcctcagcctcctgagtagctgggattacaggcatgcgccaccacacctagctaatttttgtatttttagtagagacagggtttcaccatgttggtcaggctggtcttgaactcctgatctcaggtgatctgctcaccttggcctcccaaagtgctgggattacaggcatgagccactgcgcctggcctaaaagattaattttttaaacatttatttccaccccccaaaatacaaatgtatgtttatgtaaaattaaattgttcagaaaagtaattaaagtaataaaaagtgattttctgctccatctatctgttctctctttttttttttttttttttttggacaggatctcactctgttgcccaggctggagtgcagtggtgtgttctcggctcactgcagcctccacctctcaggttcaagcagttctcctgcctcagcttcccgagtaactgggattacaggtgtttgccaccatgcccagctaattttttttttttttttaagtagagacagggtttcaccatgttggccaggctggtcttgaactcctgacctcaagtgatccacccgccccggcctcccaaagtgctgggattacaggagtgagccaccacacccagccctatctgttctcttgctccttagaggcaaatacatttttttagtggaaaaatatttttcccagtgttttaaaatattttattatgtaaaaaagctcaaacatatataaaaaaggtaagacagtacaatgattccctccatttacccatcactcagttagagtaatcatcaactcatggccactcttgtttcttctatatctcctcaaatagcaaactcctggccccactggattatttttattattttttatttttttgagatagagtctcgctctgtcactcaggctggagtgcagtggcacgatctcagctcactgtaacccctgcgtcctgggttcaagtgattctcctgcctcagcctcccgagtagctggaattacaggcgcccaccaccacacccagctaatttttgtatttttagtagagatggggtttcaccatgttggccaggctggtcacgaactcctgagctcaggtgatccgcccaccttggcttcccaaagttctgggattacaggcatgagccaccgcgcctggccaacccactggattattttcaagcaaattcaacatgtataattttgcccataaatatttcagtgtgtgtttctaaaagacaatgtattttttttcagcttgtaaatgcttaatttttttaaacatagaggatgcttggtggtgtatatgtggccatttgatgtttttatgactaagagagttcaatctcttatagaatgtaaatgtacccctacacatttatttatttatttattttctattttttccataaattattggggtacaggtagtatttggttatgtaagttcttcttcttctttttttttttttcttgagatggagtctcactctgtcgcccaggctggagtgcagtggcatgatcttggctcactgcaacctctgccacctgggttcaagcaattctcctgcctcagcctcctgagaagctgggattacaggccactgcacccggctaatttttgtatttttagtagagacggagttttaccatcttggccaggctggtcttgaactcctgacctcgtgatctacctaccttggcctcccaaagtgctgggattacaggtgtgagccactgcatccggccatgagtaagttctttagtggtgatttgtgagattttggtgcacccatcacccaagcagtatacaaggcatcgtatttgtagtcttttatcccttgcccccctcccactcttccctccaaatccccaaagtccattgtatcatttttatgtctttgcatcctcgtagcttagctcccacatgtcagtgagaacatacgatgtttgattttccattcctgagttacttcacttagaataatagtctccaatctcatccaggtcactgcaaattctgttaattctttcctttttatggctgcatagtattcagttatatatatataccacagtttttttatccacttgttgattgatgggcatttgggttggttccacaattttgcaatacacatgcacatgtaattcttatcaaaattaagcttagtcactaaaagaagattcgctatctgaactttgttctgcaggattttcacttttgccatcaggcactggagcacctgacctctcaagaagatctgggtctagtccttctgatatcatttttcttattgccatcactggtacactcacttgaaccattttgagatatatgacatatcttgaatctttagctacagttaagatatttcctgctgatacttaactttcctgtggtccagagtcttaatgtactgtcctgctgtgattactctgaggtgacttcagaatgtgatccatttgtgacactagtggcacttgaaggagatacttcaaatgtgacatcatctaggcctggtatagatgacaactttgcatctacagtattgagaattgtttcaatttgctggataccaagataaaggtttgccagtttctcctcactaaatgtagaagagcgattgaggcactatacagtgtgtaccacattttggtttagaaaagccaccattcttttctgctgaatagctggcaccttgatcaagtctacgcctgactcccatgagaggaagcccatctttatccatctcctcaggaggcaggagacccaggactcacccatgaactcctcccagatggggcctgcccaaccctgtaatcgtgtcccagtgcttccccacgtcccccaagacaatgtatttttatattcaacaaacccagttcactttaccacacctgataaaacctaacaaagatttccccaaatcaaatatctagtcctcccaccccctctccaattggtttcttaaaatcaggaccaaagataatccatactttgtattttgttaatatgtctgttttaatgaaactacatgttttcttctcttttttttaaaaaaaaaatctgttgaacggatttatttgttgaagaaatgaggttgtcctatagagttttctaaattctgggttctggtgcttcttcatggtgtcacttaatagtccatcgtttcctttaacccttattttctgtaaactgataattagatctagaagcttgttctgatacaggtttgatttttgtcagaataatttataggcagtatgtttctgaatccttggattcaaccaatcatggattgaaaatattaccaaaaaagtcttaaaaagataacaatacaataaaaaataatacaaataaaaatacagtataacaactattcacatagcatttatattgtattaaatcatctagagatgatttatagtacatgggaagatgtgtataggttatatgcaaatattacaccatttcatgtaagagattatataatgtatttttatatttcaaaatataaaatattttaaaatatatgtacaaaatttatataaaatatgtgtttataagcagacaaatatatactcatatctcccctcattccgccattttcttagataaatggtaacagtccatatatactcttcttcacctgattttttccccctcgtttaacattatatcctagggattactccatagaaatatatagagatattccttatttttaatagctgtatttcaattgctgtatgtaccttattatgttcaaccagcctcccttgatggacatttggatgctgcaatgaattgccttgtgcctatgtctttgccacttttaaggctattactataaccatttctgttttcactctcatggttccctctatgtatcttagtcatatgcttgtatcactgtattggtttgctagggctgccataacacaatatcacaggttggttggcttaaacaacagatatttattttcccacagttttggaggctagaagttcaagattaaggtgtcagcaagtttgatttcttctgagtactctttccttggcttgcagatgttcgccttcttgctgtgtcctctcacatggcctttcctctgtgtgtgctcatttttcgtgcccatttgtgtgtccaaatttcctctggttataaagataccagtcagatgagattagggcccgccctaatggcctcattttaatgcaatcacttcttaaagcccctatctgcaaatacagttacattctgaggtgttggaggttagggctacagtgtaggactttgaagggacataattctgcttgtaacaataactaattcttttttttttttttgagacagagtctcactctatcgcccaagctggagtgcagtggcatgatctcagctcactacaacctccaccttctgggctcaagtgattcttgtgcctcagtctcctgaggagctggggctacaggcatgcaccaccacgcccagctaattttttgtatttttagtagagatggggttttgccatattgcccaggctggtctcaaactactgagctcaggctttccacccgcctcggcctcccaaagtgctagggttacaggcgtgagccaccatgtctggccaataactaattattgatttatcagctttatttatgatctatttatttgctattatgatggatgaggatttatctcatattatatcatgttacctccccatcccctctcaatttttgttagttatattatactattttaaatttatctgttggctgtcttttaaaacttaattatatatatttttatatacacacatataattttttgtatatatttcaaaagtatactttttattgagacagggtcttgctctgtcacccaggctagagtgcaatggcgcgatcttggctcactgcaaccttggcaccccgggctcaagcaatcctctcatctcagcctcccaagtagctgggaccacaggtgtgcaccaccatgcccagctaattttttgtatttttagcagagatgggggtctcaccgtattgcccaggctggtctcgaactcctgagcttaagaaattcgtccacctcggcctcccaaaatgctgggattacaggcatgagccacggcgcctggcctaaaataacatatgcttttttttttttttgaaacagggtcttgcctgttgcccaggctggagtgcagtggcatgatcatggctcactgcagccttcacctcccaggctcaagcaatcttcctgcctcagcctccctaatagctgagaccacaggtgtgcaccaccatgcccaatgaatttttaaattttttgtagagacagggtcttgctatgttatgttgctcaggccggtcttgaattcctggcctgaagtcatcctttcacctcagcctcacaaactgctaggattacaggcgtgagccacaccatgctcagccctaagtcatatatttaaacttttctttcttttttttttaaaatcaaatttggagtttatctctttacttgctactttgtgaggatatttccattctttctatctctctttccctttaaccttccaccttctgtcacctctaacatttgcattttgggctttgttgatccctaataatgaaaactgaaaaggcatgttattgattgtgactattatttaactctgtggattataatttggtatctctgtatgtttccatctgctagctctctcaattctattttctcagttattctgtttgttgagtgtgatgtcctttcatggcattggtttccctcaattgtttggtaattcttgctcatatttgatttgaaattctgtgatgatcttctatgaatattgtgtcacactgtgtactataacctgaatccagtgactgatgaagaggtaggactggatgtttttcattaacctgtgttgtcagccacctagaactctgtttctgtccagccaaagtaattgtactctctgttcctttctggagaggagggaggaagatacctttcttggggaggcctattgcctgatgttcctactgttcgcatccagggctgtttccacattttgcatttttgtgcatgttgggatatctaccagttacaatactgtgagctccttcagtgagactggaatataaaggtacttaataaacatttgttggattaatccaaattttattgcagatggaattaaaaactagaaccccagtagtctaatgcttatcatatgcctttcttcaagtatgtgaagcattaagttttcagaactttctcttcctatctaagttacttcaacgttttcttttaatatttcctcagaagatgtgtttttaagtctattaatttttgctattatttttgtctttatgaccatttcttttaaattgtggagttcaaagtagaacacagaactctaacaaatgctaactgttgctttttgttttctgtgagttataagactgaatatggacagaggattcaatattttctccaatattcccccaccaatttgggggaggtatgaatttttaaaaattattttctaatttctctcttctagatgaatatgagaataggaaaagaatggttggatgctggaaattttctaatcgctgatgaatgttttcaagctgctgtggccgtaagttaccattgacttttagctgaggcaattattagtagtaacatctgtggttattctcattgttacattgtactgtgggtttattttccagagtctggagcaattatacgtcaaattaattcaaaggagctcccctgaggctgacttgaccatggagaagattactgttgagagtgaccacttcagagtgctttcttaccaagcagagtcagtaggtatcgtgggcaccagggtcttccagtggggcattttccatatgtaaaagtaaaagtgatgatatatagcctattggaagaaagtcagatgtcactggccttttataggatattaatttgacctttttatctctgttatatctgaaggtgatgttactaatgctgattggaatctatggggtggctaagggtgagaagactgatatacagctaaacatcattttcaccccctgcatgtaacatctgtcatttatttatggcagcaatccctacttgaaacacctgtctctgtgactctctcttacattcacagtctgcctaaaatatttgcctgaaaagagccttctcatttgcagttgttctgagttgtctattgatgctttctaaaagtctgctgagatcatacactgtttaaagttatactttacctctgtttatcttgtgggtttcctccttttgccatcatacacttaggtgtgcatttgagctatgatgagtttgctttctgttattacgcaattctggaaatgaaaaatccccagctgggcatggtggctcgtgcctgtaatcccagcactttgggagcctgaagcggaaagattgcttgagcccaggaattggtgaccaacctgggcagcatagtaagacccccatctctaccaaaaaataaaagtgaaaaattagccaggcttggtggtgtgcacctgtagttccagctactagggagtctgaggcagaaggattccttgaacccaggtgacagtgagctatgattgtgccactgcactccagcctgggtgacagagctagactgtgtctcaaaaaacaaacaaacaaaacaacaatgaaaaagaaaagtccccttttttattttttgacatatttactgagatataattcatataccataaaattcacccatttacactgtgtaattcagtaatttagtatattcacagaattgtgcaatattcaccacaagctaagtttaaaacatgtttgtcaccccaaaaagacatccccatcagcattagcagtcattcctcattgcttctgaccctagctctagcaaccgtgaatttattttctgtttctatagatatgcctattttggacatttcatattaatataatcatgcaataagtggtcttttgtgattagcttctttcatttagcataattgttttcagggttcatcagtgttgttgcatgtttcactgtatgaatatgccatgttttgtttatccattcatctattgatgaacatttgagtggtttccaatttttgtctattgtgaataattctaatgtgaacattcatttactctgtgtgtgtgtgtgtgtgtgtgtgtgtgtgtgtgtatgtttttaattttctttggtatataactaagggtggaattgttgggtagcatggtaactctaagtctgtgtttaaccttttgagaaactgccagaatgttttccatagtggctgaactattttattacacttcccccagtagtatatgagggctccaccttctctacatctaaaggttttatagttttagcacttacacttagatctgtggtccattttacgtaaattttcaggtataatgtgaagtagtggtctaacttcattcttttgcatgtggctattcaattgtcccagtaccatttgttgagaagactattctttccccatattgaatgaccttagcacctttgtcaaaaatcaatttatcataagtgggagggtttacttctggactcttgattctattccatttatctgtatatctagccttatgctggtaccacacttgtcttgattactgtagctatgtagtaagtttcaaaattgggaattgcaagtcctccagttttgttctttttaaagagtgtttggacttttctgggtcccttacatttccatatgaatgttaggatcagcttttcaattggtgtacagaagccagctggaattttgatagggatagcattgaatttatacaacaatttgggggatattgttatcataagaatattgtgttctgatccatgaacatgggatgtcttttcatttatttaggttttgtttaattttctctcatttatttatttttatcttttttttgtagagacaaggttttgctatgttgcccaggctggtatcaaactcctggcctcaagcagtcctctcaccttggcctctcaaagtgctgggattacaggcgtgagccaccatgcctggccagacctatgtgtggtatttttgttgttgttttagagacaggatcttgctttgttgcccaggctggagtaatgtggcccaatcatagctcactgcagcctcaacctcctgggctcaagggatcctcctccctcaacctcccgagtaggtaagactatgggtgtatgccactgtgcctggctaattaaataaacattttttttttttttttgtagagggagggttttactatgttgtctaggctgttcttgaactcctgggctcaagtgattctcccaccttgccctcccaaagtgctggaattacaggcatgaaccactgcgactggccagacctatgtgttttaattgtccacaagctcaaacttaaatcagtgatgtgacgtaactgcaaaaaaagctagcacagtcctaggctatgttaatagatacatagtgtcctcatctaggtagttaattcacattttgaatattgtgataacttctaggcatcacattttaaaatcactgggttggtgtacaaaatatatgaaaaatatttggagaatatagtgatgtttgtctcagaaaaagaagacagtaggaatgatagctctctttgaatattttaaggactattgtattaaaaaggaattaaactccacaggatggaatgaagaacaatgggtagaaattataggaagacagattttggcttaatataaggagtagccttttatcagtgatagtaatcctataatggaatagctttcctgcaagattttaaatctgttttcactggaaatttgtaagcaaaggtgtgaatatcctaagaattatacattgcagaaggaattccttcatttggtaggaaatttgactactatgacccttaagtcccttttaacaccaagatcctatgatttcagaaagtcttgtagcatttgttcagtgtggtggatgttgatatctaaatggcatctttatatagctggttaaaagtgttagttgttataatcagtaatgagaactatataattcttgactttgataagtgatgacatcttcagaagttgtggtgaaggctaattccttttgctctaagttaatttttcatttctaagacattcgcaccattagagtttatgagttttgttgatatttgcttgggagaagacatctttaaaatggcggttaatagcggtgtttgataatgagttttctctgtcctaataaagctcctgagaggccttatctttctctaggcacctaccatttaaccagttagataattgctttattatttattaagttattcaacagacaaggaatatcttctatgaacagactactatgctaggttttgtggaataatgcaaataatcacatatcctatcctcaaggattatagtttaattggtgagataaaggatgcatatgcaagatagaaaaaattgggtactataatagttgtacagataagtgatctacatgcagtgttcagtgctatgtgtgagtggagatgtaatatatggtcattttccttaagaaaattataagctagtttgagagataggtcatgaatacattttctaaaactggaaaaagaaaaatattaagtgccaaatgaatgacttaggttaggtgggacacagactttgtctaaagtggtcacatgaccttcctaacaattgttaacattttatttttcctcaatccctatatccacttgcaaggtgaaggatacttttctgtgtatgcaagtgccagattacccttctgtaatcttttagaattgtaaaaataactatagatcttggtgtttctcctaattccccatttcccttggttactggcaatgcctctttctgcagtgtgcatcatctgcagatgcaagggtcgtatgttttgcttctgctccctcccctatttaaagtaggaccacttgtagaagctgacagggtcacactgaggaaggggctatgagcttacctataaagactatgatggaggctatcctggagatacaagccaagtgaaagccagctttctctattatatcaaggactttggttcaccatctttcctagtagttaaaaaagtagtaatgtaaaaaaattaatctgcattgtcagcttctagcatagtacgtagcatataatatatattatgtaaatgtgtgtggtacaaatgaatctgctctccccctattattcctttctgatctttttgcaccccccatcctatcaaaagagtgatcagtagtatgtaaaatgtgaaagactgaaaaacaccagtacaggcaagtgctacaagagtgtagaaaagtggggagattattgtggactgggttgtagaagacacacaggatttagagcatgatttgaactttgaaggaagaaacagacttaggaaagtggggaagagggcacagaatattccaggcagagcaaagtcatataggcagaaatgtgcatgccacgtttaaggaacagtgtgatcagtttatctgaaggaaagtattttgcaagggcacaatgagtgctaagtctggagaaataagtagggccaggttgagaaagcccaaatatacctctttgaaaaaatacttttgatattttcctaaaggtactggggtgattgaaagtgtttaggaagaggtttggtggcacctagtgaagagtaacctgtaatcgtgtttagaattgattgaaaagtgaacagaatcaaggcatagtgtaagcatgaactggtgaaagcctgtactatagtagtaccaatgagaatgggaaagaagggacagatacaggagacatataaaggaagcaatcatttatgctcagtgagaaggacttgaaccattgaatctttggaggcaggaaagggaggataataaagcctgttcattccacaaacatttacatgttgttgggaggtgggagagtgcagtcgaaagtagagcaaacactgctaggcatggtggctcacacctgtaatcccagcactttgggaggccaaggtgggaggatcatttgaggtcaggagttcaagaccagcatgggcaacatagctagaccctatctctgtgagaaaagaaaaaaaattagccaggcatggtggcacatgcctgtggtctcagcttcatgggaggctgaaacaggaggatcacagattgaggctgcagtgagccatgattacaccacggcactccagcctgggtgatagagtgaatccctgtctttaaaaaattaaatttaattacattaaaatttcaaaaagcagagcaaacgaaaaagaaggaataccagagatgaaagaggactagaacagtgtgggtcattcacgagaagagagtttggagaaaaggatgatcaacagtggccagtgcttcagagaaataaaagaaaatgaggtcggaataaacgccattggacctgacgtttaggaagatgatagtgaccatagaaagcagtttcagtagtaaggtgtcttagttcgttttgtattgctataatggcatacttgaggctgggtaatttataaagaaaagatttattcttgctcacggttctgcacactgtacaagaagcatatgccagcatctgcttctggccagggacttcagtaagcttccaatcatgccaaaagtcgaaggggagcaggcatgtcacatgacaagagagggaaaaagagatacaggggagggtgataccagactctttcgaacaatgccatcttagaggaactactagagcaagaactcactgttactgtggggagagagccaagtcattcatgagagatctgactccatgtcctaaacacctcccactgggccttacctccaaaattggggcatcacatctctttctttcttcctttttttttgagacagagtcttgctctgttgcctaggttgtagtgcagtggcgtgatctcagctcactgaaatctctgcctcctgggttcaagctattctcatgcctcagcctccagagtagctgggattacagtcacatgccaccacgcccggctaatttttgtatttttagtagagacagggtttcgccatgttggccaggctggccttgaactcctcgcctcaagcaatccacccaccttggcctcccaaactgctgggattacaggcgtgagcgaccatgcctgacctggggcatcacatttcaacatgagatttggaagggacaaatattccaactatatcataagataatagtagaaaatagactgtaagggtttaaggactgaatgggtggcgaggcaatggaagaagttatggtgggaggttctgggaggtcaaaactattttataataattctaaaacattatttgcctattttttgctgttttagcatttgctctggtgatgcaaagcaatgatgggtaagattgctggcacttcaacatgaatcaggatagtggcactagcatacagactagtcatctttttattcatcactgctatactcttactttaagaagaatgccagtcttaagactatactttcagggatcatttctatagtttgttactagagaagtttctctgaacgtgtatagcactgaaaaccacaaagaagaggtgcagcattatctcctaagtgtaaagccggctcttgatgttgctttgctgcaactgccatttgccattgatgatcgttcttttcttcctttgggagactgggaaggaaaggatgcaatctgagtggttttcatttaaaaaataaataaataaaaaggatgccagttttacacaaaaccatccttgataagcgagtaaagatgattaattttattaaatcttgggcccttgaacacatatcattttaatatgtgtgatgaaaagggaaacactcatatagcacttttgttgcatatcgaagtgtgatggttatctggaggagaggctcttaagtgattgtttaatttgtgagccgaattaactattttgtgtgtgcgtgtgtgatggagtcttgctctgtcacccaggctggaatgcaatggcacaatcttggctcactgcaaactccacctcctgggttcaagcgattctcctgcctcagcctcccgagtagctgggactacaggtgcgcatcaccatgcctggctaatttttgtatttttagtagagatggaattttgccatgttggccaggcgggtctcgaactcctgacctcaggtgatctgcccacttcagcctcccaaagtgctgggattacgggcgtgacccagtgtgccctgcctggattaactatttttaatttcaagaatgactgacacataaacttggctatttagcagatgttttcataaaaatgaatgaagtgggccaggcgcagtggcccctgcctgtaatcccatcactttgggaggccgaggcgggcggatcgcctgaggtcaggagttcaagaccagcctggccaaaatggtaaaaccccgtctctactaaaaatataaacgtgggctgggcatggtgtcaggtgcctgtaatttcagctccttgggagactgaggcaggagaatcgcttgaattcgggagacagaggttgcagtgagcagagatgatgccactgcacttcagcctgggtgacagtgagattccctctcaaaagtaaaagataaaataaaatgaaccaagtgaataggactctattgtgtatatgtaccattttgcattcttcatccattcatctgttgatggacacttaggttagcatgtgacttctgggaaaacaattgacagtattttttgccagtgaaaaagtttgagcttttaggtaaaaactgaaattttagaaaatgtgtacttctaccatgagcttggtagcttctaaatacttagtcttttttttttttgaggcagtctcattctgccacacaggttggagtgcagtggcacagtctcagctcactgcagcctctgcctcccgggttcaagcggttctcatgcctcagcctgggaggtagctgggattacaggcgcacaccaccactgctggcttttttgttttgttttgttttggtatttctagtagagatgggggtttccccatgttggccaggccggtctcgagctcctggcctcaagttatccacctgccttggcctcccaaagtgctgggactacaggtatgagccactgcctaaatacaaagtctttttttttattttattattattgtactttaagttttagggtacatgtgcacaacgtgcaggtttgttacatatgtgtacatgtgccatgttggtgtgctgcacccattaactcgtcatttagcattaggtatatcccctaatgctatccctcccccctccccccaccccacaacagtctccggtgtgtgatgttccccttcctgtgtccatgggttctcattgttcaattcccaactatgagtgagaacatgcggtgtttggttttttgtccttgcgatagtttgctgagaatgatggcttccagtttcatccatgtccctacaaaggacatgaactcatccttttttatggctgcatagtattccatggtgtatatgtgccacattttcttaatccagtctatcgttattggacatttaggttgcttccaagtctttgctattgtgaatagtgccgctataaacatacgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagcattcctatttctccacatcctctccagcacctgttgtttcctgactttttaatgatgccattctaactggtgtgagatggtatctcattgtggttttgatttgcatttctctgatggccagtgatgatgagcattttttcatgtgttttttggctgcataaatgtcttcttttgagaagtgtctcctcttcatatccttcgcccacttgttgatggtattgttagtttttttcttgtaaatttgtttgagttcattgtagattctggatattagccctttgtcagatgagtagattgcaaaaattttctcccattttgtaggttgcctgttcactctgatggtagttccttttgctgtgcagaagctctttagtttaattggatcccatttgtcaattttggcttttgttgccattgcttttggtgttttagacatgaagtccttgcccatgcctatgtcctgaatggtattgcctaggttttcttctaggggttttatggttttaggtctaatgtttaagtctttaatccatcttgaattaatttttgtataaggtgtaaggaagggatccagcttcagctttctacatatggctagccagttttcccagcaccatttattaaatagggaatcctttccccattgcttgtttttgtcaggtttgtcaaagatcagatagttgtagatatgcggcattatttctgagggctctgttctgttttggtaccagtaccatgctgttttggttactgtagccttgtagtatagtttgaagtcaggtagcatgatgcctccagctttgttcttctggcttaggattgtcttggcaatgtgggctctttttggttccgtatgaactttaaagtagttttttccaattctgtgaagaaagttgttggtagcttgatggggatggcattgaaactataaattaccttgggcagtatggccattttcacgatattgattctttctacccatgagcatggaatgttcttccatttgtttgtatcctcttttatttcactgagcagtggtttgtagttctccttgaagaggtccttcacatcccttgtaagttggattcctaggtattttattctctttgaagcaattgtgaatgggagttcactcatgatttggctctgttgtctgttattggtgtataagaatgcttgtgatttttgtacattgattttgtgtccggagactttgctgaagttgtttatcagcttgaggagattttgggctgagatgatggggttttctagatgtacaatcatgtcatctacaaacagggacaatttgacttcctcttttcctaattgaataccctttatttccttctcctgcctaattgccttggccagcacttccaacactatgttgaataggagtggtgagagagggcatccctgtcttgtgtcagttttcaaagggaatgcttccagtgtttgcccattcagtatgatattggctgtgggtttgtcatagatagctcttattatttggagatatgtcccatgaatacctaatttattgagagtttttagcatgaagtgttgttgaattttgtcaaaggccttttctgcatctattgagataatcatgtggtttttgtctttggttctgtttatatgctggattacatttattgatttgcgtatgttgaatcagccttgcatcccagggatgaagcccacttaatcatggtggataagctttttgatgtgctgctgaattcggtttgtgagtattttactgaggatttttgcatcaatgttcatcaaggatattggtctaaaattctctttttttgttgtgtctctgccaggctttggtatcaggatgatgctggcctcataaaatgagttagggaggattccctctttttctattgattggaatagtttcagaaggaatggtaccagctcctccttgtacctctggtagaattcggctgtgaatccatctggtcctggactttttttggttggtaagctgttgattattgccacaatttcagagcctgttattggtctattcagagattcaacttcttcctggtttagtcttgggagggtgtatgtgtcgaggagtttatccatttcttctagattttctagtttatttgcgtagaggtgtttgtagtattctctgatggtagtttgtatttctgtgggatcggtggtgatatcccctttatcattttttattgcgtctaattgattcttctctcttttcttctttattagtcttgctagcggtctatcaatttcgttgatcttttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatcttttctgcttcctcttgtgggcatttagtgctataagtttccctctacacactgctttgaatgtgtcccagagattctggtatgttgtgtctttgttctcgttggtttcaaagaacatctttatttctgccttcatttcattatgtaccgagtagtcattcaggagcaggttgttcagtttccatgtagttgagcggttttgagtcagtttcttaatcctgagttctagtttgattgcactgtggtctgagagacagtttgttataatttctgttcttttacatttgctgaggagtgctttacttccaactatgtggtcaattttggaataggtgtggtgtggtgctgaaaagaatgtatattctgttgatttggggtggagagttctgtagatgtctattaggtccgcttggtgcaaagctgagttcaattcctgggtatccttgttaactttctgtcttattgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagttcttcttgttgaattgatccctttaccattatgtaatggccttctttgtctcttttgatctttgttggtttaaagtctgttttagcagagactaggattgcaacccctgcctttgtttgttttccatttgcttggtagatcttcctccatccctttattttgagcctatgtgtgtctctgcacatgagatggctttcctgaatacagcacactgatgggtcttgactctttatccaatttgccagtctgtgtcttttaattggagcatttagcccatttacatttaaggttaatattgttatgtgtgaatttgatcctgtcattatgatgttagctggtcattttgctcgatagttgatgcagttttttcctagccttgatggcgtttacaatttggtatgtttttgcagtggctggtaccagttgttcctttccatgtttagcgcttccttcaggagctcttttagggcaggcctggtggtgacaaaatctctcagcatttgcttgtctgtaaagtattttatttctccttcacttatgaaggttagtttggctggatatgagattgtgggttgaaaattcttccctttaagaatgttgaatattggtccccactctcttctggcttgtagagtttctgcagagagatcagctgttagtctgatgggcttccctttgtgggtaacccgacctttctctctggctgcccttaacgttttttccttcatttcaactttggtgaatctgacaattatgtgtcttggacttgctcttctcgaggagtatctttgtggtgttctctgtatttcctgaatttgaatgttggcctgccttggtagattggggaatttctcctggataatatcctgcagagtgttttccaacttggttccattctccccatcactttcagctacaccaatcagacgtagatttggtcttttcaatagtcccatatttcttggaggctttgttcatttctttttattcttttttctctaaacttctcttctcgcttcatttcatcttccatcactgataccctttcttccagttgatcgcatcggctactgaggcttctgcgttcatcacgtagctctcgtgccttggttttcagctccatcaggtccttgaaggacttctctgcattggttattctagtatccgttcgcctaattttttttcaaagcttttaacttctttgctattggttcgaatttcctcctgtagctcagagtagtttgattgcctgaagccttcttctctcagctcgtcaaagtcattcttcgtccagctttgttccattgctggtgaggagctgcattcctttggaggaggagaggcgctctgacttttagagtttccagtttttctgctctgtttttttcccatctttgtggttttatctacctttgttctttgatgatggtgacctacagatgagtttttgatgtggatgtcctttctgtttgttagttttccttctaacagacagggccctcagctgcaggtctgttggagtttgctagaggtccactccagaccctgtttgcctgggtatcagcagtggtggctgcagaacagcagatattggtgaactgcagatgctgctgcctgatcgctcctctggaagttttgtctcagaggggtacccggccgtgtgaggtgtcagtccgcccctcctgggggtgcctcccagttaggctacttgggggtcagggacccacttgaggaggcagtctgcccgttcccagatctcaagctgcgtgctgggagaaccactactctcttcaaagctgtcagagagggacatttaagtctgcataggttactgctgtctttttgtttgtctgtgccctgctcccagaggtggagcctacagaggcaggcaggcctccttgagctgtggtgggctccacccagttcgagcttcccggctgctttgtttacctaatcaaacaactaactcagcaatggtgggtgcccctccccgagcctcgctgccaccttgcagtttgatctcggactgctgtgctagcaatgagcgagactccatgggtgtaggaccctctgagccatgtgcgggatataatctcctggtgtgccattttttaagcccgttggaaaagcgcagtattagggtgggagtgacccgattttccaggtgccatctgtcactgctttctttgactaggaaagggaattccctgaccccttgtgcttccctggtgaggcgatgcctcgccctgctttggcttgcgcacagtttgctgcacccactgtcctgcacctactgtctggcactccccagtgagatgaacccggtacctcagttggaaatgcagaaatcacccatcttctgcgtcgctcacactgggagctgtagactggagctgttcctattcggccatcttggctcctccccctctaatacttagtcttttctgatgaaattggtggtggtattaaacaaatgtgattttattttattttatttgttctgagaccaagtcttgctccgttgcccaggctggagggcagtagtgccatcttggctcactgcaacctccacctcctgggttcaagcgattatcctgcctcagcctcccgagtagctagctgggactacagacagccgccaccatgctaggctaaattttgtatttttagtacagatggtgtttcaccgtgttgaccaggctggtcttgaactcctgacctcaggtgatccacccacctcggcctcccaaagcactgggattgcaggtgtgagctaccgtgcctggccaacaaatgtgtttctaaaaattttttaaaattttgaaataagcatagatttgcaggaaactacaaaaatagtaaagagagatctgtgtacccttcacccagctttttgccagtagcaaaatcttgcatacatatagtgcaatataaaaccaggaaatagacattgatacaatccacagaccttatttagatttcaccagttttacatgaactcacttgtgtgtgtttgcatgtgtttatagagctctatacaatttcagcacatgtgtaggtgaagattcatgttcactaccaccaccacaatcaagatacagaacagtttcattaccacacagattctttacataacccctttatagggatacccctttcccatcatccaaaacctcaggcaaccaaaacctagtctccatctctataattttgtcattttaagaacattatataaatgtaatattacactatgtaaccatttcatattggttgttttcactcagcatttttttttttgcgatccgtccttgtctttttatgtgttaatagtttgttctttttgtttgtttgtttgtttttgagacagagagtctcactctgttgcctaggctggagtgcaatggcgtgatctcggctcactgcaactactgcctcctgagttcaagtgattctcctgcctcagcctcccaagtagcgtgagattacaggcatgtgccaccttgcctggctaatttttttgtattttttagtatagatggcgtttcaccaagttggccaggctggtttcaaactcctggcctcaagtgatccacccacctctgcctatcaaagtgctgggattacaggcatgagtcaacgtgccaagccctgttctctttttattgctatgtagaattctatgctatggatgtaccaatttgtttagccattcaccattgaaagaatttgggttgtttccaatttttggctattgtaaataagttggcatgaacatttccatacaggtttttgtgtggacataaagggtatatttagttttattttttttttagaaactgccaactgttttctagagtggccatgccattttacattctgtgttttgttttgttttcttgttttcttttgagacagagtctcactctgtcacccagggtggagtgctgtggcatgatctcagctcactgcaacctccgcctcccaggctcaagtgattctcctgcctcagcctcccgagtggctgagactacaggtgcgtgccaccatgcctggctaatttttgtatttttagtagaaatggggctttgccatcttggccaggcttgtctcaaactgctgacctcaggtgatccacccacctaggcctcccaaagtactgggattacaggtgtgagccactgcacccggccaccatttagattcttaccagtaatgtatgagagatcccatttctttgcatccttgacagcatttggtattgtgaccaatttttttattgtagctatcctaataggtatatagtgatatctcattgtggttttaatttgcatttctctaatggctaatgatgttgaacatcctttcatttacttatttgccatctgtatctccctttaggcaaaatatctgtcatttttcttgtctattttctatttggattgtttgatagtttactgttgaatttacaggattatttatatattctagatgtgattcccttgtcagataaatattcgcgaatattgtcttgttgtagcttgtctttttgtcctttttaatagggtcacagaatacagttttgatgaagtccagttgattgatttctttttcttttatggatcatgcttttggtgtcatgtctcagaatgtttcacctagccctgggtttcttaaatttccatttgaattttaagatcagcatgttaatttctgcaaaaaaggccaactggaattttaatggaattggattaaatttatagatcaactcggggagtattgccattttaatatattgtcttttttttttttttttttgagacagagtctcactctattgcccaggcaatattgcgccatctcggctcactgcagcctctgcttcccgggttcaagcgattctcctgcctcagcctcccaagtagctgagattacaggcacgcaccaccatgcctagctagctactttttgtatttttagtagagacagggttttgccatgttggacaggctggtctcgaactcctggcctcaggtgatcagtctaccttggcctcccaaagtgctgggattacaggggtgagccactgggcccagccctgatggtagttttgattgccccaaatgtacacatttttgaatactgacttacagtttatgaaatgctttcacatctgtgatcccatttgatcctcataaaaatcaatcctatattgtagacattactgtccctattttatagttaacaaaatagagcctcaaagagattgtgacttacctaagttcactgagccaagaagtggaaaaactgggaatgcaaagctcatattcttttcactacatcagtatacgcaggacatcactccagatctaatgaatcacagtctccccaagttgtgagagctgggcatgtgattttcagaaagctccactggtgagtctgatgctcacaaaaggttactacagcactgtattgtgctgcctcttctttaagacttcttttactttaaatctttatcttttgggcttgaaatatttgtttctagtcataagaagatgaataaattttcaaaagtagcctgaattattagagctttgatttctctaagataaaatctgagtaatgatagacactttatgggttgtttgaacattaaagtctcatattgttttatatgttataagaacagacagcaacatctatcctctgatatggtgttgtcactcagcatttctcttttatagtaagattttctccaccttgaataatgatttaatcagcaagtattcatagaatatagtgtagacaggaatattattttctaatctctatatagagatttggcttattgaggcacttgtgttagcaatttattttcccctttaataatatctagtattaaagccttataagagagtatctactcagcaagatgtcaggcttactattcagcagttagaagagaaaactagagagaagctggtgtcttacgttgtttatattttcttctgtctactcaattcttttattattcaaagcacaataatatttgacaccacgtaaagaagagaagaaagaaaatagcaagtgtagtactttattatttccttgtatgtatccatgtttttcttaaaaaatgctgtgtcagccttttttttttttttgtgacagagtctcgctctgtctcccaggctggagtgcaatggctcgatctcagctcgctgcaacctccgcctcccgagtagctggattgcaggtgcccaccaccacacccagctaatttgtgtttgggttgttttgttttgttttgttttgttttgtttgtttgttttttggtagagacgggatttcaccatgttggtcaagctggtctcagactgctgacctcaggtgatccacccaccttggcctccctaggtgctgggattataggcgtgagccactgctcctggccaactaagttcttcaatggctgaaacaagcctcttctacaagtgctaaagtatgtgtgattgatgtttacattcatttgggggtgttcagacatagaatggtagaactgaaaggaaccctgcagatagtctagtacagtctcctcactttatggatgaggaaacaatctgtgagagcttaaggctcaaagttacacatgataaatggcagagcggctcttttggcttcatgatgagattgtacgaagctgcttttcttttttcttaaaattttttttttttttaagagatggggttttgctctgtcatctgtggcaggagtagagaggtatcttcttagcttactgcagcttcgaactactggacttgagcaattttcccgcctcagcctctaaagtagctgggaccataggtgtgtgccaccatgtctggctaattgataagctgctttttgtagtggatatacatagcagttcagactatgaggttattgtgatcttgctttaagacaaagactgctgtttagcttaattcctctaatgtagaagtgaatagaagagctattcaagttgcagaagcatctagtagacctggcattatgtcatagtataataacataaggcagtacaaccagtttttgcatttccagaaaaaagtaaatgactcctgctcattcagtatcaactctgtgtcaccaaagattaccacttattcttctgtattttgagcaagctatctgtttagcttgaacaactagtattgctaaaaatattagaaaacaaaataagacttttaaacactagttaaaatatgctaaaattgacttagagacaaataaccttgtcattttaaccaattattgacattctttatctttttcaggcagttgctcaaggggattttcaaagagcatctatgtgtgtactgcaatgtaaagatatgttgatgaggctcccccagatggtgagtgaagtctgcattctccaagagtttgaaaatatgctatatcaagttccaggaagaatcattactacttcatgcaaccttttggagattctatttgagatcagttccacataagtagctgatctttgaaatattttgcttcctttgttctttaccagaaagggcatttgaaaaagctatatggaatatttcttttttttcttttcttttcttttcttttcttttcttttttttttttctgagatggagtctcactctgtcacccaggctggagtgcagtgatgtgatctcagctcactgcaacctccacctcccgggttcaagtgattcttgtgcctcagcctcctgagtagctgggattacaggcctgcgccaccacacctggctactttttgtatttttagtacagacagggttttgctatgttgggcaggctgctctggagctcctggcctcaagtgatccacccacctcagcctcccaaagtactgggattacaggcgtgagccaccacacctggctgatatggaatatttcttaaaattttctttgctttgtcttttattgtcaaatcattttgataacatttgctccatattcatgctatacaacaaaagaaagaaaaaaatgagtttgtctgctgacaaggttgatagcagttaatcatcttactgccatagtatttttctatactgggatttggagatgtgagagatttgataggataaagcctgcatcctggactggatctcatgaaaattcctaaatacatagttttttgctttttcattttatcttccctttccattctttctctcctatttcagcgcctatgcctacttcagtctttactatcacagagggattaataatggagatataattggatattagggagaatgttcccagtattgcatacatcgtacctatttgtgagattggtcttattttttccccaaattgggtgtcataatgtagagcttaattcagtaaacatttatatgttgcctgttatatgtcacatcagacattcttctaggctttaaaaacttttaaaacaatttcatatttatagaaaagttataagaatagtacaaagaactcctgtatatcctttgcttggaaacgtcattcaaattttccaataatgttctatatagaaaatggtttcaatctagaattatacatagtcttcagtctccttcaatctggaaatctggaacacctcctcattcttgccttgttattcatgatcttggcagttttgaagattacagatcagtcattttgtagcatgtgatttaatgtgggtttagccaaagtttcctcatgattagaacaggttgtgaatttgaggccagaaaaccacagaagaaattctatgttctactcatggcttcctattgggtggtatacaggattgatttatactattattggtggtgctagctttgatctcttgattaagatcgtgtctttcaggttttttcactgtaaacctgtatcatttcgtgagtgatacactgaaactatggcaaatcaaatttctcattctactttcaccatctttattcttttttcctccatttttctagctttattgggggtataattgacaaaatttgtatatatttatggtatataacataatattttgatatacattgtgaaaagatcaccacaatcaagccaatttatatattcatcaactcacacaggttttttttgtggagaaatatttaagatctactttcttagcaattttcaagtatacaatacattattataatattaactgtagtcactgtgctgtacagtacagccccagaacttattcatacggcctaaatgaaactttgtaacccctccccttttatttgaagagatagagtattgctctgtcgccaggctggagtgcagtggcatgatcctggctcactgcagcctcaacctcctcggctaaagtgatcctcccacctcagcctctcgagtagctgggactacaggtgcgtgccaccaaggctggctagttgttttatttttttgtagagatgggggtttcactatgttatgcaggctgatcttgaactcctgggctcaggcagtcctcttgccccagccacccaaagtactgggattatagacgggagccactgtgcttggacactttgtaccctttgaccaatatctcctcatccattccccaaccccctggcaaccacctttctactctctacttctatgaactcagctttttcagaatccacatataagtgagatcatgcagtatttgtctttctgcggctggcttatttcacttagcttaatgtcctccaggttcatctgtgttatcacaaatgacaggatttccttcttttttatggctgaatagtattctattgtatataaataccacattttctttacccattcatctcttgttggacccttaggttgattccatagcttggctattgtaaataatgctgcagtgaacaagggattgcagatatctcttaaagatacttattttatttcccttgggtatatatccagaagtgagattgctggatcatatggtagttacatttttaattttttgagcaacctctatactgttttctgtaatgggtatactaatttacattcccaccagcagtgtacaaagtttccttttctccatgcccttgccaacacttatcttttgtctttttgataatagacattctaacagatgtgaggtgatatctcattgtgattttaatttgcatttccctgatggttagtgatgttgagcattttttcacatacctgttgctgatttgtatgtcttccttagataaatatctattcaggtcttttgcccattttttcattgggttatttgtttatttgctattgcagtgtttgagttccttgtatattttggagattaactctttatcagacgtgtgatttgtggatattttctcctattctgtaggttgtctcttcactctgttgattgtttcctttgctgtgcagagcattttggtttggtgcaatctcatttgcctatttttgcttttgtcacctgtgggggtcatatccaaaaaaatcattgaccaggggtctatctctctctttccctctaataattgctttatatatctgagtgctccagtgttgggtgcatgtgtatgtaaaattgttatagcctcttgctgaattttcccctttatccttatatagtgacctttttttctctctccttaaagtttttgtcttgaaatccattttgtctgatataagtataggtactcctgctctttcgtggtttccgttgtcatggaatatctttttccatccgtttattttcaatctgtgtgtatcttcataggggaaatgtgtttcttataggcaagagatcattgggtcttgtttttttttaatccattcagccactctatgtcctttgattggagagtttagtctatttacattcagtgttattactgataagtaaagacttactcctgccactttgttatttgttttctgattgtttttggttttctattttttattctattatatttctttctttcctgtcttccttttagtgaaggcgattttcactggtggtatgatttaatttcttcctttttatttttttattttcgttgtttttcagtttcaggttaccgtgagccttgcaaatgctatcttataatccattattttaaattgatgacagtgtaacactgattgtattaacaaagagccaaacacacacatacacacacacacacacacaaactaataaaaactctacactttaactttgttcccctgattaactttttttgtttttctttatgtcttatggtactgtccatgttttgaaaagttgttgtggttattatttctgtttggttcatcatttattctttctacttaagtcaagagaagtttacaccccacaatttcagtgtgataccattctgtctttttctgtgtgcttactgtttttttttttttttttttttgagacggaatgttgctctgtcacccaggctggagtgcagtggcatgatcttggctcactgcaacatccgcctcctgggttcaagtaattctcctgcctcagcctcccaagtagctggaactacaggtgcatgccaccacacccggataatttttgtatttttagtagagacggggtttcaccatattggtcaggctggtctcgaactcctgacctcaggcgatccacctgcctcggcctcccaaagtgctgggattacaggcatgagccactgtttccagctgtccagccttgtgcttactattacccatgagttttgtaccttcaggtgatttcttcttgctcattaacatccttttctttcagattgaacaactccctttagcatttcttgtaggacaggtctggtgttcatgaaatccctcagcttttgtttgtctgggaaagtctttatttctccctcatgtttgaaggatactttctgctggatatactatcctagggtaaacatttttttttctccttcagcactttaaatatgtcatgcctctctttcctggcctgtaaagtttctgctgataagttggctgccagatgtattgaagttcgattgtatgtgattttttttcttctcttttactgtttttgggattctttctttatccttgacctttgggagtttgattattaaatgccttgaggtgttcttctttgggttaaatctgcttagtgttctataaccttcttatacttgaatgttgatatctttctccaggtttgggatattctctgatattatctcttcgaataaacttcttacccatagctctttccctacctcctctttaaggccaatggatcttagatttacccttttgaggctattttctagatcatgtaggtatgcttcatgcttttttattttttttcttttgtctcctctgattgtgtattttcaaatagcctgtcttgaagctcactagttttcttctgcttgatcaattctgctgctaagagactgatgcattcttaagcatgtcaattgcattttcaactccagcatttctgcttgattcttttaaattatttcagtctctttgttaaatttatctgatagaattctgaattccttctttgtgttatttcaaatttcttgcagtttcttcaaaatagctattttgaattttctgtccgaaaagtcacatatctctgtttctgcagaactggtccctggtgccatatttaattcatttggtgaagtcatgttttcctggatggtgttgatgcttgtagatattcatcggtgtctgggcattgaagagttaggtatttattgtagtcttctcaatctaggcttgctcatgccagtccttcttgggaaggccttccagttattcaaagagacttggaccccaagcctaataatgctgtgtttcttgtagacccataaagggtactccttgatgaccttggataacatctgaaagaattctctggattaccaggcagaaactcttgttctttacccttactttctctgaaacatatggagtcactgtctctgtgttgagctgggggtgtggtgatgcaagcactgggcctgtgctgtgtcagacttgaagccagcacagcactggaccttgcccaaggaaggcccttccctttaggatggtgagttcccccacaacccaggtgtgtccaaagatgctctctgggagccagggattggagtcagaaacttgagcaatttacctgttttattctactgcagttaagctggcactcaaatcacaatacaaagcccttcccactcttccctccctttccacaggcagaggagtctctccctgtggccgccaccatcagtggtccatggggtgttctgctaggccaccactgatgttcacataaaacccaaggtctcttccatcagcttgtggtgaatgctgccaggcctgggactcacccttcagggcagtgggctctcctgtggcccaggacgagaaatactgtccaagaggctacacctggatttggggaccccaagagccaagctggtacctagagtgcagtacaaagtcctctttacttttcctgggcttttctcaaacaaaaggagtctttcactggagccaccacagctgggaatgtgctgggtgtcccctgaagccagcacttctcagagcccaaggcccatggtgtactccctgggtcgttaatggttattccagggttataccaagggttctttagtcagcaggtgattaatcctgccaggactggatcctttccttcaaggcagtgggttcccttttggcccaggatgtgtctagaaatgtggtttgagagctaggtcctggaatgggggcctcactactctgcccagtgccctgtcctactgtggctgagctggtatccaagatgctagacaaagtcctctttactcttcccttccctctacttaggcagaaggaaggagtcactttcattgctacgagctttattgcctggggttggggaagggatggtgcaagccctccctttgctgtgccagctgttgtctccctaggtcacgtggcaagttcactggctctaagcccagccttacactaggagttgcctaggaattgcagtccttgtgccctagactgccactcaagtttatgtaggaccccagagcacttcagcccacagtgacgaggcttgccaagaaactcaagttcccaccactgggatgagggtaattctcctgtggctaaggctggtccaaacactccctctgtgcacaagcgctggctgaacccagcatgacttttttctctactgtgactgtgcagcactgagttcaatgtaaagttccccagctgctgtgctcttcctctgcaatgtgcacagattctctctctgcactgcatagctgctgccagggaagcggggaggggtggccttggagattgaagactgtttatcctgccctcttcaatgcctctttccacaatatgtagttaaaaccgggtactgtgagtgttcacctggttttggttcttgtgattgtgcttttctgtgtgcagacagttgttaaaatttggtgttccagtggagggtacaaacaatgcaggcttttattccatgatcttgccccacccttattttagctttttttttttttttgacaaggagtttcgctcttgttgcccaggctggagtgcaatggcacagtcttggctcactgcaaccttcgcctcccgggttcaaacgatcctcctgccttagcctcccaagtagctgggattacaggcatgagccaccatgcccagctacttttttgtatttttagtagagacgttgggggggtttcattatgttggtcaggctgatctcgaactcctgacctcaggtgagccacccaccgtggcctcccaaagtgctggaattacaggcgtgagccactgcgccaggccaacatctcttataaggtgattatttatttatttattttatctgagactgagtctcactcttttgcacccaggctggagtgcagtggcgcgatctcagctcactgcaacctctgtctcccgggttcaagccattctctcacctcagtctcccaaagtagctgggattacaggctcctgccactacgtccagctaattttttgtatttttagtagagatgtggtttcaccatgttggccaggctggtcttgaactcctgacctcaggtgatccacccaccttggcctcccaaagtgctgggattataggcgtgagccaccacacccggccaaagtgattttactggaaaaacatttcgtcaattcttgtatgctgctctaaacttaaaaaagatcctttaagaatgtaaaaacttttaaaatctcaccatccatattggcccacaggttgtaatttgctgactcatttctttactgagactatatttttctatttatttcatgagtgtttataattatttgttcaaacagttttaaaacatctgatttaaagcccttatcagatagttttaacattcatatcatctttctatgattgtcttttcttatgtatgttgagattttcaagcattgtcatataccgagtagttttttattgaacaatatatatatatacatatatataaatatatgtgtatatatatttgttttttgagactgagtctccctctgtggcccaggctggagtgcggtggcatgatctcagctcactgcaacctccatttcccgggttcaagcgcttttcctgcctcagcctccctagtagctgggattacaagcgtacaccaccatgcccagctaatttttgtatttttagtagagacagggtttcgccatgttggccaggctggtctcagaattgacctcaagtgatctgcccgcctccgcctcctaaagtgctgggattacaagcatgagccaacacacccaacccctatacattttctatattacatttttggcttctgggtcttgtctaaattctgggagagtgtcgatatttttattatagcaggtaatcaatctggtagattcaggcaaattttaaactcattttttgtgggttatggtttcaatgttgtttcaattttgcagtgtgcttcaggtttgtcttgcgtatgcaacactcattgatcagtcctggtacttggcagaggtttatctgttagctcagttatcaaagtttttgttatgtaaattaggttgagattcctggttattaaggttgtaggataagccttgaacttaatcaactttattttgttgcttttctgagctcctctctctctctctctatgatcttcttggtagtttctggttctctgagctgtccttttcagtcctctaaccaatagctatccataatctgcagttgcactgtgactggggccaagcagtaggaagacacaggcagaggaaaaaaagcagtgggagtttgccccatcctgtgggaactactgctgcagtgaatggacagtaaggttttcctctctcaaagttttgagtattttggtttcccctggctaccactgctgttgccaccatgggattgcctagggcctgagcacaagagaatggaagaaagatgaaataaaaaccaaaattgaatatttgcactttctctgagcaattcaagccagaagtagagaagcaccctcagtctgtaccacagcattcgcttctgagtttctggctgcattaagtttaggccaggggatattagaggaaaagaatggtaaacttaccaccagtttggtgttaacttgaattctggtgttcttcctttatttgccttctgctattattttctcagagtcctcaaatagctaagtgcattctgtcgaggtttatagttacattcagtgggagataaagggtggtgcatacttactttatcttacccaaaactaaaacactatttatttatttattatttttattttttgagatggaatctcactatgtcgcccaggctggagtgcagtggcatgatctcggctcactgtaacctccatctttcagatttaagtgattctcctgcctcagcctcccaagtagccgggactacaggcatgcgggcatgcaccactatgcctggctaatctttgtattttttttttagtagagacagggttttatcatgttggccaggctggtctcgaactcctgatttcaagtgatctgccttccttgccctcccaaagtgctgggattacaggagtgagccactgcacccggtctaaaacactattttgatggttaactctttctacatttggccattaagaggccctttaagctgatttgtatgtcttttttggaatggcagggtggtttactagcctggtgatctatttgtgtcctttcagtttccggcctgaacttgtcttttttttgaaatatttattttggtagaattgacaaataaaaattattatgtatttaaggtgaacaacttgatgttttgatatacatacatattttggaatgatcactgtgataaaggtaatgaacatattcatcacctcacatagttacctttttttttgtggtgagaacacttaagatatagtctcttagaaaaaaatcacctatacaatacacaacacaatgttattaactatagtcaccatgctgtgcattagatctccagaacttattcatcttatataactgaaactttgtatgctttatctaacatcgccctatttccccttcccctgagcccctggcagccaccattttattctctgcttttgtaagtttgactcttttcattttacatataagtgagatcatgtagtatttgcttttctgtgcctggcttatttcatttagcataatgtcatccagatttatccatatagtttcaaatgagacaatttccttttcttttaaggctgtggtatgggttcaatgtttgacgccacccgccccccaccccccaaccaaatctcatgttgaaatttcatccctaatgttggaggtggggcttagtgggaggtgtttgcatcatgaaggtgatgaaggcagatctctcatgaatggcttggtgcagtcctcatggtaatgagtgagttctctctattagttcctgctagagctggttatttaaaagagcctgtcatctccctctgctctctgtcttgcttccactctctagccatgtgatttctgcgcaggctagcttctctttgccttctaccatgagtggaagcagcctgaagccctcatcagaagcagatactggcaccaccttgtacagcctgcaaaaccgttaatcaaataaacctcgttttaaaataaattaccctaggagtgacagaaaatgtgaaaaaaagttactcttcctcaggtattcctttatagtgacacaaactgactaaggccgatatgggtgtgtgtgtgtgtatatagatacatacatatatatacgtatatacaatatcctgtgtgtgtgtgtatatatacataccacattttgtatatacatgcatatgtatatcctgtgtgtgtgtatatacataccatattttctttatccatttatccatcaacaggtattaggttgtttccatatcttgggtattgtgaataatgctgcaatgaatatgtgagtgcagatatctcaaaatcctgattttagttcctttgcatacatacagttagccctctgtgaccctgggttccacatccatgtatttaaccaactggggattgaaaatacttgggaaaaaaggatggttgcatctgtaccaaacatgtagatacttttttcctactactttcctattcctacctaatacagttgttatactgtattatttatattattccctaaataatacagtataacaactatttacatagcatattcattgtattagatattataagtaatctagagatgatgtaaagtatataggaggatgtttgtaggttatatgcaaatactatgccattttatataagggacttgagtatctgtggattttggtatccacagagggtcctggaacaaatccccagcagatactgaaagatgactgtacctagaagtgaaatggctatatcatatagtagttttattattttttattaaccttcctactattttgcataatgattgtacagatttacattgccaacagtgtacaagggctcccttttctccattcctcaatgacacattatcttttgactttttgataatagtcatacaaacaggtgtgaggtgatgtcccatcgtggtgttgatttgaatttttctgatgattagtgtattagttcgttctcacattgctataaagaactaccagagactgggtaatttataaagaaaagaggtttaattggctcacggttctacaggctgtacaggaagcaaggcttggggtggcaggggctctggaaacttacaatcatggcagatggtgaaggggaagctggcgcatcctacatggctggagcagaaggaagagagagtgaagggggaagtgctacacactttcaaacaactaaatctcatgagaactcattatcatgacaacagcaaaagggaaatccacccctatgatccaatcacctcccaccaggcctctcccccaacactgggggttacaattcaacaagagatttgggtggggacacagagccaaaccatatcaattagtaatgttcaacactttttcatacacctgttggccatttgtatattttctttgaagaaatggtctattcagatcatttgcccatttttaaattgagctatctggtttttgttttgttttgttttgttttttgttttgctattgagttgtatgagttccttacatatcttgcacattaattcctcatcagatatatggtttgcaaatattttgtctcattttgtaggatgctttttcactctgttgatggggtttctttgctgtgcagaagcattttagtttgatgcaatcccacttgtctatttttgtttttggtgcctgtgctattagagtcatatacaaaaactcattgccaggatgaatgtcaagaagcttttcccttgttttcttctaaaagttttacggtttcaggtattaagtctgatatggcttggatatttgtccctcagaatctcatgttgaagcgtaatctccaatgttggaggtggggcctggtgggaggtgattggatcatgggggaggatcccttatgaatagcttggtgctattcctcacaatagtaagtgagttctcactcagagttcacacgagatcttgttgtttagaaaagtgtgtggcacctccctcctcactgtcttgctcccgttcttgccatgggacatgtttactcccctttgccttcctgaggctctcaccagaagctggccatgattataagcttcctgaggccctcatcagaagctgagaagctgttggtgccattcttgtacagcctgcagaaccatgagccaattaataaacctcttttctttataaattacttagtctcaagtatttctttatagcaatgcgagaacagcctaatacaaagtctttaacttattctgagttgatttttgtatacagtgtgatataagggtccaatttcattattttgcatgttgatatccatcaacactgactgaagagactgtcttttcttcattgtgtgttcttggcactcatgttgaagatcagttgcctgtgaatgtgtggatttatttctggctcttctattctattccattagtgtatatgtttgttcttattctagtaccatactgttttgattactatagctttgtaataaattttgaaatgaggaagcatgatgctcctgggtttgtacttcttgcgcaagatttctttggctatttggattcttttatgattttatatgaattttaggattgtttttcctatctgtaaagaatgccattcagattttgatagtattacattgaatctgtagatcattttaggtagtatggacattttaacaatattaattattccaatctgtgaatgtgggatgtatttccatttatctatgtgccctttaatttccttcattgatgctttacaattttcaatgtagaagtctttcacctctttaagtttattgctaagtattttgttttttgttgttattgtaagtggattgttttcttaattttcttcttggatagtttgtttttagtgtatagaaacgtcactgatacttgtatgttgattttgtatcatgttactttaatttgtttattagttctaacttttttttggttgagtttttaggattctcgaaatatatgatcatgtcattggcaagcacagatgattttacccttccttctcatttgggtgcttttttctttttctttcctaattgctgttgctgggacttctagtactatgttgaatagaagtgttgagggatgggcttccttgccttgtactagatcgtggaggaaaagctttcagtttttcccatcaattatgatgttagctgtgggcttttcatttatggccctttgtattgagttatgttcctcgtatacctattttgttgagagtgttcagtttaatggatgttgaattttgtcaaatgctttttctgcatctattgagataatcatgtggttttaatctttcattttgttaatatagtatatatcacattgattttcacgtgttgaaccatgcttgcattccagggataaatctcactggattgtggtgtatgatccttttaatatccttgttggattcagtttcttagtattttatcgaggatttttgcatctgtgttcatcagggaaattggcctgcagttttcttctggtgtccttgtcttgctttggtatcagagtaatgctgatttcataaaatgaatttggaaatattccctcttcttttattttttggaagagtttgagaaggattgatattaattcttctttgaatgtttggtagaatacaccagagaagccatttagtactgggatttttttttctggggcattttaaaattattgattcaatctctttatttgttattggtctattgtttctatttcttcttggttcagtgttgttaggctgcatgtttctaagactttagaagtaatcacctcttgcagacattgtggactggttttggtagggaaaaaccttcacctgtgggtgtgtgcaggtgtgctagattggtgaggtgtgtggtggtgctggttctggatgcatgcaagaatgctaatcccagggatatgtggtggttctagggctagggagtgcgtggtgccaccagctcaaagggggatgcttgagatcaccttgggggagcagtatcacaggctccaggtgcattggttgtgggctttgggtggctccagcagctgaggtccactttggcaaagactgtgggggtcctccactctgaaggctgaaatagtcctcagtggaaggcttctggaattttcctgttctccttttccttcactttggaactcatagctgaaggaatacctctaagtattgagctaccctggcctagggcatggggtgatgcaggcaaaataaaactgttctgttcttcctactgttttctatgtggttatcctcagattttgtgttccagtgggttgcttcagcttcttcttcttctttttctttttttcaagacagggtctcaccttgtcacccagactggagtgcagtggtgcaaaagcggctcactgcagcctggacctcctgggctcaagtgatcctcccacctcagccagccccacctccctcctgtgtagctgggattccaggcgcgcgtcaccacgcctggataatttttgtattttttatagagatggggtttcgccatgttgccctggctggacttgatctcctgggtttaagtgatccgcccacctcggccttccaaagtgctgggattacaggctctggagctctctgagagctgtttttgcctgtatatagttgttaaatcattgcttttgtggagacactagggctgggagctcttagtctgccatcttgctggtgttacttgacttctatgtgttttttacgtgttgccattacttttgagcacgtcattcctttcgggcacaataaaatattacaggcttattttgtattcctttcctttccttttttttcctttctttttcattcctttccttccttttcctttcctttcttttcctttttcctctttccttttttgagacagggtctcactctgtcacccaggctggagtgcagtgatgtgatctcactctctctgtcacctaggctgagtcacccaggctggagtgcagcggcatgatcttggctcactgcaactactgccacctgggttcaaggggttctcctgcctcagcctcctgagtagctgccattacaggcgtgtcccaccacgcccggctaatttttgtatttttagctcactgcagcctcgatttcccgggctcaagcaatcttcccacctcagccttctgggactacaggcacgtgtgtgctttcttgatcaagccatgaaattaactatgtatctcaggagaccttatttattttagtagaaaatcttatttagaagccaagatctgggcattacgcatccttattgcttttgggatgtcactgctctctcagaccctcacagtggaaagagcatatgtgtgtgtgtgtgtgtgtgtgtgtgtgtgtgtatatatatatgtgtgtgtgtgtgtatgtgtatgtgtatataaatatgtgtgtgtgtatgtatatatatctatattatatacactcatacatttccattacatttatctatattatttattatctatctatcttctatcatctctaatatactgaaaaccatgatatcgtctgtttcaatccaacaacaaaatattcatcctaattttctcccttttcatgtttctaattctcttctccaacaacaaaaaacttggcttcaattatccttaatgtatttatgtatttaatcagtacccctgtatgttaccagtcttccatattctctgccactctattcactgtgaggatgccctcttctccatgctcattctctgattcttcattttgggtttctttccctgggtgcttaccctcttccttctactctgactccctttaccttaccattatttcatgtctatgttctctcaccctatttgggctctgaatctacatgctcatctcctggatggaagaataatactttttttttttttttgagacagagtctcactcactctgtcacccaggctggagtgcagtggcacgatcttggctcactgcaactgccgcctcccaggttcaagcgattgtcctgcctcagcctcctgagtagctgggattacagacatgacccattgtgcctggctaatttttgtatttttagtagggctgggggttttaccatgttggccaggctggtctcaaactcctgacctcaagtgatctgcctgcctcagcctcccaaaatgctgggattacaggcaagataatactttcttatactagactgattgcatagaatcttatcggggagaccactcagtcctcagaatctctgtccccctggaaaattatagaactataaaaataaattttaaaaatacctgttattcaagtggccactgctataggaagagaaagtacataaaaaatggatgccagtcatggagtaatgggtgatgacatcagtatgcctctaatcctattggagactattattctaagcgaagtaactcaggaatggaaaaccaaacatcgtatgttctcactcataagtgggagctaagatgtgaggatgcaaaggcataagaatgacacagtggactttggggactcagggggaaagggtgggaaggggatgagggataaaagactacaaactgggtgcagtttatactactcggttgatgggtacaccaaaatctcacaaatcaccaccaaagaacttactcatgtaaacaaacaccacctgttctccaataacctatggaaataaaaagttaaaaaaattaaataaaattttaaaaagatgtccttaatacttttaagatgattttgtgaagtcctaaaaaatcaaaaccaaaaaacatactcttaagcaagtcaaatctaattaacttctattttaaagtaaatatatgccacacagcacttgtagaagtttgacagaagcgtgaaatcaagcgatgaaatggatagcaatgcagtagtccccccttatccgtgggggacatgttccaagatgtccagtggatacctgaaactgcggatagtaccaaatcctatatatactatgttttttcgtatatatacatacctctgataaattttaatttataaattgacactgtaagaaatgaatactactaataaaatagaataattataacaatatcctataataaaatttatgtgaatgtgatctctctctcttttaaaataccttattttattatactcacccttctttccttgggtaaccgaagccatggcaggagggaaaaccatggatggggggaactactgtaatggtttagtgtccagcttctataagtttatagtaataaatgtattaactggaataactaggacacagtaatgttttatttaatggaacttcctgatttagtgagagttagaaaattcttatattttgaacatttattttaaaaaatgtttgcatatacttacttttataagtggaacatagggattctttctttgatatttgagactcttgtaattaattactcaagacaatgctcatgatctgtgtacagccttgtaggaggagctactcattagtatcgctagttgtgagacatttcactgctttgaaaatcagtattctcatctgtaaagtgagagtgtatgacaacatggtctcaaagatcacttcagtgtaaaaattcctagtcctcaatttagggaagccctgagccatagtgcagagggtatgtgttcctatgtatgtattttttataataaaattctctgggagcagcttgtttacttaattctttacctctttctcctgttaatcagaattttattttgagtagtttgtatgctttggcttgctttgttatcttttatttctatctttagtttcttctagaagttatcttatgtatagagttttacttcattgtgaagcttttatttatgcaaaggaaatggccaattgatgtctgaaactctttgaagtaattcgttcaagattcagctagatttcattgctgctctgtgggacacaaagcttctaaatgaggtctaggttgcttactctattacaattcttttattctcttttgcctaaatttaccattttgtagccaaatatttgaaagataacgtgtaaatattctgtacatttctctctgtagtaacattgaatctcttggcacataaatgaattactccttttgatgtaaaactcagttttctgcctattatgggctagtaggcatatatttgctttctgtagacctttctgcccactgctttacgtatctgggagagcctaatcacttaaggttatctagtttcattccaaactcaaaatcatttgagccttaaaaatgactcactggtttttgtcaggtttgtcaaagatcggatggttgtagatgtgtggtattatttctgagggctctgttctgttccattggtctgtatctctgttttggtaccagtaccatgctgttttggttactgtagccttgtagtatagtttgaagtcaggtggtgtgatgctttcaactttgttcttttggctgaggactgacttggcaatgcgggctcttttttggttccatatgaactttaaagtagttttttccaattctgtgaagaaagtcattggtagcttgatggggatggcattgaatctataaattaccttgggcagtatgaccattttcatgatattgattattcctatccatgagcatggaatgtgttcttccatttgtttgtgtcctcttatgtttcactgagcagtgatttgtagttctccttgtagaggtccttcacatcccttgtaagttggattcttaggtattttattctctttgaaggaattgtgaatgggagttcactcatgatttggctctctgtttgtctgttattggtgtataagaatgcttgtgatttttgcacattgattttgtatcctgagactttactgaagttgcttatcagcttaaggagattttgggctgagacgatggggttttctagatatacaatcatgtcatctgcaaacagggacaatttgacttcctcttttcctaattggataccctttatttctttctcctgcctgattgccctggccagaacttccaacactatgttgaataggagtggtgagagagggcatccctctcttgtgccagttttcaaagggaatgcttccagtgtttgcccattcagtatgatattggctgtgggtttgtcataaatagctcttattatttcaagatacatcccatcaatacctaatttattgagagtttttagcatgaagggctgttgaattttgtcaaaggccttttctgcatctattgagataatcatgtggtttttgtctttggttctgtttatatgctggattacattcattgatttgcgtatgttgaaccagccttgcatcccagggatgaagcccacttgatcatgatagataagcttttggatgtgctgctggatttggtttgccagtattttattgaggatttttgcattgatgttcctcagggttattggtctaaaattctcttttttttgttgtgtctctgccaggctttggtatcaggatgatgctggcctcatgaaatgagttagggaggattccttctttttctattgattgaaatggtttcagaaggaatggtaccagctcctccttgtacctctggtagaattcagctgtgactccgtctggtcctggactttttttggttggtaggctattaattattgcctcaattttagagcctgttattggtctattcagagattcaacttcttcctggtgtagttttgggagagtgtatatgttgaggaatttatccatttcttctagattttctagtttatttgcgtagaggtatttatagtattctctgatggtagtttgtatttctgtgggatcggtggtgatatcccctttatcattttttattgcatctatttgattcttctctcttttcttctttattagccttgctagcgatctatcaattttgttgatcttttcaaaaaaccagctcctggattcattaattttttgaagggttttttgtgtctctatctccttcggttccctatttaataaatggtgctgggaaaactggccagccatatgtagaaagctgaaactggatcccttccttacaccgtatgcaaaaattaattcaagggccaggcgcggtggctcatgcctgtaatcccagcactttgggaggccgagacgggcagatcacgaggtcaggagatcgagaccatcctggctaacacggtgaaaccccgtgtctactgaaaatacaaaaaattagccggcctggtggtgggtgcgcctgtagtcccagctactcagaaggctgaggcaggagaatgatgtgaacccaagaggcggagcttgcagtgagcggagatcgtgcgccactgtaatctagcctgggtgacagagtgagactccgtctcaaaaaaaaaaaaattaattcaagatggattaaagacttaaatattagtcctaaaaccatgaaaacctagaatggtattgcctagaagaaaacctaggcaataccattcaggacataggcatgggcaaggacttcatgtctaaaacgccaaaaacaatggcaacaaaagccaaaactgacaaatgggatctaattaaactaaagagcttctgcacagcaaaataaactaccatcagagtgaacaggcagcgtacagaatgggagaaaatttttgcaatctacttatctgacaaagggcaaatacccagaatctacaaagaactcaaacaaatttacaagaaataaacaaacaaccccatcaacaagtgggcaaaggatatgaacagacacttctcaaaagaagacatttatgcagccaacagacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccattgtggaagacagtgtggcgattcctcagggatcttgaactagaaataccatttgacccagccatcccattactgggtatatacccaaaagattataaatcatgctgctataaagacacatgctgacatatgtttattgcggcactattcacaatagcaaagacttggaaccaacccaaatgtccatcagtgatagtctggattaagaaaatatggcacatatacaccatgaaatactatgcagccatagaaaaggatgagttcatgtcctttgcagggacatgggtgaagctggaaaccatcattctcagcaaactgtcacaaagacaaaaaaccaaacactgcatgttctcactcataggtgagaattgaacaatgagaacacttggacacaggaaggggaacatcagacgctggggcctgttgtggggtgggggcaggggggagggatcgcattaggagatatacctaatgtaaatgatgagttaatgggtgcagcacaccaacatggcacatgtatgcatatgtagcaaacatgcacgttgtgcacatgtaccctagaacttaaagtataataaaaaaattttaaaaaatgactcattggaatatttgtaacgacatgttctgtaaattttaagtgagtcatatacttttaaactaaatatctacggtatatggaaagcttggttagatttgtccatgttttgaggctctttatgtagccattagaacatttattattcattctaacaaataccaatgttgatttttagctcaggttgtcactgttattttttaaagtatggggtttactttttttttttaatactttaagttctgggataaatgtgcagaatgtgcaggtttgttacatagatgtacacgtgccatggtggtttgctgcatccattaacccgtcatctacattaggtatttctcctaatgctatccctcccatacctcctcacccctcaacaggccccagtgtatgatgttcccctccctgtgtccatgtgttctcattgttcagctcccacttatgagtgagaacatgcggtgtttggttttctgttcctgtgtcaggttgctgagaatgatggttttcagcttcatccatgtccctgcaaagaacatgaactcattcttttttatggctgcatagtattccatggtgtatatgtgccacattttctttatccagtctatcattgatgggcatttgggttggttccaagtctttgctattgtgaacagtgttgaaataaacatacgtgtgtatgtgtctttatgatagaatgatttataatcttttggctatatacccagtaatgggattgctgggtcaaatagtatttctggttctagatctttgaggaatcaccacactgtcttccacaatggttgaactaatttacacccccaccaacagtggaaaagcgttcctatttctccacatcctctccagcatctgttgtttcctgactttttaatgatcaccattttaactgtcgtgagatggtatctcattgtggttttgatttgcatttctctgatggccagtgatgatgagcattttttcatgtgtttgttggtcgcataaatgtcttcttttgagaagtgtctgttcatattactttttaatgcctacttgttgcatgtaattcttttttatcagtgtgtatctatacatagtttaaagagtaaaataagtttacaggtctttttacaaaatcaccagtacctatgaaaaattagccaggcttggtggcgggtgcctgtaattttggctattcgggtggctgaggcacgagaatgggttgaacctcggaggcagaggttgcagtgagccgagaacgcaccactgcactccagcctgggcgacggagtgactctatctcaaaaaacaaaacaaaactaaccccgaaaaaccaagatcaccagtacccatcctgacttttggacttatttttatctcacgtaacagctactttcagttattttagttggctctttttgtatttacctccatgtatctacatagtgttcttatactgctgtgctgcttgatttttttacttttagatattatatattgacttcccactttagaaggtgaatttagtttcttttctttttccctctacccccaacacatatgctcacttcctgtcactccatcatctctatatagtttaccataactttggttagattaatatttagtgtttacactccagtgtttatatgaatactatcatagttgaatcatataaagtaccatgattacttttcttttcttttcttgcacaaaagtttgtttttccctggagttaattatattggttttcctgactacttagtatttcatgtacttggtattgtttcttccctaattatgtaaacttctttttagtatgttagaatgtattagttattttatcactttcacttgcttaaagaaataactgtcatagtttctgatcttctcttatctgtacagattgttgtgtaagcatcctgttcagttatcgttttgagattttcctcctccattgacttgggaattcctttcaactccctcatagattgtaaccctgtttcttgaatcctgtgtctttctttttctgattttactccctaaattttgtggggcatatcctccagtagcttcttgagaaaggttgcatgaaatgaaaattgtttgaagagtttgcatgtctaaacatatttttattgtaccatcataatttatgctttcactggatataaaatttggacttggaaataatttttcctgagtattttgaaaacatcagttagattctcatctagcttctgatttgactactgagaaatgtgttgcaattttattttcttttactttttttaaatataaaatttttacttttgtgggtatatgatagatgtatctatttatggggtacattaaggttttgatgtaagcatgcaattgataataatcacgtcatggaaaatggagtattcatcccttcaggcatttatcctttgtgttacaaacaatccaactgaactatgttagttatttttaaatgtatattatttatataataataataattattattattttgagatggaatctctctctgttgcccaggctggagtgcggtggcatgatctcagctcactgcaacctctgccttccgggttcaagcgattctcctgcctcagccacccaagtagctgggattacaggtgcccaccaccacgcccaactaatttttctatttttagtagagacagagtttcaccatgttggccaggctggtctcaaactcctgacctcaagtgacccacccaccttggcctcccaaagtgctgggatttcaggcttgagccacggtgcccagcttaaaatttataattaaattattattgaccatagtcactctgtagtgctatcaaatacttggtcttattcattcattcttttttttttttttttttttttttttttttttttttgagacagagtctcactctgtcatccaggctggagtgagtgcagtggcacgatctcggcttactgcaacctccgcctcctgggttcaagagattgtcctgcctcagcctcctgagtagcccggattacaggcacctgccaccacgcctggctaatttttgtatttttagtggagacggggtttcgccatgttggccaggctgatcttgaactcctggcctcaagtgatccacctgtcttggtctctcaaagcgctcggattacaggtgtgagccaccgtgcctggcctattctttattttagattcaaatatatagtaggtctaatgtgctcagacatgcatattgaacttctgctatgtgaatgtactgtaattcaaagggaaacttttttgaagcaagacaggtctttatacattacttatgaataacttgcttcagatcttggattcttagttgaggatctgcttctgtagtcttactcgggtaaaacttataaaagactttttatatgggtataatcaaattctctagataggtggtttctataaatgctgaggggatatttggataaattattagcatcaaaatttctcctatgccatttcccagtattttgagagatgaaaattatgtaaaacatggcattaatgcagggactgagatgctgattcctaaggcaacattcatatacttgttcctactttcatctcaatgctaatttatgtaaagaaaatgattgttgatgctaaagagtgtccatgaaactatttctaaatacgtcttttgactagatagtgctttggacacattttagaacttcagaatttttagaattgtctcaattttgaaaaaaaaaaatcattcatttcccaacctcactcctcgtcaatagtgattttttgtctttgaatatactccctgctctagtgcctttaactggatctggcaaccaaaagcagggttttagcctgccctttggctgggcaatgattgggtttctcatttcctgttacaaagcatcttttaacttctattagtaatttattgtaatactttttcatacataactaattctccaacctgaatgttttgcagttcttctttatacaaattgagaagttttgataaggaagcttattttgatgtataggacacattaagtatgtttttgtttgtttgttttttgagacggagttttgctctgtctcctaggctggagtgatgtggcaccgtcatggctcactgccacctcggcctcccaaagtgtgttgggatttaaggaaatcatgaatctaatgcattttttttatattgcagacttcaagtcttcatcatctctgttacaactttggagtagaaacccagaagaataataaatatgaagaaagttctttctggcttaggtaacataaacaaaaaactgaatgtaaactcgggaatattatcatagatgtcagttaatatttactgtagagtactttggcagtttaaaccttctctgacttcagaagccaacatgctatatttatttactcttttaacatgtattgtttattattcttacacattgtcagttcatagaaaaatgtgttcttccttccttccttcattctttctttcttttttcctttctttctttttttcttcttttttttttcgtatctctctctgtcacctaggctggagtgcaatggcatgatctctgctcactgcaacctctgccttctgggctcaagcgatcctctgacctcagccttccaagtagctgggaccacaggcatgtgccagcatgcgtggctaatttttaatatctttggtagagaaggggtttcgccatgttgcccaggctgttctcaaactcttgagctcaggcaatccacctgcctcggtctctcaacgtgctgggattacaggcgtgagccaccacgcctgaccagtgttctcttcttaatataagagcttactcctctctcttcattcctcctttatatctctatcaagagtatagaaaattttgttgttgttgctttgatacttattgttgtctggcaacaccagagtataaggtggaggtgtgattgggagtagtattggctaaaattattagtcttagatgaattttggcattttaatatcagtcaagtaagtatatatttaacgctgtatgctgagtactatactaagatttggagtgttgtgctttatctggaaatatcaagaaaattatacaaaaatataggaaatgtgcaagaaccctttctttcactgaaaacctaggcccagcacagattctgacacacagtagatactcaataattgttagttaaatgaatatatgtgaaaaatgtatttttgtggagatgtcacataaggtgcagtgctttgaatatcaggagattatggaggaggctgggcatggtggctcacacctgtaatcccagcactttgggaggccaaggtgggcagatcacctgaggtcaggagttcaagaccagcctggccaacatggcaaaaccccatctctactaaaaatacaaaaattaggcgggtgtggtggcacaggcctgtaatcccagctactcgggaggctgaggcaggagaatcgcttgaaccagggagatgcagcttgcagtgagccgatatcgcaccgctgcactccagcctgagcgacagagagactccgtctcaaaaaaaaaaaaaagaaaaaaaaatggatcatggagtaaaatatatcaaatcaattcactaaatgtttaccctttctgagtgcaggattagttctagttatttggggatactcctatgattaactatagtctaacttttgtgaatatgatgtttgtcatttaacaaaataaatacaaatctgggcactgagattataatactcagacatatctatcactagcaaaatgttgatgcaaatgacttatataagagactttttaaagcccaaagattgatcaaactctatataaagaactattcctaatagaacaggctggagttctattccagtatttgacagtatttgggagtagaacactcacaaagtttatggcatcaatgtatcaaaagaccagtatgccaagaaggcaggaatagggagatccaaaaaaaaaaaaaaaaaaaaaaaggatgctggtgccatggatggcttctggaagcttaagactagatgtgagcttggagtttatgccaagaatgagggtgagttaggagtcataaaaataaatgttctctaggaactggtcataacagtaggttgaggcctgacatggcatgacttgtaggttatttgcacatacgccattggtttttgacttcttatctgttatcattttctaaagaatctcatggaaagaaaatatgttgatgagacatccatattataaactagaatatcttagcggctatatttgtaggaatataatctgacccacaatgatattttcataaaaatctaaataaataacaaatttatatagcaccagtatgagtcttttgtgttcacatcactagaataatattgaagaaaagaagaaaaactttaattttagccctagtaattacatatgattttaatctttctgcttcattttttcttgcacatcttttgggaatataaaaataacctggtgaaatattcacaaatgttttaaaaggaattatcatattttaatgtctaaaaagaggcaaaaataattatcagtattattaactgtaggaattgtagcacagtgaatagtttttctaacagtagactgactgtcagaatttgttgtcatctaagaccttagtgttaaattgttaaatattgtgatactttatttagaattgttgtggggtttacatatgataatgcatgtattatagagtattcagtaacatgcctggaaaacagaaactgcttaacaaacggaaaatgctgctactatctctacgtgatgtttgctatttattagagatggactctcttgtggccattccactagtttattctaaaatgtatcacagtcggatcaagcatggattacttactaagttcccaaataaaatgtcataaaaacaaacatctacatctttaaatctttggaacaattaaaaaaaaaaaacattgtttttttgtagaggcggagcctcgctatataaaccacggtggtctcaaactctggcctaaagttatcctcccacgtcagcttcccaaactgctggaattacaggtgtgagccactgcgcctgaccctttggaataatttcttcatgctttatatccacatgttaaaaaaactgttggcagcagttggtgatgcaagcagagatgaatagctgctaattaagcaccgttttctgtaaattttataccagaaggaggtcatggaaaatgagtacacattctacaggcttaactcttttgagaacagtgaatatcttagactagaggttatatataatttggaagtacccattcagtctaaaagtaaaaacctcatttttcacaaatgataatatataaaaatgctgtagtatattcgaatttttttgaaattgaagcctagagcaatactaaacgtaaagagtggtagtgggtattgtttaaaaagctcatttatttcccttgatttttgttaacatctcagtgcaggacctttctgagtttttatcaccctcctgccttttcttttgctaagaaaagttcataaatagctgctgctctccttgctttctgccacactcttttgatcgtgttcccttagagataccacaggttaagagaaagctgctgtaattatgaatgaaattaaaattccttcagctcgctttactgtggattgtcaacgtatttgcctcaatgtattaaatgacaaattctcttagacctttataaaatacaaaatttcagatttttgaaatccgaatgcaaggtttggaaataatatatttaagagtttttttgtttgtttgtttaataaaataccattttttcctccttctcctcctctttcgtaagtcttgcagtactgagctcctatgtctgctcctggcagaaggcagggctaagtagatgagaagagattgttgatagagaaatttccctcacaatctagacaacttgttagtggcctccattgttctggtggaatttaaattgtgtttagctcttaaagtcctatctaatgattaggacatatattatgctgaacttggcttttcagaaaaggtatacagaaatttcattgtaacaaatttgtattctacaaagaagaattgcatattaacacaaataagttcaactcaaaaggctttagggttacatttattaaccagaaagacttcgcagatttttttccctgggagaaaaatgctctactttccaaaccttagtcatattcttaattctgggtgatttttcatttatctctagtagttttatttctaagtcatttaactgtattccttggcactgctgacctacagcaatatcagacatctctgtggctgataaacacttgagaagctcactattttccttttgaagtaagaagacctcctactactttcttttcccctcaagcttcgttgaggtataattgacaaattaaaattgtatgtatttaatagtgtacaatgtgatgttttgatatatatatatacactgtgaaatgattactacgatcaagttgattatcatatccatcacctcacatagttaccatttttttctcacatgtcattataacagaattttattagtaatcatcaaacacacattgttcaaatttcactgattgtctcataaaatcttatacaattgatttgtcaaggcctatatactgtgattgattaaggtgtctcttatgtctactttaatcctaggtttcttcctttttttccttgcaatgtatttgttaaagaagtcaggtagcttcctgcattttgaattttgctgtttgtgcccctgttccttaacatgtttattttttctgtgttctctgtatttcctacaaattagtaattaagattctaaaggctcttaccagattttttggcagaagtatttcacaggtggtgtggtgtatgtccatcaggggtcttgtatgttagttgttttgttttttgcgatattagcagccatcagtgatcattgcctggattctttatttcatcagtgtttgtaaaataatagtattctaattgtgtcattttacttttcctttatgagctggaatacttctctagagtacaacttcccttagcaactgttagattactctgaggtccaattgtctgagttgccttttttttgtgtgtgtggtgagaatatttaatatctactctcagcaaatttcaagtgtacaatgcagtattatgaactatagttaccaagctgtacactagatctccttttaagaaagagagaagaaagaaagaaagaaagaaagaaagaaagaaagaaagaaagaaagaaagaaagaaagaaaataaaagaaaagaaggaaaagaaagaaaagaaaggaaagaaaggaaaaagagagcattcatggagacaatgccccaaagaaatcagaaattttcaaatggataactcctttgaagaaggaatgagattcctgtaatggctgcttcctggaaggcagtgtcatgtggaaccccttagcctcagcatccagagctccaggaagggaacatttccagtcaggtagaattatatatatactatttctttggaaacttcagccatcaagattcagccatcaaaattccaccatcatgacttctgtttcaacacaatggctcttagtcctcattttactgcttttgttgctgcctgttgttgaagcagtagaagccagaaatgcaattgctgtcatgttgggtgtggttctcagcattacaggcatttgtgcttgcttgggggtatgtgcacaaaagagaaatggacagatatgactttgaagggcatcccaaatcaaactttgccctgaaaacctttggactagtgaggctaaacttgagctttggtgtttgaaaatttccaagaaacagtaaataggggagttccacattcttagttgttttccataaaatgagagcaaattgctatgtataagaaaaaatgttttccttacaataaataatgcactgaaaaattaagcctataatttgtatttgctgcttagaaagggggttcaagaagtaagatggttgacatttacataagtaatatttcatagttttctaattatctaagctgggcatggtggcatgcgcctgtagtcccagctacttgaaaggctgaggtgggaggatcacttgaacccaggaggtcgaggctgcagtgagtcatcatcacaccactgcagtacagccttggtgacagagtgagatcttgtctcaaaaaaaaaaaaaaaaaaaaaaagcacatgaaataggaagaaggaagttcttgcccagaatcctaagaaatcaccactgttcagttataatcactgcctcctgaatcattgaggagtcttttctccatattttcattagacttttgttattgcccaagttaatattgtatttaaatatcaaatagccaaacatagatgcttttatctctggagaaaaaacatttagaaaaatgcattcagtgtatctaacattgaagtggagaaaagagttaatgtaaaaaaatcctttatttttatatttatcattttaaacttttattttaggtttggggtacatgtgaaagtttgttacataggtaaactcatgtcatgggagtttgttgtacagattatttcatcacccaggtattaagcccagtacccaatagttatattttttactcctctccctcctcccaccctccaccctcaagtagacctcagtatctattgttctcttctttgtgttcatgagttcgcatcatttagctcccacttacaagtgagaacatgtggtacttggtttgctttaaaaaaacactttatatttacattgaaatggagaagatatttaatgttaaaaaactttatattaattaattgagtaacatccccatggggagaagtactatattaaatataaactcattatgttgttaaaaaaaaaagaagggacgaaatgatgttgaagatgaaacctgcagcagcaggctgtacacaacaatttgtgaggaaaaaattaatcgtttgtgctctaattgaagaggagtgatgattaatagtacaaataatagccaacaccatagacatctcaatttgttctgcttatacaaatctgactgaaaaaattgaagtggagcaaactcaatgggtgccaaaaccattgtgcccagatcagcggcagataagagcagagctttcattggaaattttaaacaagtgggatcaaaatcctgaagcatttcttcaaagaattgtaacaagagatgaacatggctttaccagtatgatcccaaagagaaattacaataaaagcagtggctaccaagaagtggaagtggtctagtcaaagcaaaagcagctctgtcaagagtaaagatcatagcaacagttttttgggatgctcaaggcattttgcctggtgatttttctggagggccaaagaatgataatgtctgcttattatgagagttttttcagaaagccaaaattttagcaggaaaatgcctgaaaagcttcaccagtgtccttcaccacaacaatgttcctgctcattcctgtcatcaaacaaaagtaatcttgtgaatttcaatggaaaaacattaggcatccaccttacagacatgatttggctccttctgacttctttttgtttcctaatcttaaaaaatctgtaaaaggcacccatttttcctcagttaatgtgaaatgtgaaaaagattgcattgacatagctaaattcctcagttctttatggatggactaaatggctagtatcacaaaggtatcttaaacttgatggagcttatgttgataaataaaatttatattttaatcttttaattccatttttccaaaagttttttgaggtctcataatattctgcaattccacaggctgtctcttcactctgttaattgtttcctttgcagttgtacatggtatttagttagatgtaattccatttgtctatttttgtttttgttgtctgtactttgggggtcatatctaaaaaataatttcccatacaatatcaataagctttcccccagttttcttctagtaattttacagtttctggtcttacatttaagtctgtaatccatttttaattgattttttgcataaggtgggagataaggttccaattttattcttctgtatgtggatatccaggtttttccaacaccatttattggagaaactctcttttccccattgtatgttcttggcaactttgttgatcatcagttgcccataaatatgtggattttgttctagatattctattctattccattggtctgtatgtctttttaaaatgtccataccatgctgttttaatgactattagatgtctagtgtattttgaaatcaggaaatgtgatggctccagctttgttctttttgctcaagattgctttggctatttaggtcttttgtgattccatataaatttgaggattattttttctgcttctgtgaaaatgccattgtcatgttgacagggataagactgaatctgtagaatgctttaggtagtatggacatttaaaaatattaagtcttccaatctatgaacacaggatatctgtccctttatttgtgttttcttcaatttctttcttcagtgttttatagttttcagtgtgcaagtctttcacctccttggttaaatttactcataagtattttattttttgacactattataaatgggattgttttcttaatttttgggtatagttcattgtttgcatataaaagctactgatttttatgttgattttgtgatttgcaactttattgaatttattagttctgacagttttttggtagcattttaaggttttctaatataagattatgtcatctgcaaacaattttacttcttcctttcaaatttgaatgcctttccccccccctcatcttgcctaattgctctggctaagacttctagtacaatgttgaatagaagtggtgagagtgggcatctttgctttgcttttttcctatgttagaggaaatgttttaacctttttaccatctagtatgatgttaactgtggacttgttgcatgatttttattatgatgaggtacattccttctattcctaattttttgaaatttttttttaatcttgaaaggatgaattttgtaacagaagatttttctgcatctatcaagatgactatatgatttttatcctttattctgttcaaatggtgtatcacatttattgatttttatatgctgaaccacccccaccctcatatctgaggaataaatcctagttgatcgtgctgtatttggtttgctagtattttgttaaggattttttcatctgtgttcatcagggatagtttttttgtcatgtccttgtctggctttgatattagggtaatgctggcctcatagaatgagtgtggataggttctttcctcttcatttttagggaagagtttgagaaggattggcgttaagtttttcttaaatatttagtagaattcaccagtgaaggcatttggccctgtgttttccttggttgtgagatttttgattactgattcagtcaccttaacattattttatgtttctgtgtttgttaacttaaggcctccagctgcatccgtgttgctgcataggacatgatttcattctttttaaatggctacatagtatttcatggtgtatatgtaccacatttaccttatgcattctgccattgatgggcagcaaggttggttccatgtctttactattgtgaatagtgctgcaatgaacatacaggtgcatgtgtctttttggtacaacaatttgttttcttttggctgtatccccagtaatgaaattgtggaatcaaatagtagttctgttttaagttctttgagaaatctccaaactgctttccacagtggctgaactaatttacatccccaccaacagtgtaaaagaattcccttttctctgcagcccagctaacacctgttattctttgactttttaataaaaaccacttcgactggtgtgagatggtatctcattgtggttttgatttgcatttctctgatgactagtgatgctgagcattttttcatatgtttgttgaccacttgtatgtcttcttttgagaattgtctgttcatgtctttttaacccccactttttaatggggttatattttgcttgttgaattatttaaattccttaaagattctgggtattagacctttgttggatgcatagcttgcaagtatttactcccattctgtaggttgtctgtttactctgttgatagtttcttttgctgtgcagcagttctttagtttaattaggtcccacttgtcaagttttggttttgttgcaattgcttttggtgaggacttagtcataaattattttccaagactgatgccacaaggtagtcttctttggcttaaatccacctggtgttctataatctgttacttgaatattgatatctctctaggtttgggaagttctctgttattatccctttgaataaactatctaccactatatctttctctacctcctctttaaggtcagtgattcttatatttgccctttatgaggctatattctagatcttgtaggaatacttcattcttttttcttttgtctcccctgacttgtatttttaatagcctgtcttcaaggtcactacttatttcatctacttgttcagttgcactattaagatactctgatatcagtatatcaattgcatttttctattccagaatttctgcttgattctttgtaattatttcaatcactttgttagatatatctgataggattctgaattccttctctgtgttatcctgaatttttttgtttcctcaaaagggctaatttgaattctctgcctgaaaggtcacatatctctgtcactctgggattggtccctggtgccttatttagttcatttggtaagggcatgttttcctggatggtcttgaggcttgtggatatttgttggtgtctggacagtgaagagttaggtatttactgtagtctttgcagtctgggcttatttgtatccatcatttttgggaagactttctaatatttgaagggatttgcatgttgtgtgctatgtttttggtcacagcagccgtatctgccttagaaggcaccccaagcccagtaacactgtgagtcttgcagacttttagaggtctcaccttggtggtgttggatggggtccagaaaaattctctggattaccaagcagagactctttgttctcttcccttgctttctctctaacaaatggagtctgtttttctgtattgaactgtctggagctaggggaggagtgatacaagcacccctgtggccactacccctgggactgctgtgtctgacctgaagccagcgtagtactgggtctcacccaaggcctgctgtaatctgctacctggctaccacctatgtttgcttaatgaacgagggctctaatagcaggtgaggcgatgaagcttgccaggcttgtgtccttcaattcagggcagcaagttccccctggctcctggtgggtgcaaagatgctggccaggaacaagggcctggagtcagaatccttagggagctacctggtgctcctttttactgtggctgatctggcacccaagccacaagaaaaagtttttttctactcttccctcctctttccacaagcagaggagtatcttcctatggccaccactgtcacaggcccgtggggagtactgccaggctccactgatgttcactgaaggcccaagggctcttcagtcagcttgtgatgaatggtgccgggtctgggactcatcttgcaaggcagtgcacttctctctggcccagggtaggtccagaaatgccatccaagagtcaaggtctggaattggggacccaagagactgcttggtgctctaccccactgtggctgacctggtacctaagctgcaagataaagtcccctttcatcttccccttttttttgtcaagcagaaggagactctccccatagccaccatagctgggaatgtgttggctcacacctgaagccagcacatctcagattctcacccaaggcccatctatggtatgcactacttggctatcgctgctgattgttcaaaatgtgttggctttctagccagtgggtgatgaatcctttcaggacctggtctttcctttcaaggcagcagatccccttctggccctggttgtgtctagaaatgttatccagtagctagggcttggaatgggtgtctcatgactcttcctggtgtcctatcctaccatagcagagttgttatccaaattgcaagaccaagccctgtttactcttccctttcctctcctcaagcagaaggaagggggtctcttggagctgcaacctgtgctgcctgggcttgggggaggggcagggtaggcactcccttggccacccaggctggtgtctcacatgccccctaagtttactgactccatacccacaaggacttgccttgtggcctagactgcctttcaggtttatttaggaccccaatgcactttagccgacagcaatgaggcttgctacaactcaagttccaattactggaatggatgattgccctctgactagggctggtctaaatgtgctctccattgacgtcaactgatttgtgcctagtgttttctgctgtgaaagggcggcactgagttgcgatgcagagtctcacaatcattgcactctctatcccccaaacgcacagattcttcccattatgtggctgtgaatggggaagggatggtgtgggcaattcaagactgtctttcctaccctcttcagtgcctctttcagttatatgaagttaagaccaggcactgtgaccactcacctgatttttggttcctacaaaattgctttttttgtgcagatagttgtcaagtttggtgctcctgcagggagaatgatcagtggagacttccatttggccatcttgctctatctccctctacatttattttgtatcctgaaattttactgaagtcatttattagttctaagagccttttttttttttggaggctttagtgctttctagttatagaatcataatgtcagtgaagggagatagtttgacttcttcttttcctatttggatgcttttaatttctttctcttgcctgatcggtctggctaggatatatagtacgtattaggccattcttgtttgctataaatacttgagactgttttaatttataagaaaaaaggtttaattggttcatggttctgtaggctgtacaggaaacatagtgctgtcatctgcttctggtaaggcctcagaaagctttttctcatggcagaaggtgaagcgggagcagacatttcacccggcaaaagcagaagaaagagagtgagggtgggagggaaagtgccacccacttctacaaaaccagatttcgtgagaactcattcactcatcaccaaggggatgggctaagccattcatgagagatatgcccccatgatccaaacatcttccagcaggccctatctccaacactggagattacaagtcaacatgagatttgggcagggacattcaaactacaccacagtactatgttgaatagaagtggtgagtgtgggcgtccttgtttgttccagttctcaagggaaatgttcctagttttggcctgttcattatgatgttggccgtgggtttgtcatagatggctcttattattttgagatatgttcctttgatgcctagtgtattgggggttttttatcatgaatgggtgttggattttattgaatgcattttctgtgactattagagatgatcatgtggtttttgtttttaattctgtttatgtggtcagtcacattcattgatttgaatatattgaaccaatcttgtatcccaggaataaagcctacttgatcgtggtgaattaactttttaatgtgttgctggattcagtttgctagtattttgttgaggatttttgcattgatgttcatcagtgatattggctggaagttttgttttttgttgttcctgccagatttaggtatcaggatgatgccaccatcaggatgatgcatcgtagaatgaattacggaggagtctctcctctttgatattttggaatattttcagtaggattggtaccagctcttctttgcatgcctggtagaatttggatgtaaattctaggtccagggctttgttgtcattgttgtttttgtcgttgttgatcttctttctctattttctttgttaatttagctaccagtctgtgaatcttgtttattctttcaaataaaaccaagttttggtttcgttgatcttttgtatacagttttacatctcaattttattcagttttgctatggttttagtcatttttttttcttttgttagctttgaggttagtttgtttttgtttttctaattcctctagttgtgatgttacattgttaattttagatctttctaacttcttgatacaggcatttcatgctataaactttcctcttaacactgcttttgctgcatcccagatatatatttgtgtgtgtatatatatatatatatatatatatatatatatatatatatatttttttttttttttttttttttttttttgagacagagccttgccctgtagctcaggctggagtgcagtgggaccatcttggctcactgcaacctctgcctcctgggttaaagcgattctcctgcctcagcctcctgcatagctggaactacaggcgtgtaccatgcctggctaattttttttttttttttgagacggagttttgctcttgttgcccgtgctggagtgcaatggcgcaatctcggctcaccacaacctctgcctcctgggttcaagtgattctcctgcctcagcctctcgagtagctggaattacaggcatgtgccaccatgcccggctaattttgcatttttggtagagacggagtttcttcatgttggtcaggctggtcttcaactcctgacctcaagtgatccacccgcctcggcctcccaaagtgctgggattacaggcgtgagccactgcatggcccatcccagagattttggcatgtcgtgtatcttaattaatttcaaagtattttttatttctgccttaattttattgtttacctgaaatcactcagtaacaagttgtgcttaatttccaggtaattgtgtggttttaagggatcttctttggtattcatttctatttttattgcactgtggtctgagtgtatgcttggtatgatttcagtttgtttgaattcattgagatgtgctttatgcccgaacatgtggtcaatcttagagtatgttctgcatgcagatgagaagaatgtgtgttccatggttgctgagtgacatattttgtagaaatctattaggtccaattgttcaagtgttgaatttaagtgcagaatttcctcataagttttctgccttgatgatctgtctaacgctgtcagtgggttcttgaagttccccttattattgtgtgactgaggctattcataggtctagaagtacttgttttatgaatcagcgttctctaatgttgggtgtatatatatttaggataattaagtcttcttgttgaattgaatcctttattgttatgtaatgtcctttgtcctttttgactattgttggtttaaagtctgttttatctgatataagaatagtgacccctgcttttttttctgtttttatgatagatctttctccatcactttactttgagcctgtaggtgtcattacatgtgagatgcatctcttaaagatagcagatgatggtttccagcttcatccatgtccctacaaaggacatgaactcatcatttttatggctgcatagtattccatggtgtatatgtgccacggtatacatatgtaacaaacctgcatgttgtgcacatgtaccctaaaacttaaagtataataataaaaaaaagacagcaaatgattgggtcttgttttttatccaacttgccattcttgaaacttctgacctgtgtgctcaaacgatgcaggattgggactgggcctgcagctttgtactctggcccctcatagttgaacactagctgtcctagcggggctgaagtgcacccaagccactggcaaagcactcaggcagggcagtggaggctatgctgtgtgcttgctcttgtaggagaatccaggcaggagccttgggaggtgttgccgacagaggggcatgcagatcagatgcactccagtactgcaggaaagccatctctgctctatcctctctcttggcccagcagtcatcagggtcgtgttttactgcagctgccttgcatgcagaaccttctgggctctgcgcaggcttgagctctgcctctgtctactctcctggcattttaccctgccaatttaaatgtctatggagtttgtggaatctcttgtagctaggatcccagaggtccgtggtgggagtgtgttgactcataattccttcatttaccccttccttaggacctgttgaaggctgagagctggtcctggtgcttggtgactccatgcggagttcccagtttcctgtgcctcttccaagtcagtgtctgtgttgcctctctgttgactttcagtgttttctctcaaaagatgtgtttgaagtgtgatggtttacttgatatttggtttctcttggtgagagaggtgcttcccagctgtgtcttgaaccatcttgttccttatccaagtttgtactttttaatcatcatctctacattctctccacagctctgtctctgtaaccaccattctactctgtgcttgtacgagttcagttgttttagattccaggtacaatttaaaacatgtggtatttgactctccgtgctggacttatttcacttagcataatatcttcctggttcatccatgttgtcacaaatcacagtttttccattcttttaaaggctgaatagtattccattgtgtatataatgctacattttttaatccatttatttgttgagggacacttaggtggattgtgtaacttggctattgtgagtagcgttgcagtgaacccagaagtgtagacgtctctttgacaaactgacttcaaatatttggggtaaatacccaaaagctgcatcatatagtaattttatttttagtttgttgaggaacttctatacagttttccataatgtttgtactaatttacattctcattgacaatgtacaagggtttccttttttcacatccttgccaactcttgttatctttcgtctccccataatcattctgacaggtatgaggtgatatctcattgtgggttttttgtttgtttgtttgtttgagacagagtcttgctctcggctcacttcaacctccgcctccagggttcaagtgattatcgtgcttcagcttcccgagtagctgggatcacaggcgcctgccaccatgcctagctaatttttgtatttttagtagagacagggttttgccatgttggccaggctggtctcaaactcctaagctcaggtgatttgcttgccttggcctcccaaagtttgggattacaggcgtgagccaccacacctgccctcactgtggttttaatttgagcttccctaatgtgtagcgattttgagcattttttcatatatctgttggccatttgtatgtgttcttttgagaaatgtgtattcacttttcttgccaacttttttttttttgagacagggtcgtgttgtatttcccaaagtggtcttgtgctggtctcgtactcctgtgctcaagcaatcctcctgcatcagcctctggagtagctaggattatagatgtgtgccaccatgcctggctttttgcccattatttatttggattatttgttttcttgctctctctctctctctctctctctctctctctctctctctctatatatatatatatatatatatatatatatatatataatcaaaacccttactggatatatggattagaaatactttctcccaatctgtaggttgactctttgcactgttaattgctttcattgctgtgcaaaagctttttagcttgatataaccccacttgtctctttttgcctttgtttcctgtgcttttgtggtcaaatccaagaaaacattgcccagaccaggccatgtagtttttcccctgtgtgtgtgtgtgtgtgtgtgtgtgtgtgtgtgtgtgtgtgtgtttcccaagagatttacattttctgatcatcagggttattgtagttttattttcttggaatgtctttgtctggctttagtatcagggtaatgctgaccctgttaaaagagtttggaagtattggttttttttgtattttggaagaattacatttaggtctttaatccattttaagttgatttttgtacgtggtgggagagaaggtttaaatttcattcttctgtgtgtggatatccagctttcccaacatcatttgttgaagagactatccttttttcattgcatattcttggcacctttgttgaaaaccaattgaccacacatgtgtgggttcatttctgggctctctattctgttccattggttgacacgtctatttttatgccactaccatgttgttttaattactatagctttgtaatatagtttgaaattaggttgtgtgaaccatccagctgtattctttttgctcattgtagcatttgctaattggtgttttttgtggatccatacacattttagtgtcgttttcccatttctatgaaaattgatattggaatttttatagggattgcattgaatctgcatatcacttttggtagtatggatattgtaacaatatgaattctttcaatccatgaacatggggtatctttccatttgtgttttcagttttttttttcagtttatagttttcagtatacatgcctttcacttccttggttaaatttatttctaggtattggatttttttgtagctattataagttagattgttctctttatttcatttttggatagttcattgatcgtgcctagaaacactattgatttttgcatgtacaatttgcattttgcaactttactgtatttttttattcattcttaacagttttttggtggagtattcaggattttctaatataaaatcatgttgtcagcatctgatacaatttcacttcttcctttcttgtttggatgtcttttactttctttcttttgcttaattgctctggtgaggacttccaatattatgttggatcgaaatggcaagagggggccgggtgcagtggctcatatctgtaatcccagcactttggaaggccgaggtgggcggatcacgaggtcaggagattgagaccatcctggccaacatggtgaaaccccgtctctagtaaaagtacaaaaattagctgggtgtggcagcatgtgcctataatcccagatacttgggagtctgaggcagaagaatcatttgaacctgggaggtggaggttgcaatgagttgagattgtgccactgcactccaacctggtgacaaagctagactccatctaaaaaaaagaaaaaaagtggcaagagggggattccttgtcttgttctagatcttagagtaaaggtttcagttttttactgttgagtataatgttagctgtgggtttcttatatatggactttattgtgttaagatacgttctttttatatctaatttggtgagagttttataatgaaaaaatgttgaattttgtcagatgctttatttatttatttgggatggagttttgcttttgttgcccaggctggagtgcaatggcacaatcttggctcactgcaacctccttctcccaggttcaagtgattctcctgcctcagcctcccgagtggctggaattacaggcatgagccaccatgcctggctaattttgtatttttagtagagatggggtttctccaagttggtcaggctggtttcgaactcctgacctcaggcaatccgcccgctttggcctcccacggtgctgggattataggtgtgagtcaccacaccgggacagtcagatgctttttccacatcaaatcagaggatcatatgttttttgtcctttactctgttaatgtgacataccacatttacgttttgcatattttgaactattccatctcaggaataaatcccacctgatcatagtgaatgatccttttaatgtgttgttgaattcagttgctagtattttgttgaggatatttgcatctatgttcatcaaggttattggtctgtaattttcttttcttggaatgtccttgtctggatttggtatcagggtaacgctaatcttgttaataaagtttggaagcattcccccttctgattttttggaagagtttgggaaggattgccattcattctattatttatttatctatttattttattatacttcaagttctacggtacatgtgcatgcacaatgtgcaagtttgctacataggtatacatgtgccatgttggtttgctgcacccatcaactcatcatttacattaggtatttctcctaatgctatccctcccccaagcccaccacctcctgacaggccctggtgtgtgatgttccccaccctgtgtccaagtgttctcatggttcaattcccacctatgagtgagaacatgtggtgtttggttttctgtccttgtgatagtttgctcagaatgatggtttccagcttcatccatgtccctacaaaggacatgaactcatccttttttatggctgcatagtattccatgctgtatatgtgccatattttcttaatccagtctatcattgatggacatttgggttggttccaagtctttactattgtgaatagtgccacaataaacatatgtgtgcacgtatctttatagtagcatgatttataatcctttgggtatatacccagtaatgggatcgctgggtcaaatgctatttctagttctagatccttgaggaatcgccacactgtcttccacaatggttgaagtaatttacactcccaccaacagtgtaaaagcgttcctatttttccacaaccttaccagcacctgttgtttcctgactttttaatgatctctattctaacgggtgtgagatggtatctcattgtggttttgatttgcatttctctgatggccagtgatgatgagcattttttcatgtgtctgttggctgcataaatgttttcttttgagaagtgtctgttcatatccttcacccactttttgatggggctgtttgattttttcttgtaaatttgtttgagtacattgtagattctgcgtattagccctttgtcagatgagtaggttgtgaaaattttctcccattttgtaggttgcctcttcactctgatggtggtttcttttgctgtgcagaagctctttagtttaattagatcccatttgtcaattttggcttttgttgccatagcttttggtgttttagtcatgaagtctttgccagtgcctatgccctgaatggtattgcctagattttcttctaggttttttatggtttcaggtctaacatttaatccatcttgaattaatttttgtataagctgtatggaagggatccagtttcagctttccacatatggctagccagttttcccagcactatttattaaatagggaatcctttcccatttcttgtttttgtcaggtttgtcaaagatcagatggttgtacatgtgtggtattatttctgaggcctctgttctgttccattggtctatatatctgctttagtaccagtgtcatgctgttttggttactgtagacttgtagtatagtttgaagtcaggtagtgtgatgcctccagctttgttctttttgcttaggattgtcttggcaatgtgggctcttttctgtttccatataaactttaaagtagttttttccaattctgtgaagaaagtcattggtagcttaatggggatggcattgaatctataaattaccttgggcagtatggccattttcacggtattgattcttcctacccatgagcatggaatgttcttccatttctttgtatcctcttttatttcgtggagcagtggtttgtagttctccttgaagaggtccttcacatcccttgtaagttggattcctaggtattttattctctttgcagcaattgtgaatgggagttcactcatgatttggctctctgtttgtacttggtgtataagaatgcttgtgatttttgtacattgattttgtatcctgagactttgctgaagttgcttatcagcttaaagagattttgggcagagatgatggggttttctaaatatacaatcatgtcacctgcaaacagagacaatttgacttcctcttttcctaattgaataccctttatttctttctcctgcctaattgccctagccagaacttccaacattatgttgaataggagtggtgagagagggcatctttgtcttgtgccggttttcaaaggaaatgctttcagttgttgcccattcagtatgatattggctgtgggttttgtcagaaatagctcttatttttttgagatacgttccatcaatacctagtttattgagagtttttagcatgaagagctgttgaattttgttgaaggccttttctgcatctattgcgataatcatgtggtttttgtcattggttctctttatgtgatggattacatttattgatttgcatacgttcaaccagccttgcatcccagagatgaagctgacttgatcgtagtggataagctttttgatgtgctgctggattcggtttgccaatattttattgaggatttttgcatcaatgttcgtcagggatattggtctaaaattctctttttttttgttgtgtctctgccaggcttttgtatcaggatgatgctgacctcataaaatgagatagggaggtttccctctttttctattgattggaatagtttcagaaggaatggaccagctcctctttgtacctctggtagaattcggctgtgagtccatctggtcctggacttttttttggttggtaggctatcaattattgcctcaatttcagaacctgttattcacctattcggagattcaacttcttcctggtttagtcttgggaggatgtaagtgtccaggaatttatccattccctcgagattttcttgtttatttgcatagatgtgtttatagtattctctgatggcagtttgtatttctgtgggatcagtggtgatatcccctttgtcattttttatagcgtctatttgattcttctttcttttcttctttgttagtcttgctagcggtctatcaattttgttgatcttttcaaaaatccagctcttggattcattgatgttttgaagggatttttgtgtctctccttcagttctgctctgatcttagttatttcttgccttctgctaactttgaatttgtttgctcttgcttctctagttcttttaattgtgatgttaggatgtcgattttagatctttcctgctttctcttgtgggcgtttagtggtataaatttccctctacacactgctttaaatgtgccccagagattctggtatgttgtgtctttgttctcattggcttcaaaaaacatctttaattctgccttcattttgttatttacccagtagtcattgaggagcaggttgttcagttcccatgtagttgtgtgttttgagtgagtttcttaatcctgagttctaatttgattgcactgtggtctgagagacagtttcttgtgatttctgttcttttacatttgctgaggagtgctttacttccaattatgtggtcaattttagaataagtgcgatgtggtgctgagaagaatgtatattctgttgatttggggtggagagttctgtaggtgtctattaggtccaattggtccagagctgagttcaaagtcctggatatccttgttaaccatctgtcttgttgatctgtctaatattgacagtggggtgttaaagtctcccattattattgtgtgggagtctaagtctctttgtaggtctctaaggattgttttgtgaatatggatgctcctgtattgggtgcatatatatttaagatagttagctcttcttgttttattgatccttttaccattatgtaatggccttctttgtcttttttgatctttactggtttaaagtgtgttttatcagagactaggattgcaacccctgtttttttttttttttttttttgctttccatttgcttggtagatcttcctctatttttaaattttgagcttatgtgtgtctctgcacgtaagatgggtctcctgaacacagcacactgatgggtcttgactctttatccaatttgccagtctgtgtcttttaattggggcatttagcccatttacatttaaggttaatattgttatgtgtgaatttaatcccgtcactatgatgttagctggttagtttgcccgttaattgatgcagtttcttcctaacatcgatggtctttacaatttggcatgtttttgcagtggctggtaccagttgttcctttccatgtttagtgcttccttcaggagctcttgtaaggcaagcttggtggtgacaaaatgtcttagcatttgcttgtctgtaaaggattttatttctccttcacttatgaagcttagtttggctggatatgaaattctgggttgaaaattcttttctttaagaatgttgaatattggccgccattctcttcgggcttatagggtttgtgccaagagatcagctgttagtctgatgggcttccctttgtgggtaacccaacctttctttctggctgcccttaaaattttttccttcatttcaaccttggtgaatctgacaattatgtgtcttgtggttgctcttcttgaggggtatctttgtggtgttctctgtatttccctgaatttgaatgttcacctaccttgctaggttggggaagttctcctggataatatcctgaagagtgttatccagcttggttccattctccacctcagtttcagggacaccaatcaaacgtagatttggtcttttcacatggtcccatatttcttggagattttgttcatttctttttactcttttttctctaaacttgtcttctcactttatttcattaatttgatcttcaatcagtggtaccctctcttccacttgatcgaatcagctactgaagcctgtacatgtgtcacgaagttttcgtgctatggttttcagctccattaggtcatttaaggtcttctctacactgtttgttctagttagccatccgactaaccttttttcaagatttttagcttccttgagatggattggaacatgcttcttagcttggagaagtttgttattactgaccttctgaagcctaattctgtgaactcatgaaagtcattctccatccagctttgttccattgccggtgaggagctgtgatcctttggaggagaagaggctctctggtttttagaattttcagtttttctgctctggtttctccccatctttgtggttttcatctacctttggtatttgatgttggtgacctacagatggagttttggtgtagatgtcctttttgttgatgttgatgctatttctttctgtttgttagttttccttctaccagtgaggtccctcagctgcaggtctgttggagtttgctggaggtccactccagaccctgtttgcctgggtatcaccagcggaggctgcagaatagcaaatattgctgcctgatcctttctctggaagcttcatcccagaggggcatctgcctatatgaggtgtctgttggcccttactgggaggtgtctcacatttaggctacacgggggtcagggacccacttgaggaggcagtctgtccattctccgagctcaaacactgtgctgggagaaccactgctctcttcagagctgtcagacagggacttttaagtgtgcagaagtttctgctgccttttgttcagctctgccctgtccacagaggtggagtctatagaggcagtgggccttgctgagctgcggtgggctccgaccagcttgagcttcccagccgctttgtttacctactcaagcctcagcaatggcagatgcccctcccccagccaggctgcagccttgcagttagaactcaaactgatgcgctagcagtgagcaaggctccatgggcggggaccctccaagccaggcacgagagggaatttcctggtctgccggttgtgaagactgtgggaaaggcacagtatttgggcaggagtgtactgttcctccaggtacagactgtcacagcttcccttggctaggaaagggaagtcctcagaccccctgtgcttcccccatgagtcaacgctccaccctgctttggttcaccctccatgggctacacccactgtccaaccagtcccaatgagatgaaccatgtacctcagctggaaatgcagaaatcacccatcttctgcgtcgatcacgctgggcgctgcagagcagagctcttcctatttggccatctttgaatggaaaacctggcattccttattttataaatgtttttcttgtcttgtcttttttttgtgtgtgcgtgatggagtcttgctctgtcacccaggctggagtgcagtggaaggatcttggcttactgcaacctttgcctcccaggttcaagcgattctcctgtctcagcctcccaagtagctgggattacaggcatgtgtagccatgcctggctagtttttgtatttttagtagagacaagctttcatcatgttggccaggctggttgctggtctcaaactcctgacctcaggcaatctgcacacctcggcctcccaaggtgctgggattacaggcatgagccactgtgcctggccaaatgtttttaatatatgttttataattagttttttaaaaaatattttagaaattcagcagtgaacccatcaggtccttggcttttctttgaatgaagacattttattactggatttaatttttaatcattatttgttcagattttctgattcaatcttgatatgttgtatatatctaggaatttatccatttcttctaggttatctagtttgttgatgtataattgtaattgttcatagcagtctcttatgattctttattcttgatatcagttgtaacatctcctctctcatttctgattttatttgattactctctatatcttggttttgctaaatgcttgacaattttatccttttagaaaaccaacttttagtttcgttgatctattgtatttttttggcctctattttattcatttctgctctgatctttattttttttctgcctgttaactttgggctttgttcttattctagttcctcgaggagcaacgttgtttatttgagatatttcttttttgatgtaggcatttattgctgtaaactttcttttttttttttttttttgagacggggtctcactctgttgccaaggctggagtgcagtggcatgatctcagctcactgcaaccttcacctactgggttcaagcaattctcctccctcagcctcccgagtagctgggattacaggcacccacgaccactcttggctaatttttgtatttttaatagggacggggtttcaccatcttggccaggctggtctagaactcctgacctcatgatccacccacctcggcctcccaaagtgctgggattacaggcgtgagccaccatgcccagcttcctattagttttggtatggattgtttttattttcatttgtctgaaggtacttaaaatttttttttaatttttaaaatgtgtacatacatatatatatgtttgtagtgacaggttcttgccatgttgcctagactaatctcaagaaagcttcctgcctgggcctcctgaaatgatgagattgcaggcatgagccacctctagatgcttttaaatttcccttttaagttattcattgacctgctgattgttcatgagcatggtgtttaatttccatgtatttgtgatttttccaaaattcttcctgttattgatttctagtttcataccattttggtcagaaaggatacttgatatgattttagttttttttaaatttcaaaattttaaaagctcaaggatcgcttgagcccaggagtttgagaccagcctaggcatcgtagcaagaccttgtctctaccagaaaaacaaacaaacaaacaaaaaacaaaaacaaacaaacaaacaaacaaaacatagcctggtgtggtagcctgcatctgtagttccagctccttgggaggctgagatgggagggttgcttgcatctgggaggttgaggctacagtgagctatgatagtgtcagtgtactccagcttgggtaacagagtgaggccctgttttttgttgttgttgttgttgtttgtttgttttaaagccccactttctaatactatcatctttgtggttaggatttcaacataggaattgtgggggaacacaaacattcagaccattagtacttactgattttctttttcatagatctattctgttttcaaagtggggtactgaagtctcctactattgttgtattgctgtttatttctcccttcagtcatgttgatacttggtttatattttaggtgatcttaagtagatatatatttacaactgttatatcctcttgatgaattgactcctttatcattatataatgcccttctttgtctctggtgacagtttttgacataaattctatttttttctgatataagtatacccaaccctgctctcttttggttgctatttgcatggaatgtattttttccatcccttcactttcagcctatgtgtgtccttaaagctaaagtgagtatcttgtaggaaggaaatagatttgttgttttatccattcagccagtttgtgtcttttggttggagaaattaatccattacagttaaattaattattgataagtaaggacttaactattgtcattttattagttgtttcctgaatgttttatagtttctttgctcttcccttcttgctgtcttcctttgtgacttgattttttttttatagtggtatggtttgatcccttcttctttattttgtgtgtatcagctataatattttgcctgtggttgccatgacagttatgtaagacatcttataccagtttatttatttatttattatttataattgctgttattttttgagatggagttttgctcttggtgcccaggctggagtgcaatgatgtgatatcggctcaccgcaacgtctgcctcctgggttcaagtaattctcctgcctcagcctcccgagtagctgggattacaggcttgcgccaccacgcccagctaattttgtatttttagtagagacgggggtttctccatgttggtcaggctggtctcgaactcctgacctcaggtgatctgcctgcctcggcctcccaaagtgctgggattacaggcgtgagccactgcgcctggccaccagtttattttaagctgataaaaacttaattatgatcacataaaaagctccacattttattccttcccctctacattttgttttttgatgtcacagtttacatcatattttgtattaatgaacaagttaatgtaactgtagttactttaaatacttttttctttgaattttaaacaaattgaacataagctgggcatggtggctcctggctgtaatcccagcactttgggagactgaggtaggtagaatgcctcagcccaggagttcaagaccagcctgggcaacatggcaaaacctcctctctacaaaaaaaaaaataataataataataaataaataaaagaatataacactttacatatgtatggggtccatgtaactgtttgttacgtatgtagaatgtgtaatgataaagtcggggtatttggggtatccatcaccttgagtatttatcatttctatatgttggaaacatttcaagtcttctcttctagctatctgaaattgttgcctgactctgctattgaacattagaacttattccttccaactatatatttgtaaccattaaccaacctccccttttctcccctctcccacccacacacctttcctagattctggtattatcattctattttctacctccatgagatccacatttttagctcccacttctgagtgagaacatatgatatttgtctttctatgcctggcttcacttaacataatgacctccagttccatccatgttattgcaaatgactgtatctcattcttcttctttttttttttttttccaagacagggtctcacgctggttgcccaggctggagtacagtgatgcagtcttggctcactgtggcctcaactttccgggctcagatgattctcccatctcagcctcccgagtagctgggaccacaggcgtgcaccaccacgcctggctaaatttttctatttttagtagagacagggtttcacaatgttgcccaggttggtctcgaactcctggactcaaacaatccacccacctcggccccccaaagtgctgggattacaggcatggatcttattctttttatggctgaatagtactctgttgtgtatatgtaccacattttcttcatccattcatctgttgatggacacttaggttgattacatattttttctattgtgaatagtgctgcaacaaacatgcaagtttaagtatccctttgatatactaatttcctttccttcagataaatacccagtagtgggattgctatatcatatatagttctattataagtttgttttttttttttctgagaaatctccacgctcttctccatagtgcttgtactaatttacattctcatcaacagtgcataagaattcccttttctctgcatccttgccaccatccattaacttttgtctttttaataataggcattctgactgggtggggtaagatgatattgcattgtggttttgatttgcatttccctcatgattagtgatattgaaaatttgttcatatacttgtttggccatttgtatgcctttttttttttgagacggagtctcgctctgtcacccaggttgcagtgcagtggcgtgatctcggctcactgcaaccttcacctcctgggttcaggcgattctcctgcctcagcctcctgagtagctgggatcacaggcgtgcatcaccacacccagctaatttttgtatttttagtagagatggggtttcaccgtgctgggcaggctggtctcaaactcctcgattacaggagtgagccaccgcacccagccttgtatgtcttcttttgaataatgtctgttcatgtcctttacctcactttttaatgagattttttttaattgttgaggtgtttgaatatgttgtatattccagatattagtcccttgtagaatgaatagtttgcaaatatttttgtcctattcaacaggttgtctctttaatttgttattgtttcttttgctgtgtagaagccttttaatttaatatggtaccatttgtctattcgtgtttttgttgtctttttgaggttgtagccatatcatctttgcctagaccaatgtcctgaagcattttccctatgttttcttctagtagttttatagttttaggtcttacatttaagtctttaatctatcttgggttgatttttgtatatggtgagagacaggggttcaatttttttctcctgcatatggatatctaattttcctagcaccatttattgaagagaccaatttatgttcttgattgctttgtcaaaaattagttggctgtaaatatgtggagttatttctggattatctgttttgttccattggtctatgtgttgtttttataccaatatcatgttgttttggttaatacaggtttgtaatatattttgagtcaggtaatatgatgctgccagctttgtttgttgttgttgttgttgtttttgctcaggattgctttggctattcaagttcttttttaggattattttttctaattctgtgaaaaatgacattggtattttgatagggattgcattaaatctgattactttggacagtttggtcactttaataatatacactcttctgacccatgaacatgggatatcttttttttaaatgtttcctttaaactctttcaccagtgctttttagttctacttgtagagaactttcacctccttgattaaatttattactaggcattttttgtagctgttttaaatggggtatttttcttgatttctttctcagctagttcattaatgttgtatagaaatgctgctgatttttgtatgttgattttgtattctgcaagtttaccaaagttatttattagatctaggagttttttatggagtcttgaggtttttctagacataagatcatatcatcagcaaggacttcctcttttccagttcggatgccttttatttttttcttttgcctgattgctctggctacaacttccagtactattttgaataggagtggtgatagtggacgttcttgttttgttccagttgttggaagaaaagcttccagttttttttttttttttatgatgttagctgtgggtttgtcaaatatggcctttatcacattgaggtacatttattctttgtagtttgtgcttcactcccacccgagccctggtgctgctgggccccaggacagtgcgcagtctgttgtgggctgggctttcaaaatgatatcttgctgtatctgctcctgatttaggagtgtgggacccagccaagttccctgtctggaacagtgctgttgtgtggtttctaggcagctctctatgttattttcagggcctacaagggtctaggggcgttcctgtggctaggattgcaagagtccacaatggggatgtggtccatttggggtctctcactctttctctgcattggggagtctctctctcagctcgcagccaatcttggccaagcaagctgcctcacctccgtctccttttttgctttaggtttttcctgtaacttctctgttgaatttcagtgttctctcttggatgatctattgaagtattattatgtactattttggttcttattagtggaggaggtgagtatgagatgcctttagttagccatcttgaagctccttatcttttaactttcatagtatagttaaaagtgatttatgtaccaccattacaatattagaatattgtgagtttgagtatattcttacctttatggtgagttttatacatttatatgttttcatattgtttgttagcatccttttcttttattaataacttgaggaactctcttcatcattttttgtgggacagtggtgatgaactcccacagctttttgtttgtctgggaaataatttcttctttatttttgaaacatagctttactgactatattacaatattcttctaggcagttttttttctttcagcatgtagaatgtatcattcccaaccccttttggcctgcaaggtttctgccgagaaatctggtgatagtcttatggatagtcttatggagattgccttttatataagtcacttttctcttattactttcatgattctccctttttttttgacttttattaatttggttatattatgtcttagtgaagatctctttacattaaatttatttggctttctttgggcttcatggtctggatgttctctttgttgtccagattgcggaagttttctgtcattcccttatttaactaagctgtctgaccctttctctttctatatcctttttatgaatcctcctgggattcctatagtgttttttttgttgttgttgttgcttgtttgttttcctttatggagtcccataaattccataggctttcttcactctttttcattctttttttgtccctctgattgggtaatttcaaatggcctgtctttgagtttgctgattattctgcttcagagagtcttctgttgaagctctctgtatggccgtttttagtttcatcattgtattgtcctgctccaaaatttctgtttcattcttttttatgtttcttgtttttgaacctcttcttattttgcttatatattttctggttttgtttagttgtctgtgttcgcttgtaattaactgagctcctttaaggtgattattttgaattctttttcaggcagtttatagatactcatttctttagaattggtgactggtgctttaatttattcctttggtggtgtcgtttccttgattattatttaaaaagaatttttttaaacaaggtctcactctgtcaccaggctgcagtgcagtgttgtgatcacgactcactgcagcctcaacctcctaggcccaaagaatcttcccacctcagcctcccatatctgctgggaccacaggtgtgcgtcaccatgcctgactaatttttaaatttttgtatagatggggcctccctaagttgcccaggctggtcttgaattcctgaactaaagtgatcctcccaccacagcctcccaaagtgctgggattataggtatgagccaccacacctggccttgattattttttatctttgtggccttgagttggtatctgcacatttaaacaaataggcacactttttcaatatttacagacttgcttcagcagggaaagccctttaccagtctgcctgtctagtgattctgggtgggtcatctcatgaagaccatgggcaaattttctgctggagttctcaggtatgctgacctagtgcctgtgtctgcatggccagcctggaatctgggtttgtgtggtccatcctggcactgaggcaggccatgaacttgggtaagaggccagcataaagcttcgtgccatgaggactgatctagcactgaggctaatgtggtcagtctcctgttgggataagcctagagcctggggctatgggggtgggtccataactgggacacgcctggaggctgggttcatgaggcaagcctggagctttgggcaataggagctaacttggcgctggggcaggcttgaagtctgggtccatagtggtgggcctaagacctcctattttctagttatggtaaattaaatgtagggaacagtcaaaatggaagagttccagacatagatacagtaaaaatatagtttaaaacttctttgcttattaaaaaagttatttgtggttgtcataaaatcttaagcatcacaaaaatatgtattatggattgtaaagtgagcatctattccatactcaaaaacagaatcattgaaatggatttggaagatttaaggagttttttttaagtttttttcaaaatagattgcatttaaaaaagattaatggaatgaagtaaagccaaagagtatacacaggaaaatttgtaattggtgatctcctgttatattagagacaatgagataaattggtaaaataacagaagacatttgaattggacaacatccaagagagttggataaaaccctgaagatgttctgtaaaaaataatataacattgaccataataaatgagatttaatgacattacttctttgacttataggttagagactaggtccttatgcttataaattcttgaagaagagagttctttgtaggttaacaaaaatgagagtatttctcaatgcagagaaagggagctctgtgctgcttttctcccaatagggatacaaccagatcatagttttttcagcatccttcttttatggttacagtttatattatctttttttaaacaaacacgtaaatttattgctgctagattttggggatgttagtaaacgattgtgtaggcagtatgttaggggaggagtaaatttttgagatccttttccagcaccatttaaaattatctatatactaatctgaaacctgtctctgttggtaagtaatgtgagttgctttctattggtcaggaatagttttttttcttgacggaatatctctgagtttggagggaagtgtgtctcttttctgcctgtataaaacttattgtatacctctttgagttaaaagaaaaacccagcaaaaaatatactgttgctttctaaattcatagtgcttaggtttggtaaacctagattacgtaatttctttttttttattttaaatttgtatttgtacataacaggtatacatcttttcagggaacatgtgataatttaatatatttatatactttgtaaaacatcaaatcaatgtaattgggatatatatccatgaacttaaatatttgtcttttttttcttttattattatactttaagttttagggtacatgtgcacattgtgcaggttagttacatatgtatacatgtgccatgctggtgcgctgcacccactaactcatcatctagcattaggtatatctcccaatgctatccctcccctctcccagattatgtaatttctatactgcatttaaaagaactattatatttaccctaaggatagtatttaaataggggatatgtttatttattattgttttgcctttactatatttaggtaggaatatatatcaccagaggtcttatattgagaaataaaggaaataacaaagaaattataaatgtatttacgtgcacaaatattgatgttccatcccacaaggccaaaggacgtttgtaccagttttaatgtacttaatgttcattcctttattttcccttctcttctcagcctgaggccctgagaatctgacattattaggcaatgtgatctaagggaaggtctcagagctggcagaaaatttgttaatgataaactgtgaccttgaatcactcagttaactactatgtaccacaatatcctcacctgaaaaataggtgcaatattatgtgtgtcacaggcatggaatgaggataacagaagaaatatagtagttctttgaaaagctaagggtttacatatacggtgataaaattattaactaaaaatcagcctatacaaggcttatttttaatggaaaggtaggtattagcaccatctagtggaaacataatgaattgtataatagcattttcaatacggaaaataatttaatatagataactctttagagctggaagaaatcttacagatcacctatttagtaatttagagattatgttctgtggtgtccttatattctaccagaagagcctcaggacctcctttaagagaaagaagagtcttttccacaattctcagattctcatgttgcttcaaatagagaagttaggctttaatcagttttttatatatgtccttgtaagattttgtttgaaaaaatgattcaccttcttagaaaatgtttgaaaatgactgatttagattaactcatctttgtacagataaggaaatctaaatttagggagcttgagacttgtttgagggcacatagttggaacaatagatctctagtcttttaggaatagtttttctctaaaggtcagtagtgatgtcctttcttttattcttgattgtagtaatttgagccttctctcttcttttcttggtcagtgttgctaaaggtgtccattttttgatatattgaaagcataaacttttgagtttgttgatttttctctattgttttttagtgatcaatttcatttatttccattgtaatctataatttcccccctctgtgcttgatttatgcttagtttgctcttccttttcccttttcctaaggtgaaaggttagcatattgatttgagatcttttaaaaattactgatgtttatagctatacattttcctttaactgttgctttagttgtacctcctaagttttggtgtgtgcattttcctttttgttcatctcaaggtattttctaattccccttgtaatttattctttgacccatttggttatgtagacgtgtgttgttagattttcacacttggtaatttcctcatttcttttttgttcttgatttctaatttaattcaatgtagacaaggaactgttaaatctactatggccttttatggcctaggatatgttctattctgaagaatgttctatgtgcaattaagaatttatagtctgctattattgggtggattgttgatatggtttggctctgtgtctccacccaactctcatctcgaattgtaatccccacatgtcaagagagagacctggtgggaggtgattggatcatggggctggtttcctccatgctgttctcatgatagtgagttctcatgagatctgatggttttatcaggggctcttccccctttgccctctctctcttgcctgctgccatgtaacatgtacctgcttctatttctgccatgactgtatgtttcccgaggcctccccagtcatgtggaactgtgagtcaattaaacctcttttctttataaattaccctgtcttagacagttctttatggcagtgtgaaaatggactaattcaagtgcgctaccgatgtctattaggtctagtagatttatagtgttcttcaagtcttatatatactttttgatgttctgtctagttgttccatctattattattaattattttggctagatattttatttatttttaatttttgtgggtacatattaggtatacatatttatgggatacatgagatgcttcaatacaggcatgcaatgtgaaataatcacatcatggaaaatgggctatctatgccttcgagcatttatcctttgtgttacaaacaatccaattatactattttagttattttaaaatgttcagttgagttcttcttgactatactctccctgttgcgctatcaaatagtaggttttattccttcttttaaactattttttataaccattaatcatcctcacctcccctcaccaaaccacccccaaaccctttccagcctctggtaaccatccttctactctctgtgtccatgtgttcaattgctttgatttttaggtcccacaaataagtgagaacatgtgatgtttgtctttccgtgcctggcttatttcacttaacataatgatctccagattcatttatgttgttgcaaatgacagaatctcactcttttttatggctaaataagactccactgtataaatgtaccacatttctttatccattcatctatccgtggatacttaggttgtttccaaatcttggctattgtgaacagtgctgcaacaaacataggagtgcagatatctcttcaatatactgatttcctttcttctgggtatataaccagcagtggggttgctggatcatatggtagctcaatttttagttttttgaggaaactccaaactgttctccatagtggttgtactaatttacatccctgccaacattgtgcaagggttcccttttctccaccccttttctccacaccctcaccagcatttgttattgcctgtcttttggatataagccattttaactgagtggagatgatatctcattgtagttttgatttgcattgttctgatgatcaatgacgttgagcatctttcatgtgtctgcctgccatttgtgtgtcttctgtgagaaatgtctaaatcgtttcctcattttttgattggatcatcagattttcccctgtagagttatttaagcttcttatatattctgctcattaaccccttattagatgggtaatttgcacacattttcttcagttctgtgggtcgtctcttcattttgtttattgcttcctttgctgtgcagaagattttaaacttgatgtgatcccagttgtccatttttgcttttgtgtcagtgcttgtggggtattacttaagaaatctttgcccagactgatgttatagagattttctccaatgttttcttgtagtagtttcatagtttgaggagttagatttaagtctttaatctatttttatttgatttttgtatatgatgagagataggggtctagtttcattcttctgcatattggattccccagcaccatttcttcaagactctttcttttctccagtgtatgtgcttgacactcaaaatgagttcactgttaggtgtgtggatttgtttctgggatctctattctgttccattggtctatgtgtctgttttcatgccagtaccatgctattttggttactatagctctttagtataattggtagtcaggtagtgtgattcctccagatttgttcttttcgcttaggatagctttgactattctgggtgttttgtggttccatatacatttcaggattttttttttctatttctatgaagaatgtcattggtattttgatagggattgcagcaaatctgtagattgctttgggtagtatggacatgttaacagtattggttcttccaattcattaacatgtaatatctttccactttttggtgtcctctttaatttctttctttctttctttttctgagatggagcttctttcttttttttttctttttttgagacagagtcttgctctgtcacccaggctggagtgtagtggcgcaatctcagctcactgcaacttctaccacctgggttcaagtgattcttctgccacagcctcccaagtagctgagattacaggcacgcaccaccatgcccagctaagttttatatttttagtagagccagggtttcaccatgttggccaggttgttctggaactcctgacttcaagtgatctgccttcctcagcctcccaaagtgctgggattacaggtgtgagacaccatgcccggtcctcttcaatttatttcatcagtgttttatagttgtcattatagggatctttcacttctttggttaattcatagatgtttaattttatttgtggctattgtaaataggattacttcttttatatctttttcacattgttcactcttggcttatagaaatgctactgatttttatatgttgattttgtatcctgcaactttactgaacttttaaatcagttttaatagtttttggtgtagtctttaggtttttccaaatgtgacattatatcttctgcaagcaaagataatttgacttctttttttccaaagtggatgttcgtcatttcttcttttctgattgctttagctaagacttccagtagtatgttgaataatagtgatgacagtgggcatccttgttgtgttccagatcttagaggaaaggctttcagttcttccccattccttatgatactagctgtgggtctgttatatatggcttttattatgttaagttatgttccttgtatccccagtttttttgagggtttatatcatgaagggatgttggattttctcaaatgctttttcagcatcaattgaaatgatcatatggtttttatccttcattctgttgatatgatgtatcacattgattgatttgtatatgttgaacgatgtttgcatcccaagggtggatcacacttggtcatgatgatctttttaatatattgggcttgttgttgttgttgttttgagacaaagtcttgctctgtcacccaggctggagtgctggagtgcagtggcatgatctccattcactgcaacctctgcttcctgagttcaagtgattctcgtgcctcagccacccgagtagctgggattacaggcttgtgccaccacgcccagctaatttctgtggttttagtagagatggggtttcaccatgttggccaggctagtctcgaactcctggccttaagtgattcgcctgcctcggcctcccaaactgctgggattacaggtgtgagccaccgcactcggccatatattgctgaatttgatttgctaatattttgtcgaggatttttgcatcaatattcatcagatatattggcctgtagttttctttttttgatgcatctttatctggttggtatcagggtaatactggcctcgtagaatgagtttggatatattccctcctcctctatttttcagaacagtttgagtaggattagtattagttctttaaatattttatagaattcagcagtaaagtcattgggtccccagcttttctttactgggagactttttattatagctttgatctcattacttgttgttggtgtgttcaggttttggatttctttatgcttcaaacttggtaggttgtttgcttctagaaattttttcatttctttaaatttttcaattaattggcatatagctgttcatagtggccactaattatcctttgaatttttgtggtatcagttgtgtctcctctttgatctgtgattttaatatttgtatcttctgtatttttttcttagatagtctggctaaagttttgtcaattttgtttaacttttcaaaaaaccgcatttttgtttcattgaacttatgtgttattttctttatttcaattttatttatttctgctctgacctgtattatttcttttcttctgctaattttgggtttggtttgttcttgcttttctagtccttaaaggtgtattgttaggttgtttatttgaaaattttcttcttttttgatgtagggagttatagctataaacttccctcttagcatttcttttgctgtattccatacattttggtatgtgatgtttccattatttgtttccagaaaattttcagctttcttcttaatttcttcattgacccacggtcactcaggagcatattgtttaattttcatgtatttgtatagtttccaaaattcttgttgttgttggtttctaattttattccattgtggtcagagatgcttggtattattttgaatttttgcgtgtttacaacttgttttgtgacctaacatttggtctgtctttgagaatgatccatgtgctgaggaaaagaatgtgtattctgcagctgttggatgaaatgttctgtaaatatccattagatccatatgttctatagtgcaaattaagtctgatgcttctttttgattttctgtctggaagatctgtccaatgccgaaagtggggtgttgacatctacagctattattgtatgaagtctatgtttctctttatctctgataatatttgctttatatatctgggtgctccagtgttgggtgcatatatatttaaaattgttatatcctcttgtggaattgttccctttatcgttatatagtgaccttctttgtctcttcttatagtttttgtcttgacacctattttgtgtgatataaatatcagcactcctgctcttttttggtgtccattggcatgagatatttctgccacccaccactataactattttttttaattttttattttatttcaatagttttttttttcgaacaggtagtttttggttacatgagcaagttctttagtgttttttctgagattttggcatacccgacacctaagcagtgtacactgtacccaatatgtaattttttatccctaagcccccttccatcttcctccatctgagtccccaaagtccatcatatcattcttatgtttttgcatcctcatagtttaactcccacttataagtgagaagatacgagacttggttttccattcctgagtcacttcacttagaataatggcctccaagtccatccaagttgctgcaaaggccattattttgttctgttttatggctgggtagtattctatggtgtatatacattttctttatccactcattggttgatggtcatttaggttggctccatattttttgctattgtgaattgtgctgctataaaaatgtgtatgtgttttttcgtatgatttattttcctttgggtatatacccagtagtgggattgctggatcgaatggtagttctaattttagatttttgttttgctttgttttttgttttgagacaaggtctggctctgtcttccaggctggagtgcagtggtacgatcttggctcactgcaacctgtgcctcccaggctcaagccatcctcccacctcagcctcctgagttgctgggagtacaggcacacaccaccacacttggctaatttttgtattttttgtagagatgggatttttccatgttgctcaggctggtctcggactcctgagctcaagtgatctgccccctcagcctcccaaagtgctgggattacaggcatgagccatcatgcctggccctcattttaattctttaaggcagcagtccccaacctttttggcaccagggaccagtttcgtggaagacagtttttccatggagcggcggtgggggatcgggggtggggaatggtttctggatgaaactctttcatctcagatcattaagtattagatccttataaggagtgtgcagcctagatcccttgcatgcgcagttcacaatagggttcgtgctcctatgataatctaatgctgctgctgatctgccagaaggtggagctcaggcaggaatgctcacttgccccgccactcatctcctgctgtgcagcccggttcctgctttaggagcttcgaccccctgcttttaaacgtttttttcctgtttatatcttattgtactgtctgtgtcttgaaaagttgttgtagttattatttttgattggttcgttatttagtctttctacttaagataaaagtagtttgcacaccacagttacagtgtcataatattctgtgtttttctgtgtacttatattaccagtgagttttgtatcttcaagtgattacttactgctcacgaacatccttttctttctgattgaagtactctcttcagcatttcttgcaggacaggtctggtgttcatgaaattcctcagcttttgtttgtctgggaaagttttcatttctccttcatgtttaaaggatatttttgctggatatactattttaggataaaagttcttttccttcaacagtttaaatacatcatgctactgtctcctggcctgtaaggtttccattgaaaagtctgcttgatgtattggagctccattgtatgttgtttttttcttttctcttactgcttttaagatcctttctttatcattgggctttaggagtttgatttttaaatacttgaggtagcgttctttgggttaaatctggtgttctataactgctttgtatttggatattgatatctccttctaggtttgggaagttctctattattatccctttgaataaactttctttctttttttattatgctttaagttctaagggtacatgtgaacaacatgcaggtttgttacataggtatacatatgccatgttggtttgctgcacccatcaactagtcatttacattaggtatttctcttaatgctattgtgtgatgttccccaccctgtgtccatgtgttctcattgatcaactcccacttatgagtgagaacatgcggtgtttggttttctgtccttgtgatagtttgctgagaatgatggtatccagcttcatccatgtccctacaaaggacatgaactcatccttttttatggctgcatagtgttccatggtgtatatgtgccacattttcttaatccagtctatcattgatggacatttgggttggttccaagtctttgctattgtaaatggtgccacaataaacatatgtgtgcatgtgtctttatagtagcgtgatttataatcctttgggtatatacccactaatgggatggctgggtcaaatggtatttctagttctagatccttgaggaatcgccacactgtcttccacaatggttgaactagtttacactcctagtaacagtgtaaaagcgttcctatttctccatatcctctccagcatctgttgtttcctgaccttttagtgatcaccattctaactggtgtgagatggcatctcattgtggtttcgatttgcatttctctgatggccagtgatgatgagcatgttttcatatgtctgttcgctgcataaatgttttcttttgagaagtgtctgttcatatcctttgcctactttttcatggggttgttgctgtttttcttgtaaatttgtttaagttctttgtagattctggacattagccctttgtcagatgggtagattgcaaaaattttctcccattctgtaggctgcctgttcactctgatgatagtatcttctgccgtgcagaagctctttagttcaattagatcccatttgtcaatttttgcttttgttgccattgcttttggtgttttagtcatgaagtctttgcgcatgcctatgtcctgaatggtattgcctaggttttcttctagggtttttatggttttaggtcttacgtttaagtctttaatccatcttgagttaatttttctataagctataaggaagggatccagtttcagctttctacatatggctagccagttttcccagcaccaattattaaatagggaatcctttccccattgcttgtttttgtcaggtttgtcaaagatcagatggttgtagatgtgtggtgtctgaagcctctgttctgttccattggtctatatctctgttttggtaccagtatcatgctgttttggttattgtggccttgtaatatagtttgaagtcaggtagcatgatgcctgcagctttgttctttttgcttaggattgtcttggtaatgtgggctcttttttggttccatataaactttaaagtagttttttccaattctgtgaagaaagtcattggtagcttgatggggatggcattgaatctataaattaccttggcagtatggctattttcatgatattgattattcctatccatgagcatggaatgttcttccatttgtttgtgtcctcttttatttccttgagcagtggtttgtagttctccttgaagaggtccttcacatcccttgttagttggattcttaggtattttattctctttgtagtaattgtgaatgggagttcactcatgatttggctctctgtttgtctgtacttggtgtataagaatgcttgtgatttttgcacattgattttatatcctgagacttggctgaagttgtttatcagtttaaggagatttagggctgagaggatggggttttctaaatatacaatcatgtcatctgcaaacagcgacaatttgacttcctcttttcctaattgaatactctttatttctttctcttgcctgattgtcctggccagaacttccaacattatgttgaataggagtggtgagagagggcatccttgtcttgtgccggttttcaaagggaatgcttccagtttttgcccattcaatatgatattggctgtgggttcgtcataaatagctcttattattttgagatatgttccatcaatacctagtttattgagaatttttagcatgaagggctgttgaattttgtcaaaggccttttctgcatttattgagataatcatatggtttttgttgttggttctgtttatgtgatggattacatttattgatttgcatgaaccagccttgcatcccaggggtgaagctgacttggtcctgattgataagctttttgatgtgctgctggatttggtttgccagtattttattgaggattttcgcatcgatgttcagcagggctattggtctaaaattctgtttttttgttgtgtccctgccaggctttggtgtcagtatgatgttggcctcataaaatgagttagggaggagtccctctttttctattgattggaatagtttcagagggaatggtaccagctcctctttgtacctctgatagaatttggctgtgagtccgtctggtcctggactttttttggttggtaggctatattaattattgcctcaattttggaacctgttattggtctattcagaaattcaacttcttcctggtttagtcttgggagggtttatgtgtccaggaatttatcatttcttctagattttctagtatatttgtgtagaggtgtttatagtattctctgatggtagtttgtatttctgtgggatcagtggtgatgtcccctttatcattttttattgtgtctatttgattcttctttcttttcttctttattagtcttgctagcagtctatctattttgttgattttcaagaaaccagctcctggattcattgattttttgaagggttttttgtgtctctgtttccttcagttctgctctgatcttagttatttcttgccttctgctagcttttgaatttgtttgcacttgcttctctagttctttcaattgtgatgttagggtgtcaattttagatctttcttgctttttcttgtgggcatttagtgctataaatttccctcttcacactgctttaaatgtgtcccagagattctggtgtattgtgtctttgtcttattggtttcaaagaacatctttatttctgccttcattttgttatttacccagtagtcattcaggagcaggttgttcagtttccatgtagttgtgtgttttgagtgagtttcttcatcctgagttctaatttgattgcactgtggtctgagagactgttgtgatttcttttcttttgtgtttgctgaagagtgttgtacttccaatgatgtggtcaattttagaataagtgcgatgtggtgctgagaagaatgtatattctgttgatttggggtggagagttctgtagatgtccattaggcctgtttggtccagagctgagttcaagtcccgaatatccttgttaactttctgtcatgttgatctgtctaatattgacagtgggttgttaaagtctcccattattattgtgtgggagtctaagtctctttgtaggtctctaaggacttgctttatgaatctgggtgctgctgtattgggtgcatatatatttaggatagttagctcttcttgttgaactgatccttttaccattatgtaatggccttatttgtctcttttgatctttgttggtttgaagtgtgttttatcagagactaggattgcaacccctgcttttttttctgctttccatttgcttggtaaatcttcctccatccctttattttgagcctatgtttgtctcagcacgtgagatgggtctcctgaatacagcacaatgatgggtcttgactctttatccaatttgccagtctgtgtcttttaattggggtattcagctcatttacatttaaggttcatattgttatgagtgaatttgatcctgtcattatgatgttagctggttattttgcctgttaattgatgcagttttttcctagcatagacggtctttacaatttggcatgtttttgcagtggctggtaccggttgttcctttccatgtttagtgcttccttcaggagctcttataagacaggcctggtggtgacaaaatgtctcagcatttacttgtctgtaaaagattttatttctccttcacttatgaagcttagtttggctggatatgaaattctgggttgaaaattcttctctttaaaaatgtttaatattggctgtcactgtcttctggcttgtagggtttgtgctgagagatccgctattagtctgatgggcttccctttgtgggtaacctgacctttctttctggctgcccttaatgtttttttccttcatttcaaccttggtgaatctgacaattgtgtgtcttggggttgctcttctcaacgagtatctttgtggtattctctgtatttcctgaatttgaatgttgacctgccttgctaggttggggaaggtctcctggataatatcctgaagagtgttttctaacttggatccattctccccgtcagtttcaggaacaccagtcaaacgtagatttggtcttttcacatagtcccatatttcttggagaatttgtccgtttcttttcactcttttctctctaactttgttttctcactttatttcattaatttgatcttcaatcactgttatcgttccttccacttgattgaatcagctatcaaagcttgtgcatgtgtaatgaagttttcgtgctgtggttttcagctccatcagctaatttaaggtcttctctacactgtttattctggttagccagttgtctaaccttttttcaaggcttttagcttccttgcgatgggttagaacatgctcctttagcttggagaaatttgttattaccaaccttctgaagcctacttctgtcaacttgtcaaactctttctccatccagttttgttcctttgctggtgagaagctccaatcctttggaggagaagaggcactctggtttttggaattttcagcttttctgctctggtttctccccatctttgtggttttatctacctttggtctttgatgttggtgacctacagatggggttttggcgtagatgtcctttttgttgatgttggtgctattcctttctgttagttttccttctaacagtcgagcccctcagctgcaggtctgttggagtttgctggaggtccactccagaccctgtttgcctgggatcaccagtggaggctgcagaatagcaaatattgctgcttgatccttcctctggaagctttgtcccagaggggcacccacctgtatgaggtgtctgttagcccctactgggaggtgtctcccagtcaggctacacagggatctgggacccacttgaggaggcagtctgcccgttctctgaacctgaacaccatgctgggagaaccactgctctcttcagagctgtcagacagggacgtttaggtctgccaaagctatctgctgccttttgttctgctatgccctgcccacaaaggtggaatctacagcaaggcagtaggccttgctgagctgcagtgggctccgcccagttcgagcttcctggcctctttgttttcacggtgagcacaaaaccgcctactcaagcctcagcaatggcaacacccctccccccgccaagctgctgagccgcaggttgatcttagatgctgcgctagcagtgagcaaggctccttgggcatgggacccgccgagccaagcacgggagggaacttcctggtctgccggttgtgaagactgtaggaaaagcacagtatttgggcaggagtataccattcctccaggtacagactgtcatggcttcccttggctaggaaaggaaagtccccagaccccttgtgcttcccggttgaggcgatgcactgccctgctttggttcgccctccgtgggctgcatccactgtccaaccagtctcaatgagataaaccaggtacctcagttggaaatgcagaaatcactcatcttctgcatcaatcttgctgggagctgcagactggagctgtttttactcagccatcttggaagcctccccactttgaataaactttctaatcttatctctttctctgcttcttctttaaggccaatgatacttagatttgcccttttgaggctattttctagatcttgtaggtctgcttcattgttttttattcttttctcttttgtctcctctgaccgtatattttcaaatagcccgtcttcaagctcactaattctttcttctacttgatcaattctgctatttaaagattctgatgcagtcttgttcattatgccaattgcagtttacaactccagaatttctgcacagctccagaatttctgctttattcttttaatttcaaataaatttgtctgttaaaacttaacaaaaacttgttaagtttatctgataggattctgaatcccttctctgtgttatcttgaatttcttcgagtttcctcaaaacagctattttcaattccctgtctgaaaggtcacatgtctctgtttctccaggattggtttctggtgcattttacttgatgtggccatgtattcccggattgtcttgatacttgtagatgttcttcagtgtctgggcattttagtgttaggtatttattttagacttcacagtcttggcttgtttgtatccacccttcttgggaaggctttccccatgttcagaaggacttgagtgttgtgatctgagctatatctgttttagggggcatcccaagcccactaatgctctggttcttgtagacatatagaggtactaccttgatggtcttgggcaaaatctgggagaattctctggattaccaagcagaggctcttgttttcttcccttactttctcctaaacagagtctctctctctctctctctttctctctttctctctttctctctctctctctctcctgagctacctgaaacttggggtttagtgacacaagcactaccactttgactgtgctgggtcatacttgaagccagcacagcactgggtctcacccaaggtttgctgtaaccactctctacctaccacctatgtttgctcaagactgtggggctctatagtcagtaggtagcaaagccagccaggcctgtgttcttcccttcagggcagtgagttcccccacaccacagaagagtacagaagtgccatttgggagccagggactagagtcagaaaccttagatatttacccagtgctctattatattttactgtgactgagctgtcagttaaaccacaagatgcaatccctcccactcttccctccccctttccaaaggcagaggaacctcaccttgtggcaactgccatcccaggccacaaggagtactgcctgactactgctgaccactgtttccttaaggcccaagggctcttcagtcagcttttggtgaatgctgcctggtctgggactcacccttcacagcacccggctcccttctcactcacggtccagaaatgccattcaagagccaatcctggaattggggaccctaagagcttgcttggtgctctacttccctgtggctgagctggtacctaagatgcaagacacagtcccctttacgtttccctctatttttctgaagcagaagggcctctccctgaagccaccacagctgggaatgtgctgagtctcacctgaagtcagcaagtctcagggtctcacccgaagtcctcgacgtaggacctgactatcactgctggttattcagggcccaagggctctttggttagcagatgatgaatgattctagaactaggtcctttccttcaagagagggttctcttctggcccagggtttgtgcagaaatgtccgggagctaggacctggagaggaggcctcacaaccctaacccttgtcctatcctgctgtggttgagctggtattcgaagtgcaagacacagtcccctttatttttccccctgtttttctcaagcaaaaggagtttcgcctcatatccaccacagctagtaatgcactgagtctcacctgaagccagccagtctgaggctcacttaatgcccttgatgtagtacctgggtgtcactgttggttattcagggcccaaggactctttgttagcaggtgatgaatgatgccagaactgggtccttcccttcaaggtagtgggttccctgctggcccaggatttgtttagaaaaatgttcaggagctaggatctgaaagggggcctcacaaccctgacccaggccctatcctactgtagctgagctggtatccaagatgcaagacaaagttctccccactcttcgattttctctccttaaatggaaggaaggggtctcttttggagtcttgttgagctgtgcagcctggggttaggagagaggtgatatcagcactctctagccaccctggctggtgtctcagtagtttgcacgccctccccgcccccctcgccgcccaccccccccacccaaattccggtgactctgggcttagttcagcactaggactctcttaggagttgcagtctttgtggcctaggctgcctttaaagttcatttaccgacccacagtactttagcccacggtggcggggcttgtgggatctcaaggtctgactgctaggatcagcaattccattctgactcgggctggtttaaacaccccctccacgggcaggcgtcagctgagattggtcctgcttttctttctgctataatggagcagcagtgagttcaatgcctcataattgttgtgctctccttcccccagcatacagcaatgctctttgcaccaccgccactgccaggggacgggaaaagggtggcttctgcgattcaagactgtttttctacctctttagtgcctcttttagcaatatgaagttaaaaccaggtactgtgagtttccacctgatttctggttcttaggaaggtgatttttttgtgtagatagttgttaaattggtgtctttgcagcaggagggacgattggtggagccttctattccatcatcttgttccacctctggaattgctgatcttaggtgaatattttatagtatactattttaatttttgtaacattttttggattacgttttcttgtctttttcttttctttttttttttttttttttttgagacagagtatcgctctgtcacccaggctgggatgcagtggtgccatctcggctcactgcaatctccgccccccgggttcaagcaattctcttgcctcagcctcccgaacagctgggattacaggcctgtgccaccacgcccggctaatttttgtatttttggtagagaaggggtttctccatgctggccaagctggtctccaactcctgacttcaggtgataaaagctttactacttcatagctttattctcttttcttttttggtgattattattatacttactatgtctatatatgtttaaaaactcaagtatgcatggttataattattgctttgcaaaatcttatgtattttaaagaagatgagacataaaacagaacacaaacatatttattgtgtttttaaattttcaaccttcttataacttttggttcacttcatttcttcttttagatttgaactaccatctggtgtaatttcctgaatttctttcccacccaatctgctcttttgtgttaatcgttatcgaatatattacaaatgttatgccccagtaatacaccttaagaatttttttacacagttgctttttaaataaattaagaaaggaaagtagaagacatatataatcatactttcttttataattacctccataattactagccctgtttattttttcatatgaattcaaattattctctagtgtcacttgctttcagcatgaagaacctccttttgtatttcttataagacagattggctaacaagaaattctctcactttttgcttacctgggaatgtatttatttactcttaattttgaaagatagcttttctagatataagattctaatttcacagatttttttttcttttttttgtttattatactttaagttttagggtacaagtgcacagcatgcaggttagttacatatgtatacatgtgccatgttggtgtgctgcacacagtaactcgtcatttaacattaggtatatctcctaatgctatccctcccccctccccccaccccacaacaggccctggtgtgtgatgctccccttcctgtgtccatgtgttctcattgttcaattcccacctatgagtgagaacatgtggtgtttggttttttgtccttgcgatagtttgctgagaatgatggtttccagcttcatccatgtccctacaaaggacatgaactcatcgttttttatggttgcatagtattccatggtgtatatgtgccacattttcttaatccagtctatcattgttggacatttgggttggttccatatctttgctattgtgaatagtgccgcaataaacatacgtgtgcatgtgtctttttatagcagcatggtttataatcctttgggtatatacccagtaatgggagggctaggtcaaatggtatttctagttctagatccttgaggtatcgccacactgtcttccacaatggttgaactagtttacagtcccaccaacagtataaaagtgttcctatttctccacatcctctccagcacctgttgtgtcctgacttttatatatatatatatatatatatatatatatatttttttttttttattatactttaagttttaggatacatgtgcacattgtgcaggttagttacatatgtatacatgtgccatgctggtgcgctgcacccactaactcgtcatctagcattaggtatatctcccaatgctatccctcccccctacccccaccccacagcagtgcccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaaaccagtctatcattgttggacatttgggttggttccaagtctttgctattgtgaataatgccgcaataaacatacgtatgcgtgtctttatagcagcatgatttatagtcctttggctatatacccagtaatgggatggctgggtcaaatggtatttccagttctagatccctgaggaatcaccacactgacttccacaatggttgaactagtttacagtcccaccaacagtgtagaagcgttcctatttctccacatcctctccagcacctgttgtttcctgactttttaatgattgccattctaactggtgtgagatggtatctcattgtggttttgatttgcatttctctgatggccagtgatgatgagcattttttcacgtatcttttggctgcataaatgtcttcttttgagaagtgtctgttcatgtccttcgcccactttttgatggggttgtttgtttttttcttgtaaatttgcttgagttctttgtagattctggatattagccctttgtcatatgagtaggttgcgaaaattttctcccattttgtaggttgcctgttcactctgatggtagtttcttttgctgtgcagaagctctttagtttaattagatcccatttgataccaaagccaggcagagacacaacaaaaaaagagaattttagacccatatccttgatgaacattgatgcaaaaatcctcgataaaatactggcaaaacaaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaacactggaagcattccctttgaaaactggcacaagacagggatgccctctctcaccactcctattcaacatggtgttggaagttctggccagggcaattaggcaggagaaggaaataaaaggtgttcaattaggaaaagaggaagtcaaattttccctgtttgcagacgacatgattgtatatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattgaaaattgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcgatatcgtgaaaatggccatactgcccaaggtaatttacagattcaatgccatccccatcaagctaccaatgcctttcttcacagatttggaaaaaactactttaaagttcatatggaaccaaaaaagagcccgcattgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattacctatttaataaatggtgctgggaaaactggctagccatatgtagaaagctgaaactggatcccttccttacaccttatacaaaaatcaattcaagatggattaaagacttaaatgttagacctaaaaccataaaaaccctaaagaaaacctaggcattaccattcaggacataggcatgggcaaggacttcatgtctaaaacaccaaaagcaatggcaacaaatttcacagatgtttgaatacatcctttttgccttctttactccatgaactctgaggggtgtcagctgttaatcttattgttactcccctttatgtgatgagtcatttttctcttactgttttcaagattttctcttcatctttgatgttcaataattttcgctcatcatgtgtctggatgtagcttttttaatgcttatcctgttgaatttcattgagcttcttggatgtgtcgattattgtttttcatcaaatttggagagttttaagaccatcatttctttgaatatttatttgtccttttctttcttttcttctggtactcccattatgtatatgttggtgtgcttaatggtgtcttacatttttctgagcccatgttcatttttcttcatttttttttctgtttgttcctcagatttgtatcgtttctattgctcttcaggttagtttattgtttcttttgcctgctccaatctgctgaatttttcatttcagttattgtacttttcaactccagaatttccatttgtttcttttttaaaaaataataagcattaggagatatacctaatgtaaataacgagttagtgggtgcagcacaccaacatggcacatgtatacatttgtaacaaacctgcaggttgtgcacatgtaccctagaacttaaagtataataaaaaatatataaaaaaataataatttctatctcttaactgatacactcatattctccatatgatgagtcattgttatcagaccttcctttaatttttaaacacgattttaaaaaattctttggacgtaattataaaagttgctttgaagtctttttctattaagtgcaacattggggcctcctcaaaggaagtttcttttgctttttttcttctgtgtaggtcacactttttaattgtatgtcttacaatgttttgttaaacactagacattttggaaaatatattgtagcaagtctagatacagtttctcctctttctggggcttattgtttttattgtttgtttagtcatttatttgttcagtcacttggctggactaatttggtggaatttattttccacacactgtgtggcctctaatattcctgctcagaatttttccccttgtttttatcttttcatgacttcttatggagtcacccctgcatccacatagttcacttactggctaaaggttgtgctgaagctcacttagccagttagattttttcatcctttcctggatgtatgtttgtttagagactgcttttatagttctgggagagactaattcagtcggggactaatagcttgtagattctttatctgctcatacccaagaaagcagtcttgagcatgtgcacagtctcccagatccctcagtatgaggtcgatttgatttttaagctgggttccctggatcttagcttacctttcagttggtgtttggtcagacgatctgcttaagccccttgagccaatgaggctcaaggtactttgctgatagatctgtttatgccttgggtaatgcttttcagtttgccccaacactttctctgattgtgcgtgagtgggtgcagaatggcacatgggcacagtcttctggacccctagagataagtgtgaccccagaggttttcttcttggctgtttccctgattctctggtaaccttctggttggtctgctgtttcccttattgctaccattatcatggagctaccagctccctcttaattgctcactatcaagatctccattgttttcagcagtgtccttagacatgatcttctccatgctctgttttaaatacatcattcccctcaggaagagatgcagagttcttcctctttgcttctgttctttctttctggtcagaacctctgtgccacacgactagagctgggctcatggcatgcttctcttgaaatggcacccctaccatattagtaaattagtaaattctggcggtatggtagcccttggtcttcttagtgtgcccttttgacatgaaacctctgcctgatgagccagctggagtaaagatgatcaggatctcagtattcttgacctgtcacatttggggtagaatccttaccctaagagtgagagctgagtgggcaaagaaaagccagtcctctccatcgtacttgcccagaacacttccatgacacaggcctgagaatggcaagatagtctggcagcctgcttctctgcaggtgaaaccatagcctaggattttaggagctggcgggagagggaattcctatcttcttggctgcacccatctggagcagcttccatcacatggagccagtatagatgggagcagtttatagttcaaatgccatagactctcactggttatactgagatttagtttattttcatgaataaatgttttccattttctgtgtgcccttaggacaatttcaattttcagagactaagtggttgttttaatgaattttccagatgagtggttgtttcgctggggagagtgtctaaagagctccttatatcaccattgcagaagttccacccctcactggttatttaaaaaagtggaagtataaggttaatgtactaaaggagacctctatgaaatagggcttacaatgactaagccagcattatatctttgttagcaatctgaaaactcagtttggtagttctgggtcatttatagtttatgtttatttatatttatttatttatttcgagacacagtttcactctgtcgcccaggctggagtgcagtggcacagtattggctcactgcgacctccacctcctaggtttaagcgataatcatgcctcagtctcccaagtagctgagattacaggcatgtgccatcactccggctaatttttgtattattagtagagacggggtttcaccatgttggccaagcttgtctcaaactcctgacctcaagtgatccaaccgcctcaggatcccaaagtgctggaattacaggtgtgagccactgtcattggcctagagtttttttttttttaaggaatatttcaaagtattgtcttcaagttagttcagttcaccaacattttattgacatactcccttggaatactaattttatggtgaataatctttgatttgctttgtaggtattaggttttgaaaccttgaaactagtattaatatattatttgtggttactggaatgtcccatagataatatggtttgataattaaagcagagaactgaaaatcaaatttctctgctccccaacccctcaccctcattttcgataccaatctaggaaatatcagaaataattttatttctatattggtttagtcagccgcaaaatggagctaatagtgcttcagaagggtggtgtgagacttaatgaatattgctaaagcgtttgtttctgtgaaaacaactgtatttgttttattttaaatatatatttatacttattcggggtcgggcccaacactttgggaggctgaggctggtggatcacttgagctccggagttcgagaccaacctggccaacatggtgaaaccctatctctactaaaaatacaaaaaaaaaaaaaaattagccacgcatggtgatgagttcctataatcctagctacttgggaggctgaggcaggagaatcgcttgaacttgggagatggaggttgcaatgagtcaagatcgtgccactgcactccagcctgggtgacagaatgagactccatctcgaaaataactaagtaaatcattaataaataaatatatatttatattccttcaactttaaatggccaactaagagcttgtatacacttgtaaagtattttaatgcagtatgtattataataatttaatgcagtaaattatatatatttaatgtagcatattaagttatatatatttaaggcagtatattaaattatacctatttagtgcagtatatattatatatattcaatgctatatatatagccaaatggaaaaaggcatcaatataattgtagtgttgatttattgggtatctcctaaggaaattgttttctacagttagaaagtattgctttatatcattatatcatatggataataatctgttgtagtgcaaaacagaaaagttggaataaagtatgcttataccatgtcttcttagtaatatataatcttgaaaattatatataatttgaaatggatatatgtttatatatatatatatattttttttcctttttaatgatagccaaagctatgatattgggaagatggataagaaatctactgggccagaaatgctggtaaggatcatgttaaatattgtagaaataggttgaataacctgctttattttattgttataaaattataatagcgtactccccatttatgagtagattagctattgggcacaacatttaacatctcagtgtatttgtttttgtatatttatataataatataatctaactcataggcatgtacccatgaattaatatatgtagagtgctttgaacaatgtttgggtatgtaaattttaactttcttttctgtgtgtgtgtgtgtgtgtgtgtgtgtgtgtgtgtgtgtgtgttttgagatagagtctcgctctgttgcccaggctggaatgcagtggtgggatcactgcaacctctgcctcccaggttcaagcgattctggtgcctcagcctcccaagtagctaggactacaggcatgagccaccacacctggataatttttgtgtttttagcagagacggggttctgccatgttggccaggctggtctggaactcctgacctcaggtgatttgcccaccttggcctctcaaagtgctgggattacaggagtgagctaccgtgcctggcctagttttaacttttcttattgcatattttgaagttgcagatttttccccaactgcccagacagaacgtgcttggatatggaaattaatcttaatatgtaatcaagcaaaatgtgattgtgtaaataaatgtgatgtaaaattactacattctatagcaaaatggaatcttttgaatatccatttgattcttactattacagcatattaatcaaaatgtaactggatacctttttaatgtatttaccactgtaatatatggggaataaaagagaagcataaaatgtagcttctgcccttaaggaacttatgattaaaggataaaactagtacaagtgactacaatgaaatattatcctggcttaataaagaaagaaatctgacacatgctacaacatgggttaactgtgaggagactacgctgagtgaaacaagccagtcacaaaaagacagataatgtatggttccacttatgtgaggtatgtagagtagtcaaattcatagagacagaaagtaaaatggtggttttagggggtagggagaggggagaattgggaactattgtttagtgggtatagagtttcagttttgcaaggtaagagagttctcgagatggatgctggtaatgattgcacaagagtgtgaatatacttaatactactgaactgtacacttaaaaatgtttaagatggtcatggagccgggtgcagtggtgtgtacctgtagtcccagctactcaggaggctaagccaggaggattgcatgaaaccaggagtttgaggctgcaatgagctgtgatcatgcctgtgaatagccactgcattccatctgggcaacatagtaagactccatctccaaaaaaaatttttttttgagacagggtcttgtcacccaggctggagggcagtggtgtgatcagctcactgtaaccttcaaactcctgggctcaagcagtcctcccttcttaacctactgagtagctgggactacaggtacactccaccacatctggccaatttttaattttttatagagacgggggtctcactttgttgcctgggctggtctcaaacacctggcctcaagtgatcctcccaccttggcctcccaaggttctaggattacaggcatgagccactgcacctggcctaagattttaaaaaaagtttaagatggtcaattttatgttatgtgtattttaccacaattaaataaattatttatatataaatatataatatttatatttatatatagtgacattgtcacttattatataacagtgagactcaattaactataataattgcaacgatatggatgttctcacctataatattgaacaaatgaagcaagatacaaagtagtacttactgtatgattccataaatgtaaatgccaagaacagtcaaaatgaatatatggtgttggacatcagggaattggttacccctatttgaaacagggtctgaaaagaagcatgagtgggcttgttgctgttaatgttctgtttcttaacttttttgttgttaacatacatgtgtttactttgggaaaattcgtagagcctagaattcataagagcatagagctcttgagatttttatacttttctgtaagtcttttatacttcaatgaagaaaaatagaatttaaaaaacactactagaagtgaaacaatttgggaagataatgataaactttgtggtactgacctgaagtatgcagaagggcatatagaaaaggagattatcaagattagctagagtagttgtaggagccttttggtaggagacaggcctttttggggtccacacagttaaaagggaggaagaaaatgactccaggcaagggatctagatgggagatgtctaagaaggaaataaggatggaagataggatacaagcttgattaaaatggaatattcatattccatattgtaagtttagtgaggtaatactatgcagtaattttttatttcatgccagcagtcatttatttgaggtgtaatttatatacagtaaacttcacaagtctcaagtgtacagcttgatgagttttaatatatagtagtcttgtatattacaccatacagatcaagatacaaaaacttcccaacacccccaaaagttcccttggccccattctagttaatacccacctctacttccaagaacaaaaaaacaccattctgacttttactactctagattatttttgactgtttttgagctttgtataaatggaatcatacagttgtcctgttttatgtctggcttttttaaaacatacattgtgagattcgttcattttgttacgtcttttggatgatttgacactttcactgttatgaaatagctacagtatttctcagaaatgccatatttactccataaaagtcatttgggggagcttataaattcttagagttgttccacgataataatgtggtggtaagctgattaaatgaaatattgctctgcctcagtttccttattttaaaaggggggatgataaaatacgttaaatactgttaagaaaataattatattaacataattatattaaatgtaaataagccaggaatatagccattactgtaacattcttagacaatattttatatgggtagcataatgatgagacatattccaagactgtggtcgcttaaggaaatgctatttcataaagatgacttatgtttgagaagatgcctgtcactgtgggagtgctagtcagctgttgtattgaagtttaaccatcagatatgtgctttttttctttttttttttcttacaggctaaagttctacggctattagccacgaattatttggattgggatgacaccaaatattatgataaggctctcaatgctgtaaacctagcaaacaaggtatggggcttgtatttttgaatactaacttaatgtattttttgaagtcttgatcacattttgaaatccagtttagacatttgcttcagcatttactctcacagattgttataatctcttctatagcacagaaaggaaaaataaaatattgctataatctgaatgtttgtgtccccgcaaattcctatgttgaaatcttaacccccaaagtgatgatattaagaggtggggactttttggtgtagaatggacgtaaaaataaaaaaggtggggactttgggagatgataaagtcattgggcaaacccctcttgaatggtattactgcccttataaaagaggtccacaggagtttgttcaccccttttatcatgtgaggacatgagaaggcactgtctttgagtaagcaggccctcaccagacaccgaatctgcgagcaccttgatgttggagttcccagccttcagaactgtgagaaatcaatatctgttgtttgtaaagtatctagtttatggtattttgttatagcagcatgaacagactaaaacaaatatacttctttgaacaccagagatttttgagaaaattttcttttctgtgaaacagaaagggatgtctctactgtgagtttttaggatgaagaagtaaatgataaaatacgcagaataatgggatttaattttaaaaacaactccagtggttgactttcagctcatgttcacacatacctaaaaacatgaatacaaagcgggcgtggtgacacatgcctgtatttccagttgctcaggaggccaatgtgggagatttgcttgaggccaggagttcaaggctgcagtgcactatgattgcatctatgaatagtcactgcacttcagcctgggcaacataatagcaagaccccatctctaaaacaaacaaaacaaaatgtgtatatatctacactcctggacaaggaacactgaaaggctggtgaccctttaaaaatagattcaggctgggtgcggtggctcatgcctgtaatcccagcactttgggaggctgaggcaggcagatcacaaggtcaagagatcgaaaccatcctggtcaacatggtgaaaccccatctttactaaaaatacaaaagttagccaggtgtggtggcatgtgcctgcagtcccagctactcgggaggctgaggcaggagaatcgcttgaacccaggaggcagaggttgcagtgagccgagatcgcaccactgcattccagcctggtgacagagcaagtctccgtctcaaaaaaaaaaaaaaaaagaaatgaaataaaataagagagattcaattaggatcaatgtgttttacttaataaggcaattaaatatactgatacactttagaaaggtttttttcaacagagtggaagcatgaaaatgaatagctcgatcaaccagaatgttaaatttgtcaaacagagcatttacttgaactatattttcctgaaatttatgttatgtggatggggttatttaatgctgaaaaacttgttcaacattaaaattaaaaaattaatgtagaaatatttatagacaggaatattttctttttttaaattttactttaagttctaggatacatgtgcagaatgtgcaggtttgttacataggtatacatgtgccatggtggtttgctgcacctatcaacccgtcacctaggttttaagcccttgcctgcattaggtatttgtcctaatcctctccctccccgtgcctcccaccccctaacaggccctagtgtgtggatgttcccctccctgtgtccatgtgttctcattgttctactcccacttatgagtgagaacatgtggtgtttggttttctgttcctgtgttagtttgctgagaatgatggtttccagcttcatccatgtccctgcaaaggacatgaactcattcttttttatggctgcatagtattccatgctgtatatgtgccacattttctttatccagtctatcattgatgggtatttgggttggttccaagtccttgctattgtaaatagtgctgcaataaatatacgtgtacctgtgtctttacagcagaatgacttataatccttcgggtatatacccagtaatgggattgctgggacaaatggtatttctggttctagatccttgaggaatcaccacactgtcttttacaatggttgaactaatttacactaccaccaaaagtgtaagagcgttcctatttctccacaaccttaccagcatctgttgtttcctgactttttaataattgtcattttaactgtcgtgagatgttatctcattgtggttttgatttgcatttctttaatgaccagtgatgatgagctttttttcatgtttgttggccgcataaatgtcttcttttgagaagtgtctgtttatatcctttgcccactttttgatggggttgtttgtttttttcttataaatttgtttaagttccttgtagattctggatattaaacttttgttagatgggtagattgtaaaaattttctcccattctgtagattgcctgttcactctgaagataatttcttttgccctgcagaagctctttagtttaattagatcccatttgtcaattttggcttttgttggaattgcttttggtgttttagacatgaagtctttgcctatgcctatgtcctgaatggtattgcctaagttttcttctagggtttttattgttttggttttacatttaagtctttaatccattttgagttaatttttgtataaagtgtaaggaaggggtccagtttctgttttctgcatatcagccatactatttttcttagcaactgtatcattttaaattcccatctatagtgcacaagggttgcaatttcttcacgtcttcagcagcacttgttatcttctattttttaataatagacatcattatgagtgttaggttcacctttgttttttgaatgatattttttccaggtatagaatttaaaccagacagctttttttggggggggggtattttaaatatttcattccactgtattctcattctgttgtttctgttgagaaatatggtgccattcttatgtttgttcttttttatatagcgtgtcttcttttctgaataagttttggattttttatcattggttttgagcaacttgatgttatgcttttaagtaattttatttacgtttctcgtgcttggggctctttgtgattttttggatgtctaggagcataattttcattatgtttgaaaagttccagtatttcttcaaattttttttctgctttcccccaagtactctaattaaccatgtattaggctgcctgaagttgtgccatagtttgcttatactcttttcacttaaaacataatttgttatttttgtttcattttggactgttttgtattgctattacttttaagttcattaatctttcttctgcaatgtctaatcatctgttaatctcatcccatatatttttcatttcagactttgtagtttttatctctaaaagtttgatttggtttatttttatatcttccaagtctctagttaaatttttgagcatacgaaatacagttatacttactcttttaatgtctttctttgataattctaatatctatgtcacttctagattagtttccatctattatctccccattattgattgtttttgcctgctctgtctttcactgggtgccaactattttacatcgttggctgctggatatttttgtaatactataaatcttattgagctttattatgggaaacaggcaagttatttggaaacgatttgatcccgctgttcatgtgaactcctgactcttgcttagtatgaaatatttccttctttgttttgtaattatggatatgttaatttatgttcagtgagtgttaagtttttagaatcctattcaacctggattgagagcatggccctgcagagaaactttttattggcatcagccagatgtaaaagagttaccactcttttggttacttttattttactttctcagattggaggtttttggaccacatgagtaatgtaaatttgaactctgtatctacatgaaggcagagcccattaaaaaattatccaaaccaaaaaacttatctacacaaactttttttttttttttgcctcactcagagcttagctagaagacaaacttcctatgccattagataaaagaaaaaaactcaggaaacttaccacctccatatggttcacttctccaagttttgttgcctcactacaatctttgtttttgtttacttttaagagtcctcaggttgttgctttttatatcttgttcagagttcttagttgtaattagtagaaggtataggcttagttgtcttgcttcatatctgctggaactgaatctgatagtaaatttttaaaggagaaattaaaatttggtatgcctatgttgtttcacaaaattacctttgaaaatgtattagtgcaatgaaataaatataaaaggcataggtgcttagatactacaccaaaagcacaagcaaaaaagaacaattaggtaaaattaagtctcattaaaattaatttttttgcttcaaaggaaatcatcaagaaaatgaagacacaatccataggatcctcccaacagaatgggagaacatatttgcaaatcatatatctgttgtctattaaccataatataaaaaagaactcttactattcaataagaagacaaacaacccaattgaaaatgggctaaggaggcaaaggagctcaatagacattctccaaataatacgtaccagtggccaataagtacacaaaaagatactcaatatcattagttatcagggaatgcaaattagaagcacaatgagaaaccactttacatccactggtatggccctccgacttgtttttatttcagaattgttttggctcttctgaatctcttgcattttcatattttggaatcagcttgttgatttctgcaaagaagacagctgggaatttggtagggaatttgttgaatctgcagatcaatttgggaattattgctatcttaacaatattaagttttcaaatccaggaacatttattcattgttttgtagttttcaataaataagttttgtccttcttttgttaaatttattgcttctttatgcttttataaatggaattattttcttgacttttggattgttcattgctagtatatagaaatgccattaattgaaaaaatactgatattatatcctacaatcttcctgtacttgttcttttagctttaatagttttttaatggattacttaggattttctgtatacaagatcatattttctggccggacgctgtggctcacacctgtaatcccagtactttgggaggctgaggtgggtggatcacttgaggtcaggagttcgagaccaacccggccaacatggtgaaaccccatctctactaaaaatacaaaattaaccagacatggtggtgcatgcctgtaatcccagctatttgggaagctgaggcaggagaatcacttgaatccagaagggagaggttgcagtgagccaagattgtgccattgcactccagcctggacaacaagagcaaaactccgtctcaaaaaaaaaaaatcatattttttgtaaataaagatagttttacttcttgctttccaatctgcgtgccttttgtctctttttcttttctaatttttctagcaagaacattcattactatgttaaatagaattggcaagagcagtatctttccctaatcttagagagctttcagtattttgccattaagtatggtgttagctgtgggtttagtatagatgccctttgtcaggttgaggaagctcccttcattcctagttttttgagaattgtacaaccacgttaaaaaacagtttgaagttacttgataaaataaaatttgatcatactggaccacccagcaacttcactcctaggtagtgaagcgctagcatttgtatacaaggagaggtatacagaatgctgattccaggattgttcataatagcaattgcgttggaaacagcttaaatatccaaagtagaatgtgcaaataaagtgtgaattattcataaaacagagtactatacaacagttgttcttaatatttagcttgtgtaagtattacctagagtgtctgttaaacacagtttgctcatttgttaccttactaaacagataatagaatttatgttgaattggaaactttccataatgcaaatcaataataattattttacacattttcccccacacatgcacatacaatttgctaggcaatactcccagagtttctcatttagtaggttttggatggggcttgaatttctttttttttctttttttttaaattatactttaagttttagggtacatgtgcacgacgtgcaggtatgttacatatgtatacttgtgccatgttggtgtgctacacccattaactcgtcatttaacattaggtatatctcctaatgctatccctccccactccccccaacccacaacaggccctggttgtgatgttccccttcctgtgtccatgtgttctcattgttcaattcccacctatgagtgagaacatgcggtgtttggttttttgtccttgcgatagtttgctgagaatgatggtttccagcttcatccatgtccccacaagggacatgaactcatcattttttatggctgcatagtattccatggtgtgtatgtgccactttttcttaatccagtctatcactgttggacatttgggttggttccaagtctttgctattgtgaatagtgccgcaataaacatacgtgtgcgtatgtctttatagcagcatgatttatagtcctttgggtatatacccagtaatgggatggctgggtcaaatggtatttctagttctagatccctgaggaatcgccacactgacttccacaatggttgaactagtttacagtccgaccagtagtgtaaaagtgttcctattttttcacatcctcaccagcacctgttgtttcctgactttttaatgatgccattctaactggtgtgagatggtatctcactgtggttttgatttgcatttctctgatggccaatgatgatgagcattttttcatgtgttttttttggctgtataaatgtcttcttttgagaagtgtctgttcatatccttcaccaacttgttgatggggttgtttgttttcttcctgtaaatttgtttcagttcattgtagattctggatattagccctttgtcagatgagtagattgcaaaaattttctcccattttgtaggtcgcctgttcaccctcatgatagtttcttttgctgtgcagaagctctttagtttaattagatcccatttgtcaattttgtcttttgttgccattgcttttggtgttttagacatgaagtccttgcccatgcctatgtcctgaatggtattgcctaagttttcttctagggtttttatggttttaggtctaacatttaagtctttaatccatcttcaattaattttagtataaagtgtaaggaagggatccagtttcagctttctacatatggctagccagttttcccagcaccatttattaaattgggaatcctttccccattgcttgtttttgtcagatttgtcaaaggtcagatagttgtagatgtgtggcattatttctgagggctctgttctgttccatttgtctgtatctctgttttggtaccagtactatgctgttttggttactgtagccttgtagtatagtttgaagtcaggtagcgtgatgcttccagctttgttcttttggcttaggattgtcttagcaatgcaggccctattttggttccataggaactttaaagtagttttttccaattctgtgaagaaagtcattggtagcttgatggggatggcattgaatctataaattaccttgagcagtatggccattttcatgatattgattcttcctacccatgagcatggaatgttcttccatttgtttgtatcctcttttatttcattgagcagtggtttgtacttcttcttgaagaggtccttcatgtcttttgtaagttggattcctaggtattttattctctttgaagcaactgtgaatgggagttcactcatgatttggctctctgtttgactgtttttggtgtataagaatgcttgtgatttttgctcattgactttgtgtcctgagactttgctgaagttgcttatcagcttaaggagattttgggctgagacgatggggttttctagatatacaatcatgtcatctgcaaacagggacaatttgacttcctcttttcctaattgaataccctttatttccttctgcctgattgccccggccagaacttccaacactatgttgaataggagtggtgagagagggcatccctgtcttgtgccagttttcaaagggaatgcttccagtttttgcccattcagtatgatataggctgtgggtttgtcatagatagctcttattattttgagatacatcccatcaatacctaatttattcagagtttttagcatgaagggttgttgaattttgtcaaaggccttttctgcatctattgagataatcatgtggtttttgtcattggttctgtttatatgctggattacatttattgatttgcacatgttgaaccagcctcgcatcccagggatgaagtccacttgatcatggtggataagctttttgatgtgctgctgaattcaatttgccagtattttattgaggttttttgcatcaatgttcatcagggatattggtctaaaattctcttttttggttgtgtctctgcccggctttggtatcaggatgatgctggcctcataaaatgagttagggaggattctctctttttctatgattggaatagtttcagaaggaatggtaccagctcctccttgtacctctggtagaattcggctgtgaatccatctggtcctggactttttttggttggtaagctattgattattgcctcaattttagagcctgttattggtctattcagaggttcaacttcttcctggtttagtcttgggagggtgtatgtatcgaggaatttatccatttcttctagattttctagtttatttgcgtggaggtgtttatagtattctctgatggtagtttgtatttctgtgggatcagtggtgatatcccctttatcattttttattgcgtctatttgattcttctctcttttcttctttattagtcttgctagcggtctatcaattttgttgatcttttcaaaaaaccagctcctggattcattgagtttttgaaggcttttttgtgtctctatttccttcagttctgctctgatcttagttatttcttgccttctgttagcttttgcatgtgtttgctcttgcttctgtaattcttttaattgtgatgctagggtgtcaattttggatctttcctgctttctcttgtgggcatttagtgctataaatttccctctacacactgctttgaatgtgtcccagagattctggtatgttgcgtctttgttctcattggtttcagagaacgtctttatttctgtctttattttgttatgtacccagtagtcattcaggagcaggttgttcagtttccatgtagttgagcggttttgagtgagtttcttaatcctgagttctagtttgattgcactgtggtctgagagactgtttgttataatttctgttgttttacatttgctgaggagtgctttacttccaagtatgtggtcaattttggaataggtgtggtgtggtgcagaaaagaatgtatattctgttgatttgggttggagagttctgtagatgtctattaggtccgcttggtgcagagctgagttcagttcctggatatccttgttaactttctgtcgtgttgatctgtctaatgttgacagtggggtgttaaagtctcccattattattgtgtgggagtctacgtctctttgtaggtctctaaggacttgctttatgaatctgggtgcttctgtattgggtgcatatatatttaggatagttagctcttcttgttgaactgatccttttaccattatgtaatggccttctttgtctcttttgatctttgttggtttaaagtctgtattatcagagagtaagattgcaacccctgcctttgtttgttttccatttgcttggtagatcttcctccatccctttattttgagcctatgtgtgtctctgcacgtgagatgggtttcctgaatacagcacactgatgggtcttgactctttatccaatttgccagtctgtgtcttttaattggagcatttagcgcattaacatgtaaggttaatgttgttatgcgtgaatttgatcctgtcattgtgatgttagctggttattttgcccgttagttgatgcagttcagccttgatggtctttacaatttggcatgtttttgcagtgtcttgtaccggttgttcctttccatgtttagtgcttctttcaggagctcttttagggcaggcctggtggtgacagaatctctcagcatttgcttatctgtaaaggattttatttctccttcacttatgaagcttagtttggctggacgtgaaatttgggttgaaaattcttttctttaagaatgttgaatattggcccccactctcttctggcttgtagagtttctgccgagagatcagctgttagtctgatggacttccccttgtgggtaacccgacctttctgtctggctgcccgtaacattttttccttcatttcaactttggtgaatctgacaattatgtgtcttggagttgctcttctcgaggcatatctttgtggcgttctctgtatttcctgaatctgaatgctggcctgccttgctagattggggaagttctcctggatagtatcctgcagagtgttttgcaacttggttccattctccctgtcactttcaggtacaccaatcagacgcagatttggtcttttcacatagtcccatatttcttggaggcttttttcatttctttttattcttttttctctaaacttctcttctcgcttcatttcattcatttgatcttccatcactgatacccttttttccagttgatcgaatccgctactgaagcttgtgcattcatcacgtagttcttgtgctgtggttttcagctccatcaggtcctttaaggacttctctgtattggttattctagttagccattcgtctaattttttttcaaggtttttaacttctttgccgtgggttcgaacttcctcctttagcttggcgtagtttaatcgtctgaagccttctctcaactcgtcaaagtcattctccatccagctttgttctgttgctggtaaggagctgcgctcctttggaagaggagaggtgctctgatttttagaatttccagtttttctgctctgttttttccccatctttgtggttttatctacctttggtctttgatgatggtgacaaacagatggggttttggtgtgcatgtcctttctgtttgttagttttccttctaacagtcaggaccctcagctgcaggtgcattggagtttgccagaggtccactccagaccctgtttgcctgggtatcagagcggaggctgcagaacagcggatattggtgaacagcaaatgttgctgcctgatcgttcctctggaagttttgtctcagaggagtacccggccgtgtgaggtgtcagtctgcccctcctggggggtgcctcccagttaggctactcgggggtcagggacccacttcaggaggcagtctgtccattctcagatctcaagctgcgtgctgggagaaccactactgtcttcaaagctgtcagacagggacagttaagtctgcagaagtttttgctgccttttgtttggctatgccctgcccccagaggtggagtctacagaggcaggcaggcctccttgagctgcagtgggctccacccagttcgagcttcccagcctctttgtttacctactcaggcctcggcaatggtgggcgcccctcccccagcctcgctgctgccttgcagtttgatctcagactgctgtgctagcaatgagcgaggctctgtgggcgtaggaccctccaagccaggggtgggatttaatttcctggtgttttgtttgctaagaccgttggaagtgcgcagtattatggtgggagtgacctgattttccaggtgccatctgtcactcctttctttgactaggaaagggaattccctgaccccttgtgcttccctggtgaggcgatgcctcgccctgcttcggctcaggctcagtgcactgcacccactgtcctgcacccactatccaacactccccagtgagatgcacccagtacctcagttggaaatgcagaaatcacctgtcttctgtgttgctcacactgggagctgtagactggagctgttcctattcagccatcttggctccaacccatggcttgcatttcttacaagttcccagatggtgctgattcagggaccaccctttgacagccatgctgtatagtaatgaaaacaaataagtttcacatatctacatggttgaatctgaaaaaacatgatttgaatgaaaggaatcacagaagaacttagatacattatgattctgtttaagtgaagttcaaatgtaggcaaaactaaataattgtgttggctagcttgagctgttataactaaatactataaactgggtggcttaagcaacagaactttatgtctcacacttctagggactgagatgtccaagatcaaaataccagcctttttggttcctggtgggggcctttgtcttggtttgaagatggccaccttctttctatatcttcatttggcagagaaagagagagagagagagatcatctctcatctctctcatgtcttttcttataagggcacttatcccattcatgagggctcagccctcatgaccaaattacctcccaaagcccccacctcaaaataccatcacattggggattagatattcaatatatgaattttagaaagacacaaacattcggtccatagcaactgtatattgtgtatatataaagaaaagcaagggaattactgcacaaaattcaggatggtgtttacctctgtgaggtgaggaggatgcctatgggtaaggatacatttgaggctttttatgtggcaataatctgtttcttaaccttggtagtgaggacaccggtgtttgttttattattattctgtaaactatacatatacattgcatatacatatgtttatatactcatgtgtgtgtatgtgtgtatgtgtatgatacacttcacactagaaatgagtacattatctttagagcttgcaaaatatccagatagtgtagtaatgcctgccatgatagacagagcttcaagggaggcagcatattgtaatggaaagattatgtcctttagagtcagagagatctgaattcaaatttcagctctactacttaccagttgtgtgaccatgggtaagttacttaactttatctggccctgcaaaacaagattcacaatacttatcttgtatgtttgttgtacctggagcctgtttctcagtaactggtgaaaagaaaaaaatcagcaaacaaaaatctaaggaagggagccaggcatggtagttcatgcctataatcccagcacattgggaggctgagacaggaggattgcttgagcccaggaagtggaggctgcagtgagccgtgtttgtaccactgcactccagcctgggagacagagtgagactctgtctcaaataatgaaaaaaaaaaagcagccaggcctggtggctcatgcctgtaatccctgcactttgggaggctgaggcaggtggatcacttgaggtcaggagttcgagaacagtctggccaacatggtgaaacctcgtctctactaaaaatacaaaaatgagccagatgtggtagagtgtacctgtaatcccagctactcgggaggctgaggcaggagaattgcttgaacctgggagacggaggttgcagtgagccgagattgtgccactacactccagcctgggcgatagagtgagactccatcatgaataaataaataaacaaacaaacaaagctatgaagaatgagaaataacagtgggaaaagttacagagaagacaaggattttgatagtagggagaaagctgatggatttagcaggcaatcttcatgacttctggaagtgtagttttaagagacaataaggatggacaatatacggtgcaaatgtttacagaagtgaagacatgatgataacagaagtaaaatgtccattatctggggttgtttggtaatgaaatcagtgaaaatcatatctggaattgtttggtagaaaaaaaccagaatgttaaatttgtgtgagaatagcagactcaaggaaaacagatgttgccaagatctggaagacctctatgtctctgaagataaaagggaattgaatccaacacatacttcaacaaacctacaggaaagatggtaatgcaataaatcaaaattggcaacttcagtttattctttgtactagtgtcatctatatttgcaagcccttttaataccagtgcttactttctccaactttctatttttaagacatctcacatatgaatacctgtaattatgtgcagagtatggagctaatcagtacggtgttcatgtaggggttaattggctttgtagagagaaaagttctgttctgtgggcctagactgtacttttagtcttagaaagttgtttaaagatgtaccctgtcaggcgaaagtggaaccgggaagatcacagatggcttagggccaactaacaatgatttagaaataacgttgttattaatggtaaacacgacaggcatatcttatggaaaagacaatacattttctattttattccgccattgtttgcaaaggaccttagtcaataaatctcaaaagaaaataaaactagccggtttgtggttttgcttacaaagaatatggcctgagatttgtacagtttaagtattaatcttgtcattaaatgtttgtcactcattggaaatatttacatgttcttttccatatattatttcatttagattgaaaaaatattgggaaatatcctcagggatagaacaaatgttatgatatggtcttctgtaatttcgatttcctttgattatgagttatcccaaggtggttgaataaagcaggcaattacttgaaaattgtcttttacattccacaattttaatatcattgtgatttctttgtttaaaataggaacatttaagttctcctgggcttttcttaaaaatgaaaatcctcttgaaaggcgaaacatctaatgaagaactccttgaaggtatgatctctgtatgtgaagagcacaccattttgaaacatcactacaatttgttaaatataagatcttttgtagtatactaacaataggtgtaatttgatggtggctgagaaggaaaatgatcacccaggaaagggaaaatattgtcacccaggaagaaagagagaaagaagaaaaaatagtagcaaatttaaaaggtgtttttttttttaaaaaaagctgaataaaagcaatcagttttcttttagtccagcagagaactgtagctacccaacccttctgaagttgtctaccaccatgaagaaagaaagattacctattaatgggaaaagcctttgtaatgctgtgatttttataattacttgtttataaacattgctatttatttttcataattctccaaggaccagaatgtacactgcacaaaagttggtcattgggcaagtcacttaactttgctttgtttcttcatttagcaaaagagatattattattatctacctcatcatgttgttttgagaatcttgtgagaaaatgtgtataaagcatttaacaccatacctggtgcatagtgtgcaatatatgttacctattactgtagttattattattactgttattactactatatagatgcattacatgaagcaaaactatgcacactagcccttaacatttcagttttgtttagtcataaaaattatttactctaattcttttaatgttgtacatgcttttcagtaatctttaagagctgcattatttgtactatacaaaattatatgttagtatagttactgattatccaataaataataacaatttgttatagttagaactaaaattcaatttggcagtagccctaaatttagtactactgaatctttcggcggcctctagaattttagccaatcacttaagagacctcagaagctcaaatgtattggggattctgcatctctaggcaacagtatcacctcagcatacacagattgaaaaatgttagaaaccaggaagacaactctacttttttgcattgggggaataaacaaaccaactaaccaactaaaataatacacttactccaactaagacaacataggaagaccagagagatgattggagtcaccaagttgaagtacattagtttgggatgataattccttatgacagtgtttatccaaatgtaggtaagaagcagagtttaaaatgaaattgttctttattcacagattgcttttacttaactcaatctagatactcccgaagttgcaatgtcagtcatagtttgattacagattaggaggctaacccaaatccaagttttttatatttaaaaatactagattttgcattgaaagaatatatgaaacttgcatttttatattctgtttgttgctttgctggtgaaaatactttactcttaaaatggtcagcctaactgctggcattattgcactgatattttttgtagtagaaagattgaaatttaaaaataaacatttttcattgtgaaaggatagcacataataatttaagacatttttggaaaatactaaaaattctcatggtcctaccatccactagaagctccttgacagcaggaatatttgttatgttttatccactgctaggttctcagcacaaagcacaatgcctggtacagataatatgctcattaaatatttgtcaaataaatagaatctaaacacaatcacttttagaaatttgatcacttattttcagtattttttctcttagtttattttgcttttattacagaattgtaactatatagtacataaaagtttgctttctaatttttcacttactaatcttatacatttttcatattagtgtatattcattttttccactttatttcatactcaacagttttaatggttgcacaatagtttattgctaccctgtaatagacatacagtgtatacttcttttctattattattataatctacactgcttttaatatttttgttcataaactttccccatatttattccaggtgacttttcagaagcacaatttcttaaagggaataataatagcagctgccatttattaaatgcttactaagtgctaggttctttgctatataatttccatacattatctcaggtaatcctctcaacaaccctgagaaattggtggtatattctccattttacaggtgacaaaactaaggtatagagagcataacttgcctatggccatacaagtagcaagtggtttcaaatttagatctgtctgacttcagataccaagctctctaccccagtgttcttagcgtatagtattgccaagttgctttttgaaaggattgcaccagattactttgctatctgtgcaagagtgcttgtgtcatgacactctccagcactggatgttaatactttaaaagaagattttgataaatttttaggcaaaacatggtatatggcaaacatttagtaagtagattttgaatagaggaaaattattgaaaataactaagcttcctcaaaaattaaactgataattatttcattttttcatcttgttagctgtcatggaaatactacatcttgacatgcccttagacttctgtctgaacattgctaaactgctgatggatcatgaaaggtacagaattgatttccctttctctaaagactgacagtttttggctaggcaccagtggctcacacctagaatcccagcacttggagaggctgaggcgggaggatcccttgagcccaggagcttgagaccaaccttggcaatatagcaagaccccatctctacaaaatattttttaaaaaattggctggtatggtggcatgtgcctgtagtcatagctactcgggaggctgaggcgggaggatcacttgagcccagcagttcaaggttacagtgaactatgatagtgccactgcattccagcatgggcaacagagcaggactctctcaaaaataattttaaaaatttagtccctccttcacactagccatgtatcaaatccaaatagctgcatgtagctaatggctgccttattggacattacagattaaaaaaatttccattgtcacagggaagttctattgggcagcactgttttagaccctgtatttcttttaatgcagacaacatttaaaatagttcttttctggcagctacatcatatggttaatttcctggacttatgaaactatatgcctcatatcctccacttttatggttaagaacccattaaccatactttataaactattaaatttcagcctgattgttacagcctattttttcagttcttctgatctttgtgaatttcacttctatcatgcagtgtattaactattcctcccagtttgtgtcatcttcaaatttggtattgccacctgtcttcatctaattcaggggtctgcaaacttttcttacaggttaagatataagtatacattttgggcttgtgggccacacagtctctgtcacaactagtcaactctgccgtcgtggtgcaaaagtagccgtagactaatcataaacaaatgtgtgtggcttttattccagtaaaactttattcataaaaacaagcagagcagctggactgcaggccatagttttctaactccagataatttgacaaacagcaaaactgaggccagaaccttcgtggcagcatagattaatctccaggttaacagcaatccattaattgatactttttagtgtacaatcattgaacctgttataaatccacctaattatagagctagatgacctaatttccttcatgttgttcacaaaaatttcatggaacttaatttttattttttaaagttttggttgcttttatccttccttcttccaaaaagaatttgaaacttcttatattcaagtgtataataaagctctgaaaattgaaatagacaatcaaaaccctgaaaaggaggaagcaaacacaccaaacacaatggctaatatagttgctgtggtagagcattcaatttaatggtaagctttcttgcagccagggagaaggggcaatgtgatattttatacaattttcattattaaataacaaaagctaacatttactgatacttgctttttactaggcactattctaaattccttacattataaattatgaagtacctctaacgtaatttgattaaccccattttgcaggtgagaaaaatgagggttagatagaaaaagtaatttgcccacaattgcatagctaggaaggagcagagctggaatttaaatatgtttgcagagctcacactttttattactgtagtagaaggaatacattcaatactacattccaaatcaattaatcactagaaaaagtttacaaagtggtggactatgggctgggtgtggcgagagatgtgttgcatatagttgaattagttgccaacattaaacattcaggaaatttcacataaaaatatggttttcatatatatatatatattatatatatgtatataatatatacatagaaaatctgtgtaatgaaaaataattcaagaaaaggactgaaatttcaactgggtttattttggaaagtgaataaaataagcaatcctgttgtaaaatgcagttatgtagttatatattaagggaaaagattgcccaggcattagctctcttacagatgacaactttacaaaaaagtgtctactgagtcacacaacatattcttttttttttagtaccttctttttttattatactttaagttctagggtacatgtgcacaacatgcaggtttgttacttatgtatacatgtgccatgttggtgtgctgcacccattaactcctcatttacattaggtatatctcctaatgctatccctacccccttctcccaccccatgaaaggccccggtgtgtgatgttccccttcctgtgtccaagtgttctcattgttcaattcccacctatgagtgagaacatgcagtgtttggttttttgtccttgcgatagtttgctgagaatgatggtttccagcttcatccatgtccctacataggacagggactcatcctttttatggctgcataatattccatggtgtatatatgccacattttcttaatccagtctatcattgttggacatttgggttggttccaagtctttcctattgtgaatagtgccacaatgaacatacgtgtgcatgtgtctttatagcagcatgatttataatcctttgggtatatacccagtaatgggatggctgggtcaaatggtatttctagttctagacccttgaggaattgccacactgtcttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcacgtatcttttggctgcataaatgtcttcttttgagaagtgtctgttcatatcctttgcccactttttgatggggttgtttgttttttcttgtaaatttgtttgagttctttgtagattctggatattagctctttgtcagatgagtagattgcaaaaattttctcccattctgtaggttgcctgttcactctgatggtagtttcttttgctgtgcagaagctctttagtttaactggatcccatttgtcaattttggcttttgttgccattgtttttggtgttttctgttgcatagacataaataataatgcccagtgaagcatatttatttgtggtgtcaatgagaattttgatatgatagaacttttgaacatagtgcctgtgtcttaagtttaatgtagactggtcaaaataacttaagtatgactacagaagatatttctgcaatggttaacacaagacttgatatgaaacttaaatccaaagtggcagtgtttttaaagataaaaaacttcagtgtattaattgtataattcaccaggaaacactgtcctaaaaagataaaaaatgaaacgtgtatataataacaatatatgtataccagatattattctgtggcctcaaccgagattattgctttttttggatgaattggatgcacaatacagtagttgcttctgcttcttgtagattagggggcttagttgtatgtggtgttgtcacaggttgggttgccctggaagcaaattttgagatggaggttaacgtgaagataatttattaaagggttctttcaggatcaacacctgtgaagggaaggggatgcagctggactaatgggagaagttggcctagatatagtcagaaggcctcagccttacttattgggagctctgaagctgggatggtccctccaaattgtcctcagctaaggtcagagggccggtccttatagcccaatgttgactagtctctgtatgccagttaccctgggaaaggagaatgaccttgggtgtggtagcttttttcagcctagcgaattcctaaagagcaactggggaataaatacttcagttctgaaggggagtttcgggatgtagtgcagcatttatgtcaggtgctgaagatatattttttgaactgttgaaagaattcaacttgttcatgtcatccaagggaaaatccctgactcagttcagtgactgacctttttggtgaatatgataatccatataaacactctgaatctttctcgcgaaagtgctcataagtagttacacaaatgtaaaatttaattcacatgttcttagtgaagtcattttttggggaaatgcttttggcaaggaataatccggcttacttttctgtgctgaaattggtgtccagagatggaagtgattacttaaactacgtattcacaattgcaggtttaaagagtgaattccaaaaaggaagttttctgatttccaacattgtggcaattaaaaatattgcctattttgtctttttcaattaattttactaatgtcagtaaagaactacaaattgaagaaattgaactgcactgtagtgtggtactgaatcctaattagacaactttggaatatcagtatgtagtagacatttgctgcttttggccatccatcattttattcattccactttcctcttgatacggtacccgaatttccacttaagtatctacttttccctatcagcccatgtggacactgacatattggtgtagaagaaaggattttagctttctatttacaagtcaacaaagtaatcaatttcaaaggaaaatttgataaattatttatatttttagatttcaaatttaaaatatagctgctcttttcctacctgttcatactatttgttaatgtgcttataccatcgttcggttaatgataaagtttaattacatatctggcagtggatttttttacagtctgcttcactcatttatgttacatatttggcttctgtagacagtgtaggaagttgcattatataatggacaatgcttttagtaattttatagcaagagcataagtatattttacacagtaaagtttttttttttaagcaatgaaagctaagcatgcagaacattaactgttagaaagtgaatgaagtggccaggcgtggtggcttacgcctgtaatttcaacactttgagaagctgaggaagatggattgcctgaggtcaggagttcaagaccagcctggtcaacatggcaaacccctgtctctactgaaaacacaaaaatgagcgggctgtggtggcacatgcctctaatcccagctactcaggaggctgaggcatgagaattgcttgaacccaggagacggaggttgcagtgagccaagatcgcgccattgcactccagcctgggcgacagagcaagactccatctcaaaaaaaaaaaaaagaaaagaaagtgaatgaagttctgtaatggactaagctaatgtagttcagacctagttttctgatgatccatcttgatgcaaggataaaattttgaatatatagaatggatggaaatactatgtctcttaagcgatctttttttttttttgaaatttcaccttttacagtcaagcttcattaggagacagagagcagacaattccaggttatatacttattagatcctagtaatatccagtactatttaagggaagagcataggctttggattctagaaaagcaggtgaatggcttgatactgttattgaatcatttttctgaatttgttagattatatctatttactctctgacattaacatttaagtaaacttgcaaaagataagattaattggaggtggagccaagatggctgaataggaacagctccagtctacagctcccagcgtgagcgacgcagaagacgaatgatttctgcatttccaactgaggtaccgggtgcatctcactggggagtgttggatagtgggtgcaggacagtgggtgcagtgcactgagcctgagctgaagcagggcgaggcatggcctcacccggaaagtacaaggggtcagggaattccctttcctaggggtgatggatggcacctggaaaatttggtcactcccaccataatactgcgcttttccaatggtattagcaaatggcacaccaggagattatatcccgcgaatggtttggagggtcctacgcccacagagcctcgctcattgctagcacagcagtctgagatcaaactgcaaggcagcagcgaggctgggggaggggcgcccaccattgccgaggcttgagtaggtaaacaaagaggctgggaagctcgaactgggtggagcccactgcagctcaaggaggcctgcctgcctctgtagactccacctctgggggcagggcatagccaaacaaaaggcagcaaaaacttctgcagacttaactgtccctgtctgacagctttgaagacagtagtggttctcccagcacgcagcttgagatctgagaatggacagactgcctcctgaagtgggtccctgacccccgagtagcctaactgggaggcaccccccaggaggggcagactgacacctcacacggccgggtactcctctgagacaaaacttccagaggaacgatcaggcagcaacatttgctgttcaccaatatccgctgttctgcagcctccgctctgatacccaggcaaacagggtctggagtggacctctggcaaactccaatgcacctgcagctgagggtcctgactgttagaaggaaaactaacaaacagaaaggacatccacaccaaaaccccatctgtttgtcaccatcatcaaagaccaaaggtagataaaaccacaaagatggggaaaaaacagagcagaaaaactggaaactctaaaaatcagagcacctcttctcttccaaaggagtgcagctcctcaccagcaatggaacaaagctggacagagaatgactttgacaagtggagagaagaaggcttcagacgatcaaactactccaagttaaaggaggaagttcaaaccgaagacaaagaagataaaaaccttgaaaaaagattagacaaatggctaactagaataaccaatgcagagaagtccttaaaggacctgatggagctgaaaaccatggcacgagaactgcgtgacaaatgcacaagcctcagtagccgatgctatcaactggaagaaagggtatcagtagtggaagatcaaatgaatgaaatgaagtgagaagagaagtttagagaaaaaagaatacaaagaaatgaaaaaagcctccaagaaatatgggactatatgaaaagaccaaatctacgtctgattggtgtacctgaaagtgacggggagaatggaaccaagttggaaaacactgcaggatattatccaggagaacttccccaatctagcaaggcaggccagcattcagattcaggaaatacagagaacgccacaaagatacacctcgagaagagcaactccaagacacataattgtcagattcaccaaagttgaaatgaaggaaaaaatgttaagtgaagccagagagaaaggtcgggttgcccacaaagggaagcccatcagactaacagctgatctctcagcagaaactctacaagccagaagagtgtgggggccaatattcaacattcttaaagaaaagaattttcaacccagaatttcatgtccagccaaactaagcttcataagtgaaggagaaataaaatcctttacagataagcaaatgctgagagattttgtcaccaccaggcctgccctaaaagagctcctgaaggaagcactaaacatagaaaggaacaaccggtacaagccactgcaaaaacatgccaaattgtaaagaccatcaaggctaggaagaaactgcctcaactaacgagcaaaataaccagctaacatcacaatgacagggtcaaattcacatataacaatattaaccttaaatgtaaatggactaaatgctccaattaaaagacacagactggcaaattggataaagagtcaagacccatcagtgtgctgtattcaggaaacccatctcacgtgcagagacacacataggctcaaaataaagggatagaggaagatctaccaagcaaatggaaaacaaacaaaggcaggggttgcaatcctagtctctgataatacagactttaaaccaacaaagatcaaaagagacaaagaaggccattacataatggtaaagggatcaatacaaaaagaagagctaactatcctaaatatatatgcacccaatacaggagcacccagattcataaagcaagtccttggagacctacaaagagacttagactcccacacaataataatgggagactttaacaccccactgtcaacattagacagatcaacacgacagaaagttaacaaggatatccaggaactgaactcagctctgcaccaagcagacctaatagacatctacagaactctccatcccaaatcaacagaatatacattcttttcagcaccacaccacacctattccaaaattgaccacatacttggaagtaaagcactcctcagcaaatgtaaaagaacagaaattataacaaactgtctctcagaccacagtgcaatgaaactagaactcaggattaagaaactcactcaaaaccgctcaactacacagaaactgaacaacctgctcctgaatgactactgggtacataacaaaataaagacagaaataaagatgttctttgaaaccaatgagaacaaagacacaacataccagaatctctgggacacattcaaagcagtgtgtagagggaaatttatagcactaaatgcccacaagagaaagcaggaaagatctaaaattgacaccctaacattacaattaaaagaactagagaagcaagagcaaacacatgcaaaagctaacagaaggcaagaaataactaagatcagagcagaactgaaggaaatagagacacaaaaaagccttcaaaaactcaatgaatccaggagctggttttttgaaaagatcaacaaaattgatagaccgctagcaagactaataaagaagaaaagagagaagaatcaaatagacgcaataaaaaatgataaaggggatatcaccaccgatcccacagaaatacaaactaccatcagagaatactacaaacacctctacacaaacaaactagaaaatctagaagaaatggataaattccttgacacttacactctcccaagactaaaccaggaagaagttgaatctctgaatagaccaataacaggctctgccattgaggcaataatcaatagcttaccaaccaaaaaaagtccaggaccagatggattcacagccgaattctaccaaaggtacaaggaggagctggtaccattccttctgaaactattccaatcaatagaaaaagagggaatcctccgtaactcactttatgaggccagcatcatcctgataccaaagcctggtagaggcacaacaaaaaaagagaattttagaccaatattcctgatgaacatcgatgcaaaaatcctcaataaaatactggcaaaccgaatccagcagcacatcaaaaagcttctccaccatgatcaagtgggcttcatccctgggatgcgaggctggttcaacatatgcaaatcaataaacgtaatccagcatataaacagaaccaatgacaaaaaccacatgattatctcaatagatgcagaaaaggcctttgacaaaattcaacaactcttcatgctaaaaactctcaataaattaggtattgatgggatgtatctcaaaataataagagctatctatgacaaacccacagcctatatcatactgaatgggcaaacactggaagcattccctttgaaaaccggcacaagacagggatgccctctctcaccactcctattcaacatagtgttggaagttctggccagggcaatcaggcaggagaaggaaataaagggtattcaattaggaaaagaggaagtcaaattgtccctgtttgcagatgacatgattgtatatctagaaaaccccatcatctcagcccaaaatctccttaagctgataagcaacttcagcaaagtctcaggatacaaaatcaatgtgcaaaaatcacaggcattcttatacaccaataacagacaaacagagagccaaatcatgagtgaactcccattcacagttgcttcaaagagaataaaatacctaggaatccaactttcaagggatatgaaggacctcttcaaggagaactacaaaccactgctcaatgaaataaaagaggataaaaacaaatggaagaacattccatgctcatgggtaggaagaatcaatatcatgaaaatggccatactgcccaaggtaatttatagattcaatgcaatccccatcaagctaccagtgactttcttcacagaattggaaaaagctactttaaagttcatatggaaccaaaaaagagcccacattgccaagtgaatcctcagccaaaagaacaaaactggaggcatcactcttcctgacttcaaactatactacaaggctacagtaaccaaaacagcatagtactggtaccaaaacagagatacagaccaatggaaaagaacagagccctcagaaataatgccacatatctacaactatctgatctttgacaaacctgacaaaaacaagaaatggggaaaggattcccaatttaataaatggtgctgggaaaactggctagccatatgtagaaagctgaaattggatcccttccttacaccttatactaaaattaattcaagatggtttaaagatttgaatgttagacctaaaaccataaaaaccctagaagaaaacctaggcaataccattcaggacataggcatgggcaaggacttcatgtctaaaacagcaaaagcaatggcaacaaaagccaaaagtgacaaatgggatctaattaaactaaagagcttctgcacagcaaaagaaactaccatcagagtgaacaggcaacctacaaaatgggagaaaatttttgcaatctactcatctgacaaagggctaatatccagaatctacaaagaactcaaacaaatttacaagaaaaaaacaaagaaccccatcaacaagttggcaaaggatatgaatggacacttctcaaaagaagacatttgtgcagccaaaagacacgtgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacctaaaggattataaatcatgctgctctaaagacacatgtacacgtatgtttattgcggcactattcacaatagcaaagacttggaaccaacccaaatgtccatcaatgatagactggattaagaaaatgtggcacatatacaccatggaatactatgcaggcataaaaaaggatgagttcatgtcccttgtagggacatggatgaagctggaaaccatcattctcagcaaactatcgcaaggacaaaaaaccaaacaccacatgttctcactcttaggtgggaattgaacaatgagaacacatggacacaggaagaggaacatcacacactggggcctgttgtggggtggggggagtggggagggatagcattaggagatatacctaatgttaaatgacgagttaatgggtgcggcacaccaacatggcacatgtatacatatgtaacaaacctgcacaatgtgcacatgtaccctaaaacttaaagtataaaaaaaattaatttgctatatctttctcagtgaatccttgttgctttatgttagtgcttctcaaactttaatgtgtatatgattggctagatcagctgaagatcatgttaagatgcagattctgatttggtgggtctggaatgggacctgatctgcatttcttagaagctcgcaggtgatgtcaatgctgttggtctgtggctcattctcagagtagtatggtttgggaatccactgcctcctaaaaaaaaaaaaaaatgagaacttttcctgtccccagtcttcatcacccctccatttatccgtaattcctgaaagacttctttaatgtataagtctcatctacaaattatcttagtcctagatgtaaatttatttgatccaggggtcctgaacacttttatggcaactaagttacttttactcctaaccttggactttaatcctcttttagaattttgtatctatttaaaaaattctacaaacatgctatgactgtaatgaaaaatttaaaacaaaaaagatcacatctaatattattatcctaacaatctgcttttagttttttctttcctttaattccttatgcgtattggtgcataatttttcctagttacaatgttaacatttgtcatttatgttgttattggtgaaaggcgtcaggcccccctttttttttgatgctgattaggtaagcttaatcagttactgtttattccagtgacaagaatactaaatcaaataaacaaagggatcttgaattgcagttagactaccaagacagaatcagaaacctagagatagtgatctaggaaagtcaatgcaccaaataaaaatacagaacaagaatgtgggagatcagattgacattgccaaactaaaatgaagaagagaggagagcagcagcaggcttgtgaagtcaagatcagaatccttggaagtcacataagagatacagggaagcaatttgttcaggctcatcaagtaaaaagaaagaccagaaagccttgcatcttaaccattttattcccagctttcctgttgcataaagcctgatattgtttattaatataatagtttttgaacacactgttgaatgttataataaaatatttcagagctatctagattctacacattaaatgagttcctgaaaagttctgttcagagaaaatttgatatggtattatttttccataaacttacactatacaaataaaatgatttacctccaaaaaatgtttggctctaagatatgataaaattatacttaagaatgtagcagaattttacaattatatgtttaaatgaaatacattcttatgataatgtaataatacgtacttgaggtgagttgcagaaatggcatgctagctgagtgagaatatcctgataatatagaaaaagagataggtacaatattgaagacctcatactcaataataattcctttctgggatagatctaaaaggttatcagccactgagaaataaaagcaaacatcaactgacccttgagattttaattaatcatgtttattcagatattcccatgtaacagccactatctgagctcagtattggtgattggtatcaccctagatctttctcttctcctgcttcaggttgaatatccctgtaatgtattttgtaggacattcgtattttttgttgtaatgaacattacattatgagtttattttcaggaatcatagttccagtctgtaggaagtgaaggtggtacagaatacacactcagttcctgaatcttcagtatagataagttttgttgaaatagataagtttgtaggttttttccctagagggattggttttagggttcttgagatgggaaaaggagttttttttttttttaattatttcaacttttattttagatacaagggacacatatgcagcctagttacatgggtatattgtaccctagtagtgagcatagtacccaataggtagtttttcaacccacatgcccttcacctctcccccctctactagtccgttgtctattattcccatgtttatgtccatgtgtgctcaatgtttagctcccatttataagtgagaacatgtggtatttggttttctgttcctgttttaatttgcttaggattatggcctccagttacatccatgttgctgcaaagaacatgacttcattctttttatgactgcatagtattccatggtatatatgtaccacatcttctttatccaatccaccattgagggacacctatgttgattccttgtctttgctattgtgaatagcacagtgatgaacatatgagtgcatgtgaggttttttttgtataatctgttttcctttgggtatatacccagtaatgggattgctgggtctaatggtagctctgttttaagttctctgaggaatctccaaactgctttccacagtggctgaactaatttacatttccattaatagtgtataaatgttcccttttcttgcagcctctccagcatctgttgttttctgactttttaataatagccattctgactggtgtgagatagtatctcattgtggttttgatttgcatttttcttgtgattagtgctgatgagcattttttcacatgtttgttggcagcttgtatatcttcttttgagaagcgtctgttcatgtcctttgcccattttttaatgaggctatttgttttttgcttgttgatttttttaaaaaatcacctttctgacaagcttgttgatttttttaaagttccttatagattctgggatattatacctttgttagatccatagtttgtgaatattttaatattcttttgatagattttttttatgctgtgcagaagctctttagtgtaattaagtctcacttgtcaatttttggttttgttgcaattgcttttggggacttaaccaaaaattatttgccaaggctaatgtcaagaagggtgtttcctaggtttttaaaggttggttgctcctggagaaagagttcaattttccttacctcattgtgtgcactgacattcattttatcaacaaaaattgtgcctagtgcaacatgttgtctagggtctggttgtagatacaagaaatataacaaacacacatttccctagtgaatttatagcctactataataaattaagcatatatatgcttgatcagttgagtaacaataaaattcagaatatgagaaatgtatggtataggcaaaaacagtatatgaattcagagagagtgaaagatcactgttagctctattagtcagggaatgcttgatggaggaggtggggtcttagaaatggataagatttgcataggtgaaggagtaggaattactagcaggaagatcagagtgagcacaaggcaggtgtggggacaataatttagtccaataaagtatttagtatcgtttatgcaaagggtaccatgtggaaaacataggcaccacttgcaaagaatttacaagtcttactggaaagagagtatatgtaaagataataatataagacagcacatggaaaatggggataagtgacaaattggtataggaattcagaagaagcctagaccatcatggactaggaacatccgaaagtcttatttgaaggtgaggtttgagctggcctttgatggtagggtaggatttagaatagtggaaaggaagagttaggacacctgtggtagggactatagcataagtagatatggggacaacatggtctatttagaatatgatgactaatgaatccgagaggatttagcataagttttatataaggagtataatgaaatataaagttagagaagtaaattggagtcatttattaaattccttgatactgggttaaaggactatatgatataggcaaatggggacccactgaaggtttccaaataggatagtgacatgctaatagcaataatatgcaagaatttgagagatagggagattaattgagttgttgtaagtagctcaaatatgaagtaataagagcctgaaactaggttgatagcagtggaaattcattctttcacgtttgagttcctacaatgtaccagtcattttgttgctaggcattgaagatgcagagataaaataatatgcatgtccctggtggtctcaaggatatcactacttaatggggaagataagctcaaaattatgaaacaaatacaatcacagaatatttttataccataaaagggggggttagaggataatttatgaagacaaaactattctacttcttgcctacctatttggcattagaattaatacagttttgactgacttgccagctgcacactatccttaggacctatctttttttatatatactttaagttctagggtacatatgcacaaagtgcaggtttgttacatatgtatacatgcgccatgatggtgtgctgcacccattaactcgtcatttacattaggtatatctcctaatgctatccctccccctcctcccaccccacaacaggccccagtgtgtgatgttccccttcctgtgtccaagtgttctcattgttcaattcccacctatgagtgagaatatgcagtgtttgattttttgaccttgcaatagtttgctgagaatgatggtttccagcttcatctttgtccctacaaaggacatgaacccatccttttttatggctgcatagtattccatggtgtatatgtgccacattttcttaatccagtctatcattgatggacatttgggttggttccaagtctttcctattgtgaatagtgccgcaataaacatatgtgtgcatgtgtctttatagcagcatgatttataatcctttgggtatatacccggtaatgggatggctgggtcaaatggtatttctagttctagatccttgaggaatcaccacactgtcttccacaatggttgaactagtttagagtcccaccagcagtgtaaaagtgttcctattttttcacatcctcaccagcacctgttgtttcctgactttttaatgatgccattctaactggtgtgagatggtatctcattgtggttttgatttgtatttctctgatggccagtgatgatgagcatttttcatgtgtcttttggctgcataaatgtcttcttttgagaagtgtctgctcatatcctttgcccactttttgatggggttgtttgtttttttcttgtaaatttgtttgagttctttgtagattctggatattagccctttgtcagatgagtagattgcaaatattttctcccattctgtaggttgcctgttcactctgatggtagtttcttttgctgtgcagaagctctttagtttaattagatcccatttgtcacttttggcttttgttgccattgcttttgcataggaagaatcaatattgtgaaaatagccatactgcccaaggtaatttatagattcaatgccatccccatcaagctaccagtgactttcttcacagaattggaaaaaactactttaaagttcatatggaaccaaaaaagggcctgcattgccaagacaatcctaagccaaaagaacaaagctggaggcatcacgctacctgacttcaaactatactacaaggctatagtaaccaaaacagcatggtactggtaccaaaacagagatatagaccaatggaacagaacagaggcctcagaaataataccacacatctacagccatctgatctttgacaaacctgacaaaaacaagcaatggagaaaggattccctatttaataaatggtgctgggaaaactggctagccatatgtagaaagctgaaactggatcccttccttacaccttatactaaaattaattcaagatgtattaaagacttaaatgttagacctaaaaccataaaaaccctagaagaaaacctaggcaataccattcaggacataggcatgggcaaggacttcatgtctaaaggacctatcttttttttttaaacatttcctagtaaagccataagtcatacaaattagcacttgtcataaacgataaaagtaaggaatgtttctctcagattccagaataggaaatggaaagaagtgatggaagtgaaagacattatgatggaagaataaagaagatatgtaactgggtataggaggtggggaacagggagacagaagaggatagatagatggcaacagactcaagatgatgcagtgtcctggaggagctggtataaatagtatagaatgtatgtatacaatgtacttgaacagtaaagaatgaagattgagaaaaagaataatgatttcgagtactggactcagtagtaacttcaaacatctttataatagctatcattcactgaattcttactttgtaccagacactattctaagggcttttaatttaatatattatttaacctttcacaaatacactgtgaggtaggtactattagcatcttccacattatacagatggggagtatattagtccattctcgcactgctataaagaaatacttgaggctgggtaatttataaagaaaagaggcttaattggctcacggttccacagactgtacaggaagtgtggcagcatccgtttctggggagacctcagggaacttttactcatggcagaaggcaaagcaaaagcaggcatcttacatggcagaacaggagagagagagagagagagagacagagacagagagggagagagagagagagagagagataccacacactttgaaatgaccagatctcgtgagaactccatcatgagaatagcaccaaagggatggtgctaaaccattcatgaaggatccacctccatgattcaatcacctcccactaggcccgacctccaacactggagactacaatcgaacgtgagatttgggtgaggacacatgtccaaaccataccagggaagttaagaaacttgaccaaggtcacagagctagtaagtagtggagcaaggatccaaacccaggctggcaagtttcagaacctgtactcttaattgcagtgcgatacatatggcctatctaaagcaaatgtagaacagacaggagaaatgcgagagataaatgagatgttaggaattagagatagctgtagtagatcacctatctgtttggaatattttggcagtaaattggaaagaaaggataaaaatggtagagggacaaatgggaaaatccaaccccactaacaccagtataggggagattgtgcatgtccaaggcagaggaaaagtatcctatatggagggaggtatccagagggctaaaaagaaggtgtaattgagaaagttcaagctcctaatatataacggaagtagtatactgatagggagagggcactagctctaggatcagtaggcctggtttcaaatcctagcaattctctttactagctggcaggttgcttgtgcctcactttcctcatctgcagttttcttatatgtaacatgagatatgatattataacactttctagggttgttgtcagattacaagagattatgtacataaaatatgtagaagttataaactatgataggtattcactaattattaacttttttgattattatttgttgagaggcaatattgtgtagtggtcatgagtatgctgcttagatctgaatccttgttccaccattagccagctgtatgactttaggtaagtttttaacttctttgtgcctcagtttcctcattttaaaaatagagatatcaaagtacctacttcataaggttgctgtgaggactaaatgtattaatatctgcaaagtgttagaattgtgcctgatgcataataagcactatataaagtttgccactatataaagtttgctactactatgatttggggagcccttcatacgtagtggacaataaaccttgtctgttatatgtattgcaaatatcttcccctttctgtcttttaccctacagaggtcttaaaatttggtgaggatgttgagtgaaaaaaaaggccaatctcaaaaggtgacattacaggaatctatgtaacattcttgaaacaacaaaattatagagatggacgacagattaatggttgccaggaattagggatggtggggagaaggagagaagtagatgtgactgtaacagggtagcatgagggatatctttgtggtgataagacagttcttgtttgccatggtagttgcatgaatcttcatgtgtgacaaaatgacatagaactatatgcaggcaaacatctcagagatatgcatttggttccagaacactgcaataaagcaagtattgcaataaagtgagtcacacaattttttttatttctcagtgcatgtaaaagttaggttactatatactgtagtctattaagtatgcaatagcataatgtcttaaaaaccaaatgtgcatactttaattttaaaatacgttattgctaaaaaaaaataataatctgagccttcagtgagttgtaatctttgtgctaatgaagggtcttgtcttgatgttgttggctgcggactgatcaggatgatggttgctgaagttggggtggctatggcaattgcttaaaataagtcaacagtgaagtttaccacattgattgactcttcctttaatcaaatatttctgtgcagcatgttgtgctgtttgttagcatttcacccacagtagaacttcttgcaaaattggagtcaattccctcaaaccctgccactgctttatcaactaaatattataatatactaaatcctgtgttgtctttcaacaatgtacacggcatcttcaccagaagtagattctatctcaagaaaccactttctttattcatccataagaagcaacttctcatccattcaagtcttatcatgagattacagcaattcaatcatatcttcaggccccagttctaattctatttctcttgctatttccgccacatctgcagttacttcctccactgaagtcttgaacccctccaagtcatccttgacgactggagtcaacttcttccaaactcctgttaaatgttgatattttgaccttcttccatcaatcacaagtgtttctaatggcatctagaatggtgaatactttccagaatgttttcaatgtactttgtccagatccatgagaggaataactatctatgcagctatagccttgcaaaatgtatttcttaaataacaagacttgaaagtctaaattactccttgatccatggatgttgtattagcaggcatgaaaacaacattaatctccctctgcatctcccttagaactcttgggtgaccagatgcattgtcaacgagcagtaatcttttcttctgagcaatggttctcaacagagggtttaaactattcagtgagccatgctgttaacagatgtgctatcatccaggctttgttgttccatttatagagcacaggcagagaagatttagcataattcttaagggccctgggatttttggaatggtaaataagcattggtttcaacttaaagccaccagctgcattagtctctaacaagagagtgagcctgacctttcaagctttgaagccaggtattgacttctctctagctataaagttctagatggcatcttcttccaatgtaagaatgtttcatctatgttgaaaatttattatttagtgtagccaccttcatcagtgatcttagatcttctggataacttgccgcagcttcttcatcagaacttgctgctttgcattgtgcttttatgttacggagacagcttctttccttaaaccacaagaacgaacctctggtagcttcaaattttgcttctgaagcttcctcacctctctaggccttcatagaatgaagagagttaggacgttgctctggattaggctttggctcaagaacgtgctgtggctggggttgatcttctatccagaccactaaaactttgtccatattagcaataaggctgttttgcttttttatcatttttgtgttcactggagtagtacttttaattgccttcaagaactttttgtttgcagtcgcaatttggctgtttggcacaagaggcctagctttcggcctagcttggctttcaacatgccttcctcaccaagcttaatcatcactggcttttgatttaaaatgagagatatgtgaatattccttgtacttgaacacttagaggccattgtagggttattaattggcctagtttcagtattgctgtgtctcagggaataggggtgcccaaggaaagggagagagatggggaataattagtcaatgaagcagttagaacacacacatttgggcttagtttatggtaccccaaaacaattacaatgttgacatcaaagatcactggttacagttataataataatgaaaaaaattgaaatattgcgagaattacttaaatgtgacagagagacacaaatagagtgcatgctgttggaaaaatggtacctgtagacttgacttgcttgattcagggttgccacacatcttcaatttgtaaaacaaacaaacagaacagtatctggtggcacgtgcttatagttctaactactcgggaggctgagactactcaggaggcttgagccaggagatcaagacggcagtgagctatgatcacagcacttcactccagcctgggtgacagagtgagaccctgtttcaaaaacaaacaaacaaacaaacaaaaaactagtaactgtaaagtacaataaagagaagtgcaataaaatgaagtatgcctgttcacacatcgtaccaatgctgtttcctgctttgatattgttctatagttatataagatttaactataggaggaaactgggtgagggtacatgggatttccttatacattttttttttgcaatttcctgtggatctatagttatttcaaaggtaaaagttaacaaagttttgatgaaattaaattgtcagccttctttttttatgacttgtggattttgtgtcatgcctagaaaggccttttgtaaaccaagatgataaaaggtatctcaagcaacaatctattagaaaatgatgatgatgatgatgatgatgatgaccataaacagatccagtgcatggtgacaaacagtttaaaggcttttatcgtttgttttctacatttactttctttcctcatgggtcactttgttcattttggtgcttctctttaaggttgttcattttcttcaaatgtctagtttcttcagatgatcttgattctcttcatatttttaaaagaaaagatctgctaccaatagtttgtggtttgatcctttgacatcctttggaataacttcccacatgagtgttccggctagccgcgggtgtctccactctgtcatgtagacaggtgggatttcgttgggtctttgggttatctattgttgtgtagcaaaccaccctaagatttagcagtttgaatcactagtttattattatctcatggtgctgtgggttgattgggctcaacttaggtggttattgcctggagtcttacatggttgcagtcagatagtggctggtgttagagtcatctaaattttagattctaaaggcttggatgggctgaacactctatgttttcttcactcatgtgtctgttgtctaggctggaagtcactggatgctacccagacatctctgtctctttcttcatgtgtctaggttagaattcctcccagtgttacatcctcagggtagttggacttcttactgatgattagcttcatccaaagttccaagagaccaggcagatactgcaaggcttatgtcttattagaagtcatgcattgttaaaagcaagtcacagagccagtctagattcaaggggagaggactacaagggcatgaatactaggaagcataatttattgggagtacatctttagagactagttattacagtgggctagagacactagcccccacctccatcttgatatgcaaagtaggaaattagttctcttgccatataaggattttcactactgtgctgattgattttcctctttactccttttctcatatctacagtcttcctgtcccttatgctcaagctgggaggttcccataactgatcccttaaatcatttagaaggtttgacagcagagcctggggtcaaacatcaatggcctctactccttgcatgcacaacagagaattggaatagtttctgcagttcctctaggatcatcacaaatttttcctgtcccctactaattaatttctaattttgtggagtttcctagggtgttttttttttttgctggggggaacctatctatttcttcaatggcctcctttttggcttctgttgggtttcaggattctcacctcttgatttttccatcagtctgattgcttttaattatagaaattctttaaagtttcttaccaaagacaatatattttcctgctctctggctctactatagatttattcttacattcattctatttttttgaggtaaataactgtactcaatctgctgttttaaactgaaggttagatagatggaataaaatctagcattcagtagcacaatagggtgactatagttagtaataatttattgtatatttcaaaacaactaaaagtgaaattgggacattcacaacaaaaagaaatgataaatgcttgaggtggtgggtatcccaattaccctgaattgatcattacacactgtatgcttgtgtcaaactattgtatgtaccccataagtgtgtacatactatgtacttataaaaatgtacatattatttacttataataataaaaaataaaaataaaatgtaaatctaaacaagcttcttcagaaataaataaataaaaattaactattcatccagtatagaataattttaaaatgtggactttggcgtcagattacatgttttcaagttcttgttcctccactttgcagatgcttaaccttatgcaaattatttaaactatatatgcttcagtttactattcatgaatagtacttacctgttggggttttctgaagattaaataaggaatgtaaaattcctggcatatgataagcattcaacactttagctgttatcatttctggaaaagtattagaactaatacaataaacataatatttcattccaagttgagctgtatgtctgtggaatagaattcaaatccatcattttacataaggttagtattcctggacaagatcatgctgcatttagcttctttagcagttttatcagcacttgtgagctatgtctaagagtaaattgcaagacagttttactaacactgagcccatttacaggcattaaagtgatgattgctaaaacaccatttagcatgagcagtgagtatatgttagcaagaggtgacatgtggtatattggaacgagtccttgctactaactaaatgaccatgcgacctcagacaagtcatttagcttctcagggccagtgacaagcagaataatgtccccaaaggggcttccatgccctaatctctggggctgtgagtatgttaccttacatggcaaaattgattctgaatatgtaattaaagtcactaaccagttgaatttaaaatagggagatcatcctggattatctaggtagccccagtataaccacacaagctcttaaaagcagaagaggaatacagaaaaagtagtcagatagattcaaagcacaagaagtatttagcacaccattactggctctgaagagagaatgaaccataagccaaggaatacaagtggcctctaggagctgacacaaatcccagccaacagccagcaaggaaatgggacctcagccctagaatctcacagaactgaatttcgtcaatagcctgaatgagcctagaaatgtattctcccccaaagcctccatataagagcccaggatggccagtatcttgcctttggccttgtgtgagcctaagcctgaatggatttctgagctacaaaattgggaaataataagtgagtattttggggtttttttgttgtttgtttgtttgttcgtttgtttttgagatagagtcttgctctggcacctaggctggagtgcagtggcgtgatctctgctcactgcagccttgacttcctgggctcaggtgacccttccacctcagccttctgagtagctgggactacaggcgcacaccaccatacctagctattttttaattttttttgtagagacagggtctcactgtgttgcccaggctggtcttgagctcctgggctcaagcgatcctcctgtcttggcctcccaaattgttagaattacagacatgagccatccacctggtgagttttgttttaaatcactaagtttgtggcaatgttttacaacagcaatagaaaactaatatgaggccttagttccttttgtaaatgatggggtaggaggcagtgtggaggaagtcagaataaatgaactttaaggttccttctagctctaaattctgtgattgcaagattcttattcagctgctagtttgtgagctaaagtccagcaaccataagtagtatggacacacacacacgtacacacacatatatacgtgagcactttcaaggatacatatgaatatggcaaagctaaagttttaggggactccatagtggcagatcaaccagatagatattggagtgggttttgcaactgcaaagcaaatggttgcaaccagggttaaggtttttcaggtagatcctgaaactaagaatcaatgaaaaagtgactttatatgtgcacagttttcataccctgaaatggaaaaatgatcattattattaaactagaaggtcagtggtgtctgtatttgcgttataacaatttacagttcttattcttttaaagaatcaattatgtaccccatatttctaatacatagtgaattctcacaatttgctatatttggcaaacatactctttgttttctatgaaactaactccaaggagctgagattccagtaaaacctggaaatgaatagtatattccttagagatgtaaacctctttagagcaatctccagggttctctatgcaagttgacactaaatttataatgataattctagctggccttcccacccacctctagcaattatgcaaagaaatgcccaattttatgttatattgttgttttttaaaacagctttatgaaggtgtaatcaacctacagttaaatgcatatatttggaataagtgtacaataagctttgattacacatacatacttatgaacccattatcgcaatcaggataataaacatatttaccacccccaaaaggttccttgtggtcttttgtaatctctccctacctctccttcatcagacagccattgatcactgaatgtcactatagcttcatttgtattttctagatttttatataaatgaaattgagtatactttttagtctggcttctttaactcagtatgattccctgaggtccacctatgttgttgcatatatctgtatagtttatacttttttattgctgagtagtagtctgttgtatggatagcctacaatttgtttatctattcagctgttcatagacattttgattgttttcagttttaggacattacaaataaagctgctgtgagcattcacgtgtgtctctttgtatggacatttgctttcatttcttttggtaaatacatagaagtgaaaagtctggtttggatggtaggtagtgctatggtttggatatggtttgtccccagcaaaattcatgtttaaatttgttctccaatgtggcagtgttaggacttgggaggtgtttgggtcatggaggtcatgaataacttggggctgttcttgcagtagtgagtgagttctcgtttcaagaggctggatgagtccttacagggatgaatcagttctgaggagagtgggttgttataaagccaggatatcacttgggttttgcctctttgctcctatccgcttcccctttgaactttctccaccaagttatgatgtagcacaaaagccctcattagaagtcagggccacgctatcatactaaaactgtgagctaaataaacttttctttataaattacacagtcttaggtattctgttacagcaacacaaaatagactaatacagtgctatgtatttaaattttcaagaaattgccaagcttttccaaagtagttacaacattcatttaacattcctaccagcagtgtttgagagtttcagtttctccacatcctgacccacatttggtatagtcagccttttaaataggtatgatgtctcattgtggctttaatttgcacttttataatgactaataatgttgagcatttttttcatttgcttttcatgtgtgtatccctttttgtgaaatgcctgttaaaatcttttgccctgttttgtttgtttgttttgttttgttttgttttaagtattgagttagaaactcctttcaggccaggcacggtggctcacgcttgtaatagcagcactttgggaggccaacgtgggcagatcacgaggtcaagaggttgagaccatcctggccaacgtggtgaaacctcgtctgtactaaaaatacaaaaattagctgggcatggtggtgtgcgccagtagtcccagctactcaggaggctgaggcaggagaatcacttgaacccgggaggtggaggttgcagtgagccaagatcgcaccactgcactccagcctggcaacagagtgagactccatctcacaaaaaagaaaagaaaagaaaaatgaagctcctttcaatatttggggttttttttaacttttattttaggttcagaagtacatgtgcaggtttgttatacaggaaaacttcctttcaatattttgtaaacaagatcctttttcaactttattgaagtataattgaaaaattgtatacagtcaaggtgaacaatatattttgatatatgcatacattgtgaaatgattaccacaatgaggctaattaacatatccatcacctcacatagttacttctttgtgtggtaagaatacttaagatccactctcttagcaaatttcagtacataatatattattgttaactatagtcaccatgctgtacattaggtcaccagaacctattcatcttgcataactgcaagtttgtaccctttaactaaaatcttcctacccacccctcaccccagccctgccactactgcccttggtgaccaccattctaccttgtttcaatgagtctgactttttgagagaccacatataagtgaaatcatgcagtatttgttgttctgtgtctggcttatttaacttaacataacatccctacaagttcatccatgtttttgtaaatgagggaatttctttctttttaaggatgaataatattccattgtatataaatatataccacattttttaaaccattaaccactaatcatcaaggaaatacaaatcaaaaccacatgagatatcacctcacacctattaggatagatactttttttaagaaaagataacaagtgttggcaaggatgtagaaaagttggaatttttttttttgagatggagttttgctcttgttgcccaggctggagtgcaatggtgcaatctctgctcactgcaatctccttctcctgggttcaagtgattctcctgcctcagcctcccaagtagctgggattacaggcgtgcaccaccatgcccagctaatttttttgtatttagtagatacggggtttcaccatgttattcaggctggtcttgaactcctgacctcaggtaatccacctcggcctcccaaagtgctgggattacaggcgtgtgccactgcaccctgccagaagttggaatttttgtacagtgctggtgggaatgtaaaatggtagaacccctgtggaaaacagtatggcagtttctcaaaaaattaaagatagaactaccatatgatccaggaattctacttttgggtatataccccaaagaactgaaagtaggatctgaaagagatatcttcactcccatgttgattacagcattattcatattcactaaaatgtggaaggcaacccaagtgtctattagtggatgaatgggtaagcaaaatgtgatatatatatatatacatatatatatacacacacgcaaacgtatacagatacatatatatgatggaatgttattcaaccttaaaaagaaggaaatcccactatttgtgacagcatggatgaaccttgaggacattttgttaagtgaaataagctagtcacaagacaaatactgtgtgattccacttctgtgaggtatctaaaatagtaaaactaatagaaacagaatagaatggtggttactaggggctgggaggtgggggagagggggtattgttgctcaatacgtataaagtttcagttacacgatatgaaaaagttctagagatctgtacaatgtagtgcctgcagctaacaataaagtattgtgcactcaaaattgtgttaagagggtagatatcatgttaagaattcttacaccaaaaaacaaaagaaaaaaagcacagagacccaagggagcttttggaggtgacggatatatttattacattgattgtggtgatatcttgagtgtgcacatatgtcaaactcatcaaattgtatacattaaacatgtgcagtgtttattgtatattaactataccacaataaaaataaaaaatatagccactcctacttttgattaatggtttcatggtatatttttttccaaacttttattttcaaccctcctatatcagtttttttgaagtaagtttcttgtacacactctacagttaggacatgtttgggactttcccctacctttttgagatataattgacaattaaaaattgtgtatatttaatgtgatgttttgatatacctacatattgtgaaatgattaccacaaccaagctaattaacatatccacttcatggttacctttttttatagagaggatacttgagatctgttcttagcaaatttcaagtatataatacattattattaactatagtcgccatgctgtacattaagtctccagaacttaatcaatttttaacttaaagtgtatatcctttgaccagcatctcccccattcccccacccaatgaaactctggtaaccaccattctattatctattactatgagtttaaacttttttttagccttcacatattagtgagatcatgtagtatttgtttttccgtgtctgacatatttcacttagcatagtgtcctccgcgtttattcactttgttgcacatcacaggcttctttcatttgaaggctgaataatattccattgtatgtatatacatcacattttacttatccattcatctgtcaatggacacttgggttacttccacattttagcacatgtgaataatgctatgaatatgagtgcacaaatatctgttcgagaccctgctttcaattattttggatatgtacccagaagtgatattgctgtgtcatatggtagttctatttttaattttttttgagaaactgccatattattttccatagtggctgtaccattttacattcccaccagcagtgcacaagagttccaatttcttcacatcctcaccaacacttatcttttgactttttcacaatagccatcctaacaggtagttttcatttgcatctccctgatggttggtgattttgagcatctttttaatatcttttggctatttgtatgttttctttgggaaaatgtctgtacaagttctttgcagatttttaaatcaggttgtttgatttttttccccttgagttaaatgagttccttacaattttagatattagcctcttattggatatatggtttgcaaatattttcttccattctgtaagttgccttttgattttgctgattgttttcttggtgtatttttttttagtctatgctgccaatttctttcttttaattggcatatttagaccatttacattatttgtaattattgatgtgttacagcttaagcttgccacttaaatttttattttctgatctatatacacttttaaaacctttttaaaaatatttatttattagagacagggcctcactcttagcacccaggctggagtgcaattgtagctcactgtaacctcagactcctggactcaagtgatcttcctgcctcagcctcctgagtagccaggaccctaggcacacaccaccacactcagctaattttctttttctttttaatttttttgtagagacagggtgtcttactatgttgcccaggctcgtcccgaacttctggcctcaactgatcctcctgtcttggcctcccaaggcacggaaattacaggcgtgaaccattatacctaacctctgctttatattttagtttacttttagttttacagaaaaattgggaagatagtacaaagagttgccatatacactctacacagtttcccctagtattgccatcttatatagtacctttgtcataagtaatggaccaatattgatacatcattattattaacctaaaatcaatggttaattccaatttcctttgttgttacctaatatcctttttctattccagaatcttacctgtgatatcacattacatttagttgtcatatctccttggacttcatttggccatagtagtttcttagatatatttttctttttgatgattttgacagtcttgagactacccatcaagtattttgtaggatacctatgtattagattttttctgatatttttctcatgattagactggggttatgggtttggggaggaagatcactcagataaagtaccattttcattacatcgttatcaagggtatatactgtcaatatgatttatgtatgttgatattagccttgattagttggctgagtattcatcaagtgtttacaccttgaagttatccatttttcctttttacatactatattctttgcagttgtggagttatgctcccctgcttaaaggcatacttatctagataaattattttgaattcttctacatgggaaatttgtctcttctccctaattcgttaatttgttcaaccatttttatatcaatacggacttgggaatatgtattttattctttaggttataattcaatactacatttttgttgttcagattgttttagctttggccattgggagctcttttaattgactcctgcacccttttgacataccccaatcagtgtgggtggttttgttttttataagcaattcctttctttctgacaacacagaatgttctaggttcatcttgcacatttcttgccccaatcctggaatcaaccatttctcctaggaggtctagttcctctcactggcaaagtatattagtaaccaagatctgaatgttagttgtgcttgttgctactggggtgtcatttcttctaggccttattagttgacggagcaaagaaaatatatgtgtgtatactaatctgagtatatagacatatatatataaatattttggtatgtaaacatctgtatctatattaagttaaacgtaagttattactgatgtttcctattctaattcattagcacttagatcattctagccttgcttgcagattacccttgcttatctgttcccaatccaacagtgggaaacctggctcttaccatccatcattcatttacttaattttttaattgttcaattttagtatacatgtaaagcagtatcagaattgttcacctgtaccctcatgagaaacaactttgtcaactagagtacagtgcttatgtgcagttctttttgcctttattcttacagactctacttatttccagagttacttaggtcagtatctagtcctcctatttcctttagtgaagttgttccacacatttgttagagtctcttgtcacagtctctattatatctgaggattcccccaacctcccaaattatatatatatatataaaatatcaaattatatataatatatataatacctagttatatataactatatatataatttgtatgcattgagattgacttgttgtgtggtaaagtcctgtggattttgacatgcataatgacacgtatctgctattatagtatcacacgtagtattttcaccatcctaaaaatcctctgtgcctcatctcttcatcttcctgagatgctggcaaccacatcttttcactctctatttttcttactggctcttctttttgcttttgtgccatttctgcaatgtcacataattggaatcattcagtatgtagtctttttagattggcttcttccacttagcaatatgaatttcaggttcctctatgtcttttttgtgactgatagctcatctctttgtttatctatttacctattggaggacatcttggttgcttcctgtgtttggtgattatcaataaagttgctgtaaacattcacgggaagatttttgagtagatctaagttttcaaatcaagtgggtaaattcctagcagtgaaatggctcctgtaggtaaggtatcatttctctttctgtgcattcaagatttttttctttgtcttaggatggaatttgactatgacatgtcttaggatggaatttctttggatttatcatgtttggagtttgcaccgctctttgaatctctaggtttatgttttttcccaaatatttgagacattatttctttgaatatttatttgttctgccctacctttcttctcctcttccagggttctgatgacataatgtacattttttgttgtcttacacgtcgctgaggctccatgcagtttttttttcagtctgttttctctctgttgttcagatgaggtaatttctacttttttatttttccttctccttccttccttccttccttttctttctttttcttcctttctttcctttctttcttttctttgaaacaaggtctcactctgttgcccaggctggagtgcagtggtataatcatagctcactgcagcctcaaacacatggactcaagcagtcctcccacttcagcctgccaaatagctgggattacaggcaccaaccactgcacataactctactttatttcaaattcacttattctttcctttgtcctctccattctgctgtaagctcatctgttgagttatttttaagattttggttattgtatatactagttttctgagtattgtaacaaattaccacagatgggatgacttaaaacaacagaaatttattctctcacaattttggaggccagaagtccaaaatcaaggtatttgttggctttttttttttagattaaaaagacttagatattttaatcaattgaaatgtatgaatcttattcagatcctgagtcaaacacttaaaatcaataatgtatgagacagttacataaatgtgaacagtaattaaatacttaagaatattgaggatatcttgttaagttttaaactgtaatgatagtattatgtttatgatttttacaaaaaatagtttctatctttaagagatagataattaaaatacttggaagtggattaataggatgtcttgaatttacttcaaaagcatgagtgtgtgtgtgtgtctgtgtgtgtgtctctgtgtgtgaatgaggtggaaagatgggttaaataaaattggctttgatgttgttacagcctgataataatgatgtgtaggttcattacattattttctccactttggtatatatttgaaatttgtgtagcagagagttaaggaaatacttattgattcaaagtaaaccgatctaatcataacccttgcaaatggatgtctacctatgtataaataaggtacttctttttttaaaactatgggtctctttttattaaggcgagatctcttgcaactggtgtttcatgaatagagttgccagataaaatacaagactcggttaatttgaaatttcagataaacaatgtctagtattttagaataagcacatcccagctattgcactggacacactaatactaaaaaaataatttttgtttatctgaaattctaattttactggggcattctgtattttttttttttttttactttaagttctggatacatgtgcagaacgtgcaggtttgttacataggtatatgtgtgccatggtggtttgctgcacctatcaacctgtcacctaggttttaagccccacatgcattagctatttgtcttgatgctctccttcccctcaccctcacctcccgacaggctccagagtgtgttgttcctttccctgtctccatatgttctcattgttcaactcccacttatgagtgagaacatgtggtgtttggttttctgttcctgtgttagtttgctgagatgatggcttgcagcttaatccatgtccctgcaaaagacatgatctcattcatttttatggctgcgtagtattccatggtgtatatgtaccacattttctttatccagtctatcattgatgggcatttgggttggttccatgtctttgctgttgtgaatagtgctgcaataaacatacgtgtgcatatatctttataatagaatgatttatattccttgggtatatacccagtaatgggattgctgggtcaaatggtatttctgattttagatccttgaagaatcaccacactgtcttccacaatggttgaacaaaagctgaaattgacaaatggggtataattaaactgaagagcttctgcacagcaaaagaaactatcatcagagtgagcaggcaacctacagaatgagaaaaaatttttgcaatctacccatctgacaaaggtctaatatccagaatttacaaagaatttaaatttacaagaaaaaaaaaaccttgtcaaaaagtgggcaatgaatatgaacagacacttctgaaaagaagacatttatgtggccaacaaacatatggaaaaaagctcagcattactgatcattagagaaatgcaaatcaaaaccacaattagataccatctcacaccagtcagaatggcaattattaaaaagtcaaaaaacaacagatgctggcgaggctatggagaaataggaacacttacactgttgatgggaatgtaaattagtttgacttttcattttattgaagttttctttgcagtgcagaagctttttagtttgacatagtcccatttgtttgtttttgctttaaaaattttttttgcctttgcttttggtgttctatacaaaaaaatccttaccaaggccaatttcaaagagcttcttccctatttttttcttttaggagttctacagtttcaagtattacatttaagtttttaatgcactttctgttgatttgtgtgtgtgctgtaggatgtgttcaatttattcttttgcaggtggatgtccagttgtccaaacacatttttttttgagacagagtctcactccaacacccaagctagagtgtggtggcatgatcttggctcactgcaacctgtgtctcctgggttcaagtgattcttgtgcctcagccctccccgcatagctggaattacaggcatgtgccaccacatccagctaatttttgtatttttagtagagatggggttttgccacattggccaggctggtctcaaactcctggcctcaagcgatccaccaacctcggccttctgaagtgctgggattacaggagtgagccactgcacccagcccaagcacaaaagagactgtgctttttccattgtgtattttgggcacctttgtcaaatactagttggctatatatacttggttttttggggtttttttctgggctctcgattctgttccattggtctatgtgtctgtttttatgccagtaccatactgctttgattactatagctttgtagtataatttgaaatcagaaagcgtgatgcctccaattttgtttttgtttttaaggttgctttggcacagagtcttttgtggttccatacaaattttaatattagcttttctatttctgtgaaaaatgccattggacttaagatagggatttccttgcatttgtagatcactttgagtagtgtggacattttaataatactaattctttcaatcaatgaacacaggatatctattttatttttgttttcttcaatttcatcaatgttttttagttttcagtgtacagatgtttcacctacttggttacttttattcatatatatttgagatggagtctcactcactctgtcacccaggctggagatctcggctcactgcaacctccacctcctgggttcaagtgattctcctgcctcagcctcctgagtagctgagattacaggcatgcaccaccatgcccagttaatttttgcatttttagcagagacagggtttcaccatgttggccagtctggtctcgaactcctgacctcaagtgatccaccctcctcagcctctcaaagtgctggaattacaggcatgagccactgtgcccaactattttatatatttttgatgctattgtaaataggattgttttcttgatttcctttttggatattttattgttggcacaaagaaacgcttctgggttttgtatgttgattttgtaacctgcaactttactgaagtaatttattagttcttagagttctttggtggagtctttagagtcttccgtatataggatcacttggtcccatggaaacagttttttagctcttccatttgggtctttgatccattttgaattaatttttgtatatgatatgagataagaatccaatttcattcatttgcatgtggaaatcccgttttcctagcaccatttgctgaaaggactgtcctatcaccatttgctgaaaggactgtcctatcaccattaaatggtcctggcacctttgtcacaaataatttgatgatatataacaagatttatttctgcgttctctattccattccattggtctatatgtctatctttatgccagttccacacattttcattactatggctttgtaataagttttgaaatcagaaagtacaaatcctctaattttgctctttgttttcaagtttgtttagggcttttggggtcccttgagcaaagtccatattaattttaggatggattttttccatttctgcaaaacacatcattgggattttggggtttttttcagacagggcctcagtctgtcgcccaggctggagtgcagtagcccgatcacagcccactgcagccttgacctcccagggtcaggcagtcctcccacttcagccttgctagtagctgagactacaagcatgcgccatcacagctgccaattttttgtagagacaggcttttgccatcttgcccaagctagtctcaaactcctaggctcaagcagtctgcccacctcagcctctcaaagtgctgggattacaggcgtgaaccaccacacctggcctgggattttaatagggataaatatctgcaaatctgtagatcactttgggaatatcaacacattaacaatatttagtcttccaacccgtgaactgtttacatttttaaatagaagatactagtgtattatttgtgtaatcaaacataaacaagtttttagaaagaggttttggccgaggaactagtaaatttctcatgtcttttcatgtaacttcactggatctcggtaaccaatttttaaagcttgcaatcagttctgggaaaaacataaattagatattaggagagaaatgattatctgactataggtgttaatagaaaatgtttatggcttaataaactgaaattaaattaaatcatgtaatattgacaaattaagcttatttagacatttaataacattacctgagttcagatatgcttttatctggcttattttgctcacactgaaatacattttagtcccattgatcaataaccagtttttctgttcgcattgcttaaaattgtgtctcattgtacagagaatctgttgggtttcatttcctgacgattattcatgaacgttttaagtcatcggaaaatattggaaaagttctgatactccatactgacatgcttttacaaaggaaggaagaacttcttgccaaggagaagattgaagaaatctttttaggtcagtaggattttcgcaagtgttttagaaacgtattaatttgtgtataattcttagatgtcagagtaatagcaaaatcctcaagtcaatggatttcttccacttcctttttttcttcctccctaatggtcttttaacagtaacacctcacctgtccacatcccacaaattgggcaagtggaatgagaaactaagcaaaaataagaaaccatcattgaaaacagacaaacttctgagcttaaagctcacatgtggtggaatattgtgaggttacaagcctaatttaatatctctagtttgatctcaatttagctgtgtacctttgaacaagtcaaaggaccttgatttttttttcaactataaaatgatgattgtgaactaaactcctggtttctaacttcttttcagcagcagcatccttttgtgatgcaatcttatatgaaccccaccctgaatgaaatagattagagtttttctggttaaagcagagatgtagagccaaatctgctcagcattcccctaatcctctgcctccctgcagaacttctgtaccctgaagaacacagatagtaagatccctttcttagaaaattctcttcaccacttcgtccttccaactaagtgcatgtagagatataattggagtgatagtcactaaatgttaactctggggtttattctgaatggtggcattttaggtgacgtgttgctttcttctaaatactctaccatattgtttgaatttttataagcacaattcatgtttctataaaaacaaagtcattaattttttaaaggaagtcatctgagtagatgatctctaagagccatattttactgataacaccctccctccaggcatttaccaattatttttagacccagttttgataaacttggttatccggttttcctactcttaacattttgatggtagcactttgcaaatagagaaaaggtttaaagggaagtatacagatagcctgaccatagggaggaaaaaaaactctaccaattttataaaacagattcaaatttttaatacaacaatctgtactgtataacaactcccaaaggcatcactgtgatatattaatagtacaataaaataaaatagttgttaatgttgacctcaagtggtcaagaaaaagttgaattatgcttaagaaaactaggaagtttgtttactttttagaaaatttaagaactttcatgaaaatattcagactttttaaattcagaagtgatttttatttaaagaaagtaaactgccagttgaccagaaaacttgattacacagaattactcattttcctaaaattccacttagactgttctattatgacatctaagttacacttacactctcaaagtattataatatttcaagtagatacatttagtagctgtttactctcatgtgagtatttttaagtaagtcatggaacaaactacatttgctgactgggctagagggtcagagattcctaatgttctagtcaagacttttgtggaaattgatagtttatgccaaagggcagaagaggaggtgcagaattctattatagtttagactttaccttaatgtgctaatgtatttgaactctgtaaatgtctagaccagaaacaatcaacgcaagttaagatttaaagtaataaagtttatgtgtaagcatggtcttaaagtattttacaaaggctttaaggcataattggcctttcttgtgaacttgatctgatctatttagcacataatagtataagcacttcttattaatgatttctggcattgctgtctgctcattcacaataaccttattaaggcaccagatgatgatctaatttggaatgtggaaaatcagttaaaaagagagtaggctggaaaactatcacagattgatgggagaattactgtgattctagcaaactctgattgcattatattatcaattatggtagtaaacctaaaattgatgatgaaaacctgtctgaatttttttgtgtgtagccattacttaaagattataggttctgagtatagttagctctctttacttaatgtaatagaccgagattctttttttttttttttttaattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaaggagcatgctgccttcaagcatctgtttaacaaagcacatcttgcaccgcccttaatccattcaaccctgagtggatacagcacatgtttcagatagcacagggttgggggtaaggtcacagatcaacaggatcccaaggcagaagaatttttcttagtacagaacaaaatgaaaagtctcccacgtctacctctttctacacagacacggcaaccatccgatttctcaatcttttccccacctttcccccctttctattccacaaaaccgccactgtcatcatggcccgttctcaatgagctgttgggtacacctcccagacggggtggtggccgggcagaggggctcctcagttcccagtaggggcggccgggcagaggcgcccctcacctcccggacggggcggctggccgggcggggggctgaccccccccacctccctcccggacggggcggctggccgggcagaggggctcctcacttcccagtaggggcggccgggcagaggcgcccctcacctcccggacggggcggctggccgggcggggggctgacccctcccacctccctcccggacggggcggctggccgggcggggggctgacccccccacctccctcccggacgggcggctggccgggcggggggctgacccccccacctccctgcctgacgaggtggctgccgggcagagacgctcctcacttcccagacggggtggctgctgggcggaggggcttctcacttctcagacagcgcggctgccgggcggaggggctcctcacttctcagacggggcggttgccaggcagagggtctcctcacttctcagacggggcggccgggcagagacgctcctcacttcccagatgggatggcggccgggaagaggcgctcctcacttcctagatgggatggcggccgggcagagacgctcctcactttccagactgcgcagccaggcagaggggctcctcacatcccagacgatgggcggccgggcagagacgctcctcacttcccagacggggtggtggccgggcagaggctgcaatctcggcactttgggaggccaaggcaggcggctgggaggtgaaggttgtagcgagccgagatcacgccactgcactccagcctgggcaccattgagcacggagtgaatgagactccgtctgcaatcccggcacctcaggatgccgaggctggcggatcactcgcggttaggagctggagaccagcccagccaacacagcgaaacctcgtctccaccaaaaaaatacgaaaaccagtcaggcgtggcggcgcgcgcctgcaatcgcaggcagtcggcaggctgaggcaggagaatcaggcagcagtaccgtccagcttcagctcggcatcagagggagaccgtggagagagggagagggagaccgtggggagagggagagggagagggagagggagagggagacaatagaccgagattcttattttcagagctttttttttttttcagctcaccaaacaggaagacaactgacagcagaatcaatgaactggttacacaacattctgtggagacaagctgccagtagttttgaggtttgagaataatctctttttcattctttatttctccactgcaacaaaaaatagtgcattcactataaaaataaaagagcatcaaatacttcaataatctctgtctgtttagataccatatatttattaaatattcacaatatagagtgttaatgagcattgtgcaagagtttattaaaaataataagacatgattcctctccattgagagcttacagtgtagggaaatgtcatcgctgatattaagatataagaatgtaatttttttaacatgagggctgagaaagagttttattccctttaaaaacttaatggtgtaataaaaaatggaaaaaaaaacctttacaagacaactcaggtttcctgtaaacctaaagataagtttttttaaagcaaagaacaatcatttataattttggtatatttccttctaatctttgtgtattatacatttgtgtccctgtgtatataaatcagatgggacgtaccattaaaaaaaaagttgtgtttgcttccacttgcaattaatatgtagtaacagggactgttttatgtcccttcttgaacaacaagcccctctccacaaaggacaagacaaaatagacgaaaagaaaaaaaaaggcttttatgaccctgaacatcaggcaatgaaggagaatggtccctgggagataagaaataaagcgagcattggccgggcgtggtggctcacgcctgtaatcccagcaatttgggaggctgaggtgggcagatcacaaggtcaggagatcgagaacatcctggctaacatggtgaaagcccatctctactaaaatacaaaaaattagctgggcatggtagcacacgcctgtagtgtccgctactcaggaggctgaggcaggggaatcgcttgaacccgggaggcagaggttgcagtgagccgagatcgcgccactgcactccagcctggcgacagagcaagactccatctcaaaaaaaaaaaaaaaaaaaaaaggaaagaaaagaaagaaagaaagtgagcattacaattgtgcagcttactgctttgagtttccagggtatagcacaagaaggggatctgaagcagagcctggcaagcgtcctgatttgagatgcagctgagtctgaggagaccaaggcagccagaatttataagacaaagtactgaagaggaccacatagcgtagattaggcattgtaaaagaaaagattgataaacttgaagtcagagcaaagaagctattcaaaattaaacacactgaataaaagacttaaaagagcttcagtgagatgagggtcctcttccaatgtttaacagagttctgatcaggacatacatgaagcaaaattacctgaagctaggagaataaccatctaaaaatattagcgggaacagtgcctagcactcacatggggttgagaataaggcctgttcttatcacccagtctggaaaacctctaattcatggggcattgggaagaaaactcagaagggtcttgtctcagaagaggggaataattagtcctacactaagtcctgctccagaactaccttaaaaattataaacctatggtgtgaaaggatcaaattgatcccaaggaacttaattgcttcccagagcagagttcaagaatatttataggaatataaaactgtacagcacccaacaggataaagtttacaatgtctggcatccagcaaaaaaattactgagcatgtgaagaggcatgaaaatgcaacctataatgaggagaataagcaatcaatcgatactgacccagaactgacatagaagttagcattaacagaggacatctcttataattgtatttcatgcattcaaaaagttaagtggaggcatggaagatacgtaaagacccaaatcaaacttataaagatgaaaactctgtttaggatgagaagcacattggacagtattaacatcatattagacattgtagaagaaaagactgatgaatttgaagttatagcaaagaagctattgaaaatgaaatacacagggaaaaaacccttaaaaaaattaaaagagttcagtgaggttagggacaattttaggtagcttaatatacgggtaactgggattcccaaatgaggatggagataataaatatttgaagaaataaaactttcaaaacttaatgaaaactctaaatgcacagatagatagaaaaatcttaacaaaccccaaacacaagaaacacaaaacgacaccaacgcacgtaatcaaaattctcaaaaccagtgataaagagaatgtcctaaaagcagccagataaaagtgacaccttatatacagaggaataaattaaagagaacgtcagatttcttgttggaagtaatgcaagcaagaactcagtggagcagcatctttaaaataatgaaagaaaattaaaacctgtcagccaaaatttctgtatccagcacaagtattgtttaaaatgaaagtagttggtacaaatgtaaaatagtgtagccactatggaaaacagtatggcagctcttcaaacaattaaaaatgttattaacatatgatgcagcattttcacttttgcttgtatatccaaaagaattaaaagcaagatatttgcacacccatgtttatagcagccaaaaggtggaagcaacccaagttccatcaacaaatgagtggataaataaaatggggtatactcaaacaatgaaatattacttagccttaaaaagcaaggacttctgatacatgctataacatggatgagccttgaggacattatgctaagtgacataagcctgtcacaaaaaacaatactgtgtggttccacttacatgaggtacctagagtagtcaaatccgtggagaatgaaagtagaatgggccggatgcggtggctcacacctgcaatcctagcactttgggaggccaaggcgggtggatcacttaaggtcaggagttcgagaccagcctggccaacatggtgaaaccccgtctctactaaaaatacaaaaattagccaagtgtggtggtgcacgcatgtagttccagctactcaggaggctgaggcaggagaatcacttgaacccaggaggcagatgttgcaatgagccaagtttgtgccactgcactccagcctgggcaacagagcgagactctgagaaaaagaaaagaaaagaaacagaaaggaagaggggaagagaagagaagagaaacgagaagagaaagaagagagagagagagaggaaaagaaaagaaaaagaaaaagaaaagaaagaaaggtggtttccaggggctaggaggaggggaaaatgtggagttgtttaatgagtatagagtttcagttttactagatgaaaaagttctggagattggttgcagagtagtcaattttatgctatgtgttttttaccataataaaaatatgtttttaaaaaatgaaagcaaaatagtcttccagacatttaaaagctgaaataactaatcactcaaagatctacattacaaggaagtcctctgagcagaaggaaacttacaccagatggaaatatgaatctatacaaatgaataaagaataccagaaatggtaattatatgagtaattgataagatttttttcgtattattacaatctctttaaaagatagtttattgcttaaacaaaaataataacattgtattctgcagtttataacctgtaaaagtaagatgcatgacaagaacatataggccaagaagagagaaatggaagtataccataagtgaggtggtataacatcacttgaagatagactatgataagttaaacatgtatactatgtaccctaaaacaaccattaaaatagcaaaacaaagagttttttttaaaaatgagataaaatcaaatcataaaaatattcaaataatctaaaataaggcagaaaaaggaaagacggatcaaaaaagatggcacaaatagaagacaaatagcaagatgatagatttacatctaagcatatgaaaaaaaaatcacattaagtgaaaatgacctcaagaccccagtgaaaaggcagagattgtcaaactggataaaagagcaagacccaagtttatgtactgcttaaaagaaatgtactttaaacataaagatacaaattggttataaacaaaagcatcagaaaaatatagagagacaagattgttctaaaatttatatataaaacaatggaatgaaaatagccaagatacattattaaaaagtcaaaaaataatagatgctggcaaggttgtagagaaaaaggaacacttatatactgttggtgggagtgtaaattagttcaaccactgtggaaagcagtatggctatttctgaaagaactaaaagcagaataccatttggcccagcaatcccattactggatatatacccagaggaataaaaatcattctatcataaagacacatacatgcaaatgttcattgcagcactattcacaataggaaagacatggactcaacctaaatgcccatcaatgacagactgaataaagaaaatgtggtacatatacaccatagaatattatgcagccataaaaaagaaaagatcatgtcttttgcgggaacattgatggagctggaagctatcgtcctgagaaaactaacacaggatcagaaagccaaataatgcatgttttcacttataagtgggagttaaatgataagaacttatgaacacaaagaaggaaacaacagacactggtgtctacttgagggtggaggatgagagaagggagaggagcagaaaagataactattgggtactaggcttaatatctgggtgatgcaataatatgtacaacaaacccctgtgacatgtgtttacctatgtaacaaaccttcacctgtacccctaaacctaaaataaaaattataaaaagaaaatagccaaaacaacctgagagagaatagaacagaaagaattaccctattcaatttcaacactttttatatagctacagtaatctagactgtgtggtatcattagagacatagatccatagatcaatggaacagaatggaaaaccaaaaaataatcccacacaaatatgctcaactgatttttgagaaagcacaaaagtaattcaatggaaaaagatggtgttttcaactaatggtgctggagaaattggacatccatagaaaaaaaaaaacccttgaccttaacttcacattttatacaaaaattaaatagattataaaattagatgtaaaatgtgcaataaaaatacataggagaaaatcttcaggatctaggccaggtcatgtgcagcctattccctgcatgaactgcacttgatatgtgactaaagacaaggatgttaagaagtttatcattcaaaatatggtagaaagccaagtgtggtggctcctgcctgtaatcccagtgctttgagaggctgaggcgggaggattgctcgagcctaggagtttgggaccaaccagcctgggcaatataaaggagcaccatctatacaaaaataaaaaatttagcctggtgtggtagcatgcacctgtagtcccagctactcaggaggctgaagcagaaggatcctttgagcccaggagtttaaggctgcagtgagctgtgatcatgccacttcactccagcctgggtcacagagcaagatcctgtctcaaaagctaaaaacaaagaaaacaacaaaacatagtagaggccacagctatcagggacatagctgaagccagtgtctttgatgtctatgtgcttcccaagctgtttgtgaagctacattactgcatgagttgcaccattcacagcaaggtagtccagaatcaatctcgtgaagccggtaaggaccaaacaccccaaccctgatttagacctgtgggtgctgcccaccaacctccaccaaagcctacatatggagctgagtccttaaggactgaaaaaaaagctatcctctgaagaaaataaagtgaaaattatactttaaaaaaaagagatcctgttgaatagatgaaaaaagctagagactgggagaaaaattttcagaccatgtatacaataatgggctagtagctaaaacatagaaagaactctctaaactcaatgtacaaagaaaaacaattcaaaaattagcaaaggatatgaacagacatttcaccaaaaagggatatatgcatgaaaataagcacccaaaaaagatgacttatgagtcattagggaaatgcaaacgaaaaccccaaggagataccaatacataattcttagaatagccaaaatggaaaagattaaccataccaaatgctgacgaagatgttgaggaactggaacttcatggtggaaatataagatagtacagacggtttggaaaatagtttggcagttttctaaaatgttaaacttgcccctatcatgtgatccagccatttcaatcctatgtatgtactcaagagaaaaggaattatttatccatacaaaaacttgcatgtaaaagctgatagcagctttatttataatagttaaaaactggaaacagccaaatgtccatcaacaagtgagtggataaacaaactggtatgtccttcaatgaaatactactcagcaatgaaaaggaatgaactattgatagatgcaataatggggataaatctagaaactgttttgctgagcgaaaggggccaggcaaaaaagtattaatacatattagatgattccattgtataaaagcctataaaataaaaattaatagttatagaaagttatagaaagcacatccataactgcttggggtatgagagaccagaatgaactggattgagggattacaaagaaaaaatggttgtgatggatgtgttcactccgttgactgtgttgatggttttagctatgtgtgtgtgtatatatatatatatatatatatatatatatcaaaacaattgtacagtttaaatattcatagtgtttcatatgtcaattgtacctcaataaaactgttttccaaaaaatgttatggtaggttttgtaggagaaagatgtgaagagaaaaaagggaacaaaatctgagaaacaaagaattagacccaagagaaggaaagagaatcccttataggagcatgtagaaacctaggtcttatggttaggtaccacaagatagaatgatattcgtattctcttttagaaggcctttatttatttttttactgaataggtgaagaactacttcagaattcccattcttctattgattctttttctttcctctcattttccagtcttgctgaataattttcttaaaacatccacttccaacactggagaggaatgtaatcttatttctaattgactatttctaatatgacatatttctaatctactatgactaatgtaatagtcaaaggcagtgttttacctatttagcataattgtttctagttgaagagggtgttttattccttgaaggtcctaatggctcctattcttaattgaaaaatatgaagcttcttgatagggtacaagggaatcatttaccttaccttggtttataagcagtctcagttttcttagattaagaaataattatccaggttattcctatcagattttccctagctagcttcttaccattgaaaattttaaatttactcaagagaaaaatgtatttttatatacaaatacagcagcatcaattacaatagtaaaaaccctgcaaattcactaaatagctaacattaagaaaatcattatatacttgattaaatgttatgtatctcctaaaattgattactgtgaagactacatagcaacatagattaatatgtacaaaacaaaattaaatggaaagaatagaacatgaaattctatataagctacgattacaactaggtaaatatacaaaagaatacagttaaaattgaacatagataaatgaaaatagctgcattagcatggtgaattatgggtgttctcttttaaaatttttgtcgttgttgttttaataacttttaaaatagattttaagttttctggggtggtttactacactcttagactcttcatcctatgtgtgaaatttctaatgtgtaggaaaaagaaagaatactgattgccaccttatctaaaacttatgttgaccaagactgataataaaatgcacttagaaccctatataaaggatattgtgttttgattgcctaaaaaagaaaccaacagcatcttttatttgtttctagaggtgacttgggaaagatagggtagcgacatcgctgtgattttgttgtttctttttaaactttaggtacaaaattacactgatgccctacaatggtactattattctctgaggttttattcaactgatgaaatggatctggacttcaccaagctgcagaggaacatggcttgctgttacctgaatttgcaacaacttgataaggtcctttgatttatctattttcagaggtagcaaatgttcttatgtgcagtggcagagagatagatgccatgctgtgacttcctggctgttagtttaggatgtctgagagttccctcatatagaacaaggtcaaattgacattttcttgatttgcacactgtaaacatagagtgaaacttcccaaagaaagagagaatttggaataccattaattctattacttaccctttatttttcacacctattctgaaaggtaatatatcattggaactcctgaacaaagttatctgctactaaccatctgtaatattgtcctttgcagcaagctaaattttgaagtacacacttttgtcaagcattcattgagaccaaatacttgaatgaagtggccattctttcactttctaggttgttatctcttgcctttccaaccaccctagaaaatgttctttaactgatttcttatcaggacaaaattctagaaggtaaagaagataaaagcttgtttaaagatagaacggaaatactttccaaagcaattaggacatttcttcctttggttatcatatggtatgcacgtaatgaggggtattggctcttagaaggacaaagaactagaaggacaagtgtgaacccaaatgaaatatgaaggtttttgttgcctttcaagttttaatgacaggtctaacctttgttcacctaggtgattaagggtaatgattccagatgttttctttgaaggtttatttttgaagagttgtttatctgacttaaatactttagattttctttcaagaaaatatttgctatttagtttatatgttataaagtcacagccctggaagagaacttgaaatgttacttaattcatcataatgttgtacaggctagcatttaactgtttcagaaaatagttacctacagtttaagatctaaaaggaagatgatcatgtagattttgttacctaattctgcacaggacagcactatttcagaaaggtagttgcctactgtttacttaaagactaataaagaaggcaatcacagagcctttataacttccatgatttatgacacagtgagctaggcagcttgggaaggacctatatctggatgtagacatgctagttggggaatggatgcatttgcaggccaagggaggatatctaatcagccagtcaggaaagaaagaaagaacacagtaccagacattatgctaggctctgaggttacagagatgaacaaagtatagttgccttcaactcactcaagcagctgacatcatggtatcctaatgggcagataagcagagcatggcaatgagagaaatctaaatgttggaaatagtccgtaagtcaggcacacaggtggttggcatcacataaacataacagcagggaacagggtttcaatcacagatatttggactctgagacagtacacaaatctttgaggaataggagtgtgtgcagacatactagaaagagcaaagtagatctccacaactaaaggggccaggatatgaggctgtttttaagagcagatcccctgcatagggagccaaactgggaagcaatgaccagaagaggaatacaagttgactagatacagttttctgagacttaagcaatgctacttacatctcttctaatgtcaagtttggtcctagagcctagtatagcactgactttataattggaaattcaaatggtattaatagtgaggttaggaagaataggagaacagtaaaccaggtgtattttaatggtgcgtactcaatatgtaactgtatcatttatggccagattagtggtgaaaccaaaggatattttgaatatattcaaggtaactttgttggttactgttagtatatttctccatttcatccttgtcttgaatttagcagacattgattggataccctccatatacaatgaatatcctcttatgcactaggacagacagaaaggtgaaaaaaatacacaatccatcatattttaataatcccacctcgccagtgtctaacctttgttagctttcattgtctttcttcactccttcctttgagttgcttgagcattgttgggaaaatttatgaaaccatgtttattgggtttgctaaaatttcatggtttttcagctaggtagtcaataatactgactcttgttgagtttttatcacattccccacagtgataattccaaaacattttttttctgtccttaagcacccatgctttctcctttgttgtagcaaaagatcttatcgtgtgatttgctgagcttgtagccactgacatgaacttcatcaatttctcacctcttcacccatcctttcttttctcttacctacgagaaagaagtaactttgtctggggaccttactctacagatctcaaccctagctgtttaatcattctctactgtttcttttttattttttttttttgagacagagtctcactcttgttgcccaggctggagtgcaatggtgctatctcagctcactgcaacctccgcctcctgagctcaagcaattctcctgtctcagcctcctgagtagctgggattacaggcatgggccaccacgcctgggtaattttttatatttttagtagagacagggtttcacctttttggccaggctggtctcgaactcctgacctcatgatctgcccgcctcggcctcccaaagtgctgggattacaggcgtgagccaccgcgcccggcctactgtttctttctcctgtcactataattaccttgaagtcttctttatccaaaaaccttccttcaactttgtaatcctcctcaaacttcagttctgtgtccttctttttgttgccaaactttctaatccaattttttagtgttcattcattcaaaaatatttatttattgtctcctatgtgttaagtactgttctaggcattggggatatagtaatgaacaaaatatataaaaacctttatccacatggacaaatactgctgtccccattattttccactaggagaggcaaacaataaaaagataaataagtattatgttatattataggggtcaacaaactttctgtaaagaaccacagtaaatattttaggttttgcaggccatacagtctgtgctgaaactaatcaactctgttgttgtgccttgaaaatagccatagacagtatgtaatcaaattggtgtggctgtgttccaataaaactatgttttggaatactgaaatttgaatttcatgtaatttttgtgtgtcataaaatatgattcttttgatttatttcaggcacttaaaatgtaaaattgttctaacttatgaactgtacaaaaaatatggtgagccagattttgcccaaaggctatagtttgttgactcctggtatattaaatattgataagtgctaaggagaaaactaagcaggaaagggtgatattaaatgtttcagaggcggatgaatggttgaacttttagatagggtggtcagggaagtcctcactgagaagattgtttttaagtagagacctgaggaaaaagagcattccagatggagggaataacaactgcaaaggccctagggtatttaaagaatggcaaagagacctttgtggctggagctgagggaacattaggagaattaggagatgtgatcagggaagtagtggtgtcttagtctgtttcgtgttggtataacagaatacctaagactgagtaattaataaagaaaataggtttatttaagctcatgattctgcaggctgggaagttcaagggccatggtgctggcatttgcttggcttctggtgagggcttttgtgctagatcaaaacatagcagaaagtcaaagggaagtagactcatgccaggagacataatccaaggggctttctggctttataacaacctactttcatggaaactgtttctgttttatttccttgtatactatgtttgtcctcaactggagtacttgctgcttcctagccatgatctatgttttctacctcagtatcttttttcatgcttcttcattgcaaattacctctttcctgcatccctaaaattcccttttcaaagcctagcttaaaattccctttttcaaagcctaactcttaatgacattcttagcttcctgaggaaatttccttgtcttgcctttcctccaagactttgtaacagttctgtttatccctagatacttgttttctcattatattttagttatttctatacctgccttagtcatctattggactgtcagtcacctccttgaggacagagaccatatcttatctttatttgcccttgtacccagcatagtgcctaatgcatagtagatgctcattacattaaaaatagttataaagactcaataaatacctgtcaatcaacttcttctgatataggaattccatttcctcatgctatttctgtccttgctactatgcataatttggaaattaatagtgattaagatctgtgagtgctctttgattatcagaactgaatgagattatattattaaaaatcatcccactataactttctccagctcagctcttttctcttttgagggtgagaacgcattttattttgatttaaaatgaaatattgaatcataggtcagaagttaatttgggcaggccaatggagttgagaaatagactcccttgaactttttagtagattaggttacagattcattagctcgcacacttggcaacctctttttgagataacaatgccaattatagatcatttctttggtttgttttctaaattgtataaataaaaattttttaattgctattatccattcagatatcttcagtactttgcatgagacaatattaaacaatgttgtttcatagatatcaactctgcctttgaggtgtttgtagtgccttaagcctggtatcctgattttgctatattatttttgaggatttaaaaatatttggtttgtgcaagtcataggtttgaatggattaaggatgaaggaaatgagcttgggttctaaatacagaagcagtttatcacaccttgatataatgggattttgctgcaaaccataataaaaccttaatgttagttgacagatggataatgacttgttttggtgatagtctgtgtaagttaatgggaatgcacaattgggtactctttaactcagtacagaagtcccatcctcagcttgcaactgcagtttaggtacatgaatgtcattagcactactatagtttgataaaactgaaccacactctcaaaccacagaatggctgtaagacttacaacagacacaaagatgagactattcatagaatatttatgtgacctaaagtgaagacagttatgtctcatgtgctggttatatattgtttctctttaccatataaagttcgaaaaatgagcttgggaccagcagacataaactagtgatattcactagatggcactgtggcctctgtacttcatcagcttgtgcttgactgattctgagggtttttttttttttttttgtaattcttaggtagatgtacctttcccacaaatgcatctatatggatgcaaaaaaaaaaaaccactaaagaaacataagatgaaggtcagctgtgactcatttgatacagctatactgtaaaaataccctgactgagattccaactcaacaaatattaaatgcctaatctgtgccaagcactatagaataagtagaagacatgatctattctgtaagtgagcctaaaatattaatgcagaaacaatatttacatatataaaataattagaaaataataaaaggctgttcaatcacacatcattgtgtggtatgtaccatatgaacttagaataggaatatatagatgaggacgtttgtgaatattgattgaatgtacatatgatgtgaagctgaaaagggtaactgatttgttagaagatagagtcagatctgaagggaccttaataggttgaaatgatgagcctattctagcaagacgaagacaaacaggaaacaacaaaacatcctataattggatcccaaaaccaattgtacaagaacaaagtagataaaatatggctctaaaagcagcatatgtgagtcacttggtacattttattgactataagcactgcataagccaaaaatactaagaaagtttactcaaattaggttgaatcaatagagatttaatgtatagaaggagaaaaagtggcaatcaccctctattctgctctggttagaatatatctgaagtacagattcaatcaaacgcagactgaaaatattcagaaaaaagcaatttagaaaatagcaatacaacatagaaaataatgcaaatataaaacaatacagtgtaactactatttacagaacatttacgttgcattaggtgtaagtaatctagagattatttaaagtatacaaaaggatgtgtgtaggttatatgcaactactataaggaacttgagcatctgcagattgtgatatccgagggtgtcctggaaccaatcctctaaagatacgagggaacaactgtatagacagcccttgacttacaagggttcgatttaggatttatcaatcttatgatagtatgaaagcaatactcattcaataagctcctcaagttaccatggggttatgtctggataaatccgtcataggttgaaaatgcactttctatttaggatattttcagtttaccatgggtttatcaggatgtaaccccatcattagttgaggagcatctgtattgtattggattgaggggcaccacttataaaggaggatattgacaaacccaagtgtgccaagaggaaggcactgaggatggtgagagcactaaaaatcatctaatttgaagaataaaggaagtgtggatgttaaacttgggaaatggaagatttacgagaaacacgatagctttcttccaatatttgaatggctgtcagggagtaaagaaattaaatttatttcatgagtgtttccatgggtgagacctacaaggagtgagattttggattatcataaggaaaccctttcttaattatttgacctaccaaaacaatgaaatggattttcttaaaatagagtgaattctgtcttcttgaatatatttaagtaaagactgaatgacttggtataaatgttatagaggagattcaagcatcagaagaattttttgactaagagaactttgaggtatcttctgcccacatttttctgaaatatcagtataacctgataaaatgtattatagtcaaagaggattttgtgggggactaggctcattaatcactgaatttgaaaactaaaggaacccttgcaagtcattactaatttattttaaaatgaatttataaaaatataatttacatacaaaaatgcattcattttaggtatagttcaataattttgacaactttataccccaaatttacccactaccatggtctagatatagaagacttccattatcctgagagatttccttgtgttccttcccagtcaatcctcacctccactcccagccccaggcaatgactggtatgctttctatcactataggttagatttatctttcctagagtttcatataaatggaattacacggtatgtactttaccttttttttaaatctggcttctttcactcaattttagaattttagagaatctcttctggcttgtagagtttctgccgagagatcagctgttagtctgatgggcttccctttgtgggtaacccgacctttctctctggctgcacttaacattttttccttcatttcaactttggtgaatctgacaattatgtgtcttggagttgctcttctcgaggagtatctttgtggcattctctgtatttcctgaatctgaatgttggcctgccttgctagattggggaagttctcctggataatatcctgcagagtgttttccaatttggttgcattctccccgtcactttcaggtacaccaatcagacatagatttggtcttttcacatagtcccatatttcttggaggcttttttcatttctttttattcttttttctctaaacttctcttctcgcttcatttcattcatttgatcttccatcgctgataccctttcttccagttgatcgaatcggctactgaggcttgtgcattctccacgtagttctcgtaccatggttttcagctccatcaggtccttgaaggacttctctgcattggttattctagttagccatttgtctaatcttttttcaaggttttttacttatttgccatgggtttgaatgtcctcctttagctcggagtagtttgatcgtctgaagccttctctcaactcgtcaaagtcattctctatccagctttgttccgttgctgatgaggagctgcattcctttggaggaggagaggcaatctgatttttagaattttcagtttttctgctctgttttttccccatctttgtggttttatctacctttggtctttgatgatggtaatgtacagatgaggttttggtgtggatgtcctttctgtttgttagttttccttctaacagacaggaccctcagctgcaggtctgctggagtttgctggaggtccactccagaccctgtttgcctgggtatcagagcggaggctgcagaacagtggatatcaggcaaatgttgctgcctgatcattcctctggaagttttgtctcagaggagtacccggctgtgtgaggtgtcagtctgcccctactggggggtgcctcccagttaggctacttgggggtcagggacccacttcaggaggcagtctgtctattctcagatctccagctgcatgctaggagaaccactactctcttccaagctgtcagacagggacagttaagtctgcagaggtttctgctgccttttgtttggctatgccctgcccccagaggtggagtctacagaggcaggcaggcctccttgagctgcggtgggctccacccagttcgagcttccgggctgctttgtttacctactcaagcctgggcaatggcgggcgcccctcccccagctttgctgccgccttgcagtttgatctcagactgctgtgctagcaatgagcgaggctctgtgggcgtaggaccctctgagccaggcgtgggatacagtctcctggtgtgccgtttgctaagacccttggaaaagtgcagtattatggtgggagtgacctgattttccaagtgccgtctgtcacccctttccttggctaggaaagggaattccctgacccccttgcacttcccgggtgaggcaatgcctcgccctgcttcagctcacgctcggtgtgctgcacccactgtcctgcacccactgtccaacaatcctcagtgagatgcacccagtacctcagttggaaatgcagaaatcatttgtcttctgtgtcgctcacactgggagctgtagactggagctgtttctattcggccatcttggttccatccctaatttttgtatttttaatagagacgggatttcaccaagttggccaggctggtcttgaactcctgacctcaggtgatccacccaccttgacctcccaaagtgttgggattacaggcgtgagccacctcgcccagccttttattgctattttagagtatataaaacaaaattataaaacaaaattaactgtaaaacagcctcagacaggtccttcaggaagtattccagaagaaggcattatcatagtaagtgacagctccatgcatgttattgcccctgaggactttccagtgggacaagatgtggaggtggaagacagtgatactgatgatcccgagcctgtgtaggtctaggctaatgtgtttgctcatgtcttagtttttaacaaaaagtttgaaaagtcaaaaaagattttaaagtgttaaaaatcaaaaatcttgtagaataaggatataaaaaggaaatttttgtacaactgtacaatgtttgtattttaagctcggtgttattacaaaatacttaaaaagttttttaaatattaaaaagtttataaagttaaaaagttacagtaaactccattattgaagaaagaaaaatatccttttataaattgagtgtagcctaagtatacactgtttataaagtctacagtagtatacagtaatatcctaggccttcacattcactcagcactcactgactacccagagcaacttccagtcctacaagctccatttatgtaagtaccctatacaagtgtaccattttttatgttttataccctatatttactgtattttttctaggtttagatatgtttagatatataaatacttaccattaaaattgcctacagtattcagtacagtcacatgctgtagagatttgtagcctaggagcaatgggctataccatatagtcatgtatagtaggctataccatctaagtttgtgtaagtacactatggtgttcacacaaagatgaaattgcctaatggcacatttctcagaatgtacccctgttgttaagtgacacatgactgtaccacattttgtttatcctttcatctattcattggacacttgggttgctttgacattttggctattatgaataaatacttctatgaacatagatattacaagtatctttttgagttcctgctttcagtttttttgagtatttacctaataatataatcattggatcatgtggtaattctgtatttaacattttgaacaatcatcctacttttttccacaatggttgtaccattttacattcccaccagtaatgcacaagtgttccaatttctccacatcctggtcaacactcactgtttttaagttttttgataaaagccatcctaatgggtttgaagtgttctcttattgtgtttttgatttgcatttccctaatgaccagtgatgttgaacatattttcatgtgcttattggccatttgtgtatcttctttggagaaacatctgttgaagtcctttacccatttttaattgggatttgtattttatagtggttgaattgtaggaattatttatatatttcagatattaaccccttaccaaaatatgattagcaaatatgttttcccattctgtgggttgtctttttcttagtgtcttttgaagaacagtagattttaaaaaatttttgatgaggcccatttatctgatttttcttttgttgactgtgctttgggtgtcatatccaagaagtcatttgcaaatccgatgtcatgaagattttcgcatgtgttttcttctaagacttgtatagttttagctcttatgtttacacctttaatccatgttgagttaatttttatgtgtgatataaggtaaagatccagcttctttcttttgcatgtggatatcctggtttcccagcaccatttgttgaaaagactgtccttttcccattgaatagtttgggaacccttgtcaaaaaccatttcaccatatatgtgagggttcatttctgggctctctattatatgccattggtctatatgtcagtccttatctcagtactatactgttttgattactatatcttcatagctaagtcttgaaatcaggatcccttgaaacttcatatgaattttaggatgggtttttttatttatgaaaaaaaaatgcccttggaattgtcatagggattacattgaatctgtagatcactttgggtatcttcatttttcagtgtttatcttttactgtggtaaaatatacattatcttcattccttcttaacttcaaattttttcttgtttttgacttttagtctcttttggcattattggctgtatttatttacttttgactttcttcttgttagtcttcatttctgaaatgacttcttttacttctaatattttccttagctctaccacctcatttctgagtttttctaattattactatgggtttttttgtttgtttgtttgtttttttgagactgagtctcgctctgtcgcccaggctggagagcagttgtgctatctcggctcactgcaacctccgcctcccaggttcaagcaattctcctccctcagcctcccgagtagctgggattacaggcacccgccatcgtgcccggctaatttttgtatttttgtagagatgaggtttcaccatgttggccaggctggccaggcggaactcctgacctcaggtgatccgcccttctcagcctcccaaagtgctgagattgcagatgtgagtcacgacgccccaccgctaattcttatttaggttgatctttcatatcttgtatcattttttaaatttttattattatactttaagttttagggtacatgtgcacaatgtgcaggttagttacatatgtatacatgtgccatgctggtgtgctgcacccattaactcgtcatttagcattaggtatatctcctaatgctatccctcccccctccccccaccccacaacagtccccagagtgtgatgttccccttcctgtgtccatgtgttctcattgttcaattcccatctatgagtgagaacatgcggtgtttggttttttgtccttgcgatagtttactgagaatgatgatttccaatttcatccatgtacctacaaaggacatgaactcatccttttttatggctgcatagtattccatggtgtatatgtgccacattttcttaatccagtctatcattgttggacatttgggtttgttccaagtctttgctattgtgaatagtgccaaaataaacatacgtgtgcatgtgtctttatagcagcatgatttatttttaaatgtgtttagctcatttttaaatagtcggttatgattttgacctgttttttgagcacatttttctgacatgctttcattttctgtggggatactttgctgctgctgatgctgctgctgcttttttttttttaattttttacaactttttagggtatttaccttaaagctttactgtttctcattttgatgtgaaattagttttccttaacttataaaaaggtagacatttagaaagtgttactacttcacagagctcccttttttgtttttggtttggtttggtttgttagtgtttaaaaataaggcagcttttattctgagatttcctggctctgcttctctctgtcttttggtgtacacccacactgtccaatatgatagcaatgaggcatgtgtggctatgtacgtttaagtttaaattaattaaaattaaataaagttataaaaatttatttcttcaattgcagtagccacatttcaagtgctaaatagccatgtgtggctaatgactactctattgaatagcacaaatatagaatatttccatcatcacagaactctattggacaacactgatctatactttttctttcatctttgttgtcactgtcctgttcagttttttattgtactctcagcagtttctccttagtgtggagcctctcagaggggagctctagtgggtaagctttaagggttcatagggcctagactactatcgcttctttagtacatctttgatatgaggtccttgcactcactcaataatggagaaagcaaattatctcccaatttcaactgctgttctccagtttccccatcatgctattcagttgatttctacaagccaattttggggtcctccttttctatatagtccattagacgcttccctattacttccttttttttcttcatcctgtacagatgctgacataatgcaggtcttgtagctgttgttgctttttctccacccacttgtgtttcttaatgcctcgggatattttgtcactcagttttgttataaacgctgtctgtggtttttggttttgccatctgcatgctcagttgtttttcatgagaattcagagaaatgttacctctaccacatatttccagaatcattttgtatagtttttttttcttcctacctacctaccgacagggcctcactttgtcacctaggctggagtgcagtggtgtaaacacagctcacagcatcctcaacttcctgggctcaagtaatcctcctaccttaacctcctgagtagctgggaccacaggcatgcaccaccatgcctggctaatttaaaaaaatttttttgttgagacgggggtcttactatgttgcccaagctggtctcaaactcctggactcagatgatcctctcacctcagcctcccaaagtgctgggatcacaggcatgatcagccatgcccagcctcatatggcatatatatatatatatatacacagctacctttgctaaagtctcttaataattgtaataatttgcttataaattcttctgggttgtctacatattcaattatacaaattgacaattgtgtttcttctttttcaatatgctttatatatttcttgtcttattttgtctaataattcaaccactatgttgaattaaagtggtgttttggatttaaaagggaaagctaccataaattgccattaaatatgatgtttgctttagggtttttttgtgttgttgttgtatagatacggtattagtttcctagggatgctataacaaagcactacaaactgtgtggcttaaaacaacagaaatgtatacacttatagttctggaggctggaagtccaaaatcaaggtgtcgataaagctatgctctctctgaagactttagtagaggattcttcctagactagatttgcttaatggttaggtaaatggtcactttttgtaaatattctgtgtgtgcttgaaaaaaatgtgttttctgcagtttttaggcactgtgtatgtacatatatgtacagatgttccttgacttacgatggagttatatcccaataaattgatcataagttgaaaatatcgtaaggtgaaaatgcagttaatgctggcaaaatggcaggcatctacaacttatgatggtttaacttaatggtattttgattttataatgatgtaaaggcaatatacatttagtagaaaccataaccctgtcataagttgtaaggagctcccagacttacgatgtggttacatcctgataaacccgtggtaaagtcaaaaaatcataagacggagaccacctatatacacacatgtataaatttagattaagtttgttcattttatttgaatcttctgtatcaaaactcatattttgtgtacttactctatcacttactgagatgaggtgctggaatatccctttatggtttgaattgatctatttcttcatttaattttatcatttttgctttatatattttaggccatactacttatacatacaaaattagtactgtaatatatttgtttgttgaagttttattgttatgcagtgatcttctttatatctagtattattttctgccttaaagtcatttttgtctgatattaatatatccacactttggttaatattttccagatagatcttctctaatccctttactttgaacttttaatacatttatattttaggtgtgccacttctaaaaaacatgtagttacatatttttaatccagtctgaccatttttgttttttaactagggcatttcgtgtttatacatttaatacaatattggtatatctgagtttaaatctgtaacttactttatgctttctatttgtcatttctttttttttttttttttttttttgagacagagtctcactttatgcccaggctggagtgcagtagtacaatctctgctcactgcaaactccgcctcccatgttcaagtgattctcatgcctcagcctcccaagtagctgggatcacagatgtgtgccaccacatccagctaatttttatatttttagtagagatggggtttcaccatgctggccaggctggtctcaaactcctgttctcaggggatctgcctgcctgagcctcccaaagtgttgggattacaggcatgagccaccgtgcccggcttctatttgtcatttctatcctgtttctttttctctcctcacttgccttcttcgggatcaatgtttctaaataatagactttacttgttacagcagttttaggtttacagaaaaattgagtaggaaatatagagagttttcatataccccctcacggttcttcacatactgtttcccctgtcattaacatctcgcattagtgtgctatatatgttacagttaataagccaatattgatatgttatttttaactaaagtccgtagtttacattaggatttagtctttgtgttgtacatcatatgtggtttgatgaatgtataaaaaagtgtctaccattataataccatacagaatagttcaaccccctgtggttcaactattcatcccttcctccctctcactgaactagtgtcaaccactgatctttttactgtctccatagttttgccttttcagaatgtcacataattggaatcgtgcagtatgtagccttttcaaataggtttctttcacttagcaatatgcatttaagattccttcatgtccttttatgggttggtagttaattttttttagtgctgaataatatttcactatctggatatattagtttatacactcacctatggaagaacatcttagttgcttccaaattttggcagttatgaataaagctactataaatatctttatgtagatttttgtgtagacataagttttgacacatttgaataaataccaaaggtgcaactgctggattgtatggcaagagtatgtttagttttgtaggaaactgccaaactgtcttccaagttggctataccatttttcattcccaccagtgatgaatgagagttcctgttgcaccacatccttgccagcattatatgtcgttaaagtgttttgaattttagttattctaatagatgcatagtgatatctcattgctgttttaatttgcaaaaccctaatgacataagatgttaagcatcttttcatatacttatttgccatctgcatattttatttagtgaagtgtttcttcaggtcttttgcccattttatacttgggttgtttattttcttattgttgaatttgaagaattcttcatacatgttgaataccagtccttcattacatatgtgtttggcaaatattttttcccaatatgtggcttttatcattattctcttaatgctgtctttcacagagcagtttttaattttaatgaagtttaacttaccagttttttcttttatagatatggttttggtgttgtgtctaaaaagtcattgccaaagttcacctaaaatttctcctatgttatcttctaaaagttttatagtttgggtttttatatttaggttataatccattttcagttaatttttgtgagaggtttatggtctgtgtctagctctacttttttacatgtggatgtctagttgttccagcaccagttgttaaaaatactattttcattttttttttcattgcagtcttccccttctactagtgtgaaaattatttactgcttctaatcttttagtggctatcctagaaagtatagaatcctttcttaactgtcttccatgtttgtaatcgctctgtgctgcattttggctattttattctttcagcccactaattttctcttcacctgtttctaatctgctattaaacctgtctattatgttttaatttgggtaattgggtttttcatttcaaaaagcttctttgtttcagatccccaaggtcacattttatggtctctgtttcctactaacttcactgatatgcaaagtatttaataactggtatggcacaggtaataatgagacagaatggataccatctagaaacaaccactataactgtattaatttgtaccactgtgtatcaacccacatacatatattttgaacatacattgtatttctttagactttgaaaacataggtgttttataaccagtttttcataattctagtatctgcatcttgagggtctgcttctgctatctcgtttctgctgtttatggtaccttgtttccgagtgtgctttgttatttttgtaacgtgtacaactcatggttcttgaaaaattatttatggaaatatttcgaaggctgacataaggtgctttcccccagagaagatttacatttgcttctgtagatgcttgggagctatctaaactaaattctcagctttaggtcttttagcttcctgtataatgtagtttgggtcagtgaatacatgagtctcctagtattacacctcatggattgtttccctccaccccattgtgctgccttctattcagtactaaggtaactttatttgcagttttccagggatgtgggtaggagtgggtttacttttggcttgtccctagtctaggagtgtgatcccttggaacttgatgtcttttcccctgacctagtgatgtccctcaaaactgaagttaacatttgcttacatttgcaaatgcttaccagataaaagcgactttacttttctgtttacctctctgagacctcagttttccttagattttgccttggtaattcttttgctatttgtcagttgctcttttgttctttctggaaaaaaattaatatatcatccaatatttttggttgttttcagcaggagggttggtctgacatatctaacttactctatttccagaagtataactcactgttgcattagcattctagaagagcacttctgcaaatatttttcttagattcatatattttcattgtgagtatccctcagccattttgactaccttaatgatattagtaaaatatggtaagtccttccttgtagattttattaaaatgacccagtgtttttctttccaggccaaagaggcagtggcagaagctgaacgacatgaccctaggaacgttttcactcaattttatatattcaagattgcagtcatagagggcaactctgaaagaggtataaattttatttgtcacttatatttgactattaacacaaagaataaataatcctcttcaaccacagtgggaaaaaaacattgtttttaagacaatagaattgaatatatgttctgtctttcctatgtaaaggtgatacaacaatgcaaaaagaaaccgtggaaggttatataaaagtaaaagaacagtggttacctattgagggaataggaactgggcaaacgcgggacaagaattaggggaaagtcttatcactatgtacttttttatacttttatttaaaccaacctattcaaaaattaaatttaaaaagctgtgtgtgggtgagattatactaaaaacccatatcagttaagaattgtcttcaaaaaatgaaagttggggtaccttttgattgttttcacttatttgggaggtgattggtgagagatttggccttgagatggagtttctctccacagagtagacagtcttggaatttcacacatgaccctcatcccattaatgttgaggcctttccattaagttaagcatagtttcctagctggtgtgtctgcatgggcacatatatgttgaattggttatagatatgcctttgctcagatattaatgccttcagccctcaggtagctgaattaatcctgaaggagtctgagctccagactggttgccatttgtttggcagaagttaagaaacttaaattaatggatccaaacaaaatgtatacgaatccaattaagcaactgtttttggacacctactacgtacaaaggactctgttattcactccttaagaaaaaagatcatttattttacattaaaaaagaaatgttccagaatagtaaagtatacctgtataataattaaggaatagtaaattagaggttaatattgctgtcatgttcatcatcaaagttttcattagagacttttaggcatttgttttacttgatatactgtgtttaagggtaaaataacttgaagcttttttgccagtaaaaatggcaaaaatattagtaattttcctgttaaatcttttgttttaacattattttttaaaaattattttactttttaaatacaacatcagatcaacccttttatttcttctccagttgtctgtgaccattttttaagtcacgtatattgaagatacatataataaatttactcttgctagtgtatggtcctatgaggtttatatatgttaaaaattctgagttttgaagtgcatacagtcatataactaccaccacaatgtagaaaaaaaatacctcagggccctttactgttactccttctcaccactttcagccctggaaatcagtaatctcttctatctctatagttttgtcttttccagaatgtcatataaatgaaatcatatagtatgaatctttttgagcttctttcacttaacttaatgcatttgaaactcacccatattgtgtttatccacagtttgttcttttttattgctatgtggcattccatagtatggaaataccacagtatggaaaaatgcattcaccagttgaaggatatttgaatggttttcagggttttttttcacctctgagacaagttcaaagttttcagttttgacaattgtgaataaaggtgctgtaaaacatctctttacatattttctgtgataataatattgtttttttgagatggggtcttgctctgtcacccaggctggagtgcagtggcatgatctcagctcactgcaatctccacctcccaggttcaagcgattctcctgcctcagcctcctgaatagctgggactacaggtgtgcaccaccatgcccagttaattcgatgataatattttacttctgtagggtaaatatctaggagtgggactgtggacttatatggtaaatacatgtttaactttattagaaactgcaaaactgttttctaaagcgactatacaatttcacctgtgaaccagctatgtttaagagttctagctgatctacatcctcatcagcacttgaaattgtccacttaaaaaaatttagccattctgggagattattaaaaagtcaagaaacaacagatgctggtgaggctgtagagaaataggaatgcttttacactgttggtgggaatgtaaattagttcaatcatagcggaagacagcatggtgattcttcaaggatctagaaccggaaatactatttgacccagcaatcccattactgggtatatactcaaaggaatataaaccattctattataaagatacatgcacacgtgtgttcattgcagcactattcacaatagcaaagacatggaaccaacccaaatgcccatcaatggcagactggataaagaaaatgtggtacatatacaccgtggaatactatgcagccataaaaaggaataagatcatgtcttttgcaggcacatggatgaagctggaagccatcaacctcagcaaactaatgcaggaaccgaaaaccaaacaccacatgttctcactcataagagggagatgaacaatgagaacacatggacacaggaaggggaacaacacacactggggcctgttgggggcggggaggggagggagaacatcaggacaaatagctaatgcatgtgaggcttaaaacctaggtgatgggttgataggtgcatcaaaccaccatgacacacgtatgcctacgtaataaaactgcactttctgcacatgtatcctagaacttaaagttaaaacaataaaaaagaacaaaaatttagctattctgatagtgggtagtagtgttttactgtggcattagcatttccctaatgtttaatattttattaaaccatgtatgtttttgggttgtttgtacaaatctttttcccagtttaagatagggtactttgttttattattactgatttttgacagttctttatatattctggatacaagttgtcttttttaaaaacttatttttttaattggcaaataaaaattatatatatattgatcatgaacaacatggtgggttttatttatttatttattttattattatactttaagtttcagggtacatgtgcacaacatgcaggtttgttacatatgtatacatgtgccatgttggtgtgctgcacccattaactcgtcatttacattaggtatatctcctaatgctatccctccccagtcccccatcccacaacaggccctggggtgtgatgttccccttcctgtgtccaagtgttctcattgttcaattcccacctatgagtgagaatatgcggtgtttggttttttgtccttactatagtttgctgagaatgatggtttccagcttcatccatgtccctacaaaggacatgaattcatcattttttatggctgcataatattccatggtgtatatgtgccacattttcttaatccagtctatcattgatggacatttgggttggttccaagtctttgctatcgtgaatagtgctgcaataaacatacgtgtgcatgtgtctttatagcagcatgatttatacttctttgagtatatacccagtaatgggatggctgggtcaaatggtgtttctagttctagatccctgaggaatcgccacactgacttccacaatggttgaactagtttacagtcccaccaacagtgtaaaagtgttcctgtttctccacatcctctccagcaacaacatggtgttttaaagatatgtatacattgtggaatggctaaatcaagctaattaacatatacattacctcacatcctttttttattttttatttttttgaagcaaggtcttactctgtcacccaagtggaagtgcagtggaatgatcacggctcattgcagccttgacctcccaggctcaagagatcctccacctcatcttttttattattttttgtatagatggagtctcactatgttgcccaggctggcctcaaactcctgggctcaagcaatcctcctgcttcagcctcccaaagtgctaggattacaggcatgagccatcacacccaaccctacctcacatacttagcattttttttgtggtgagaacacttaaactctcagtgatttttaagaatagaatacattgttataatctatagtcaccatgttgtacaatagatctcttgaacttgttccttctgctcaacggaaattctgtattctttcaccatctccctaatctccccgactccttagtccctggtaaccaccattctactttgcttctatgaacattctattctgcttctatgaggtcaacttctttagatttcacatatgagatcatgtggtatttatttttgtgtgcctggcttatttcacttaatataatgtcttcgaggttcatacctttttttcataaatgacaggatttcctccttttattgaggctgaatagtattccattgtctatatatacaccagattttctttatccacttatccaccgataaacagttaagttgattccataccatggctattgtgaataatgctgcaatgaatatgggagtgcagatatctctttgacatattgatttcacttcttttttatattctactacgtagtgggactgctggatcatatggtagttctactttaatttttttgaggaacctccatactgctttccatgatggctatactaatttacattcccacctacaatatgcaagagttccctattctccgcatccttgtcagcacttgctctcctttgtcttttttataatagccattctagcagatgtggggtgatgttatcatcgtggttttaatttgcgtttctctgatgagtagtgatgttagacattttttcatatacttgtggaccacttgctcatctccttttgagaagtgtcttgtcaggtcatttgcccattttaaaatcaggttatttgtttccttcctattgaattgtttgaatttcttatatattttggatgttaaccccttctcaaatgcctggtttgtaaatatattctcccattccatacattgtgtcttcactctgttgatggtttcttttgctgtgtggaagctttttagtttgatgtaatcccatgtgtctatttttgtgtttagcaatgtcgtggaacttttcctctatgttttcttttagtagttctacagtttcatgtcttacgtttaaatctttaatctattttgaatagcttttttatatattgtgagaaaagggtcaaattttattcttctgcatgtgggtatccagttttaccaacactattggttgaagaaactgtccttttctcattgtgtgttcttgacacctttattgaaaaccaattgactgtaaatgtgtggatttatttctgggctctctatttccttccattggcctatgtatctgtttttctgccaataccatgctgttttgattagtatagctttgtagtttattttgacttcacatagtatggtgacttcagctttcttatttttgctcaagattgcgatagctagtcagggtctttttgcttccgtggaaacgtcagtatttttttttttatttctgggaaaaaatgtcactggaattttaatagggattgcattgcatctgtagattgccttgggtagtatggacatttaacaatatttttccaatccgtgaacctgggatatctttccatttctttgtgttttcttcactttctttcatcagtgttttatagtttttagtgtacatgtctttcacttcaacattaaatttgctcctaaatatttttgtagctattgtaaatggaatcatgtttttaatattttttcaggtagtttgttgttagtatgtagaaatgctactactttgtgtatattgattttgtatcttgctacttaattgaattcacttattggttctaaattttttttcattgcctctgtaaggttttctatatataagatcatgttatttacaagcagacaatttaacttcttcctttccaacttagatatttctcatgcctaattactctgactaggacttccagtagtatgttgaatagaagtagtgagagtgggcatccatgtcttcttccttattttagaggaaacgctcctaactattcaccattgagtatggtgttatttgtccattggtcatatatggcctttattgtgtttttttttttaaatcatggaatgatgttgaattttgtgaaatgatttccattttttggaagaatttgagaaggattggtattagttctttaaacgtttggtaggagcagtgacaccatcagatcctgagcttttcttagatggaagattttttgttattcatttaatctccttattcattatttgttcacattttctatttcattatgattccatctcggttttatatgtctaggactttatctttcttctagattatccaatttcttggtacataattgttcatagtagtcgcatgattttttatatttctctggtaccagctgtactgtcttctctttctttttttattttatttatctttttttaattttttttattatactttaagttttagggtacatgtgcacattgtgcaggttagttacatatgtatacatgtgccatgctggtgtgctgcacccactaactcctcatctagcattaggtatatctcccaatgctatccctcccccctccccccaccccacaacagtccccagagtgtgatgttccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccaatctatcattgttggacatttgggttggttccaagcctttgctattgtgaataatgccgcaataaacgtacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagcattcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctattcatgtcctttgcccactttttgatggggttgtttttttttttcttgtaaatttgtttgagttcattgtagattctggatattagccctttgtcatatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctacgtcctgaatggtaatgcctaggatttcttctagggtttttatggttttaggtcgaatgtttaagtctttaatccatcgtgaattgatttttgtataaggtgtaaggaagggatccagtttcagctttctacatatggctagccagttttcccagcaccatttattaaatagggaatcctttccccattgcttgtttttctcaggtttgtcaaagatcagagagttgtagatatgcagcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatgctcttttatttccttgagcagcggtttgtagttctccttgaagaggtccttcatatcccttgtaagttggattcctaggtattttattctctttgaagcaattgtgaatgggagttcactcatgatttggctctctgtttgtctgttgttggtgtataggaatgcttgtgatttttgcacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattaccgtggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatatgtcccatcaatacctaatttattgagagtttttagcatgaagggttgttgaattttgtcaaaggccttttctgcatctattgagataatcatgtggtttttgtctttggctctgtttatatgctggattacatttattgatttgcgtatattgaaccagccttgcatcccaaggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctgatctcataaaatgagttagggaggattccctctttttctattgattggaatagtttcagaaggaatggtaccggttcctccttgtacctctggtagaattcggctgtgaatccatctggtcctggattctttttggttggtaagctattgattattgccacaatatcagatcctgttattgatctattcagagattcaacttcttcctggtttagtcttggaagagtgtatgtgttgaggagtttatccatttcttctagattttctagtttatttgcatagaggtgtttttagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattaatattttgaaggcttttttgtgtctctatttccttcagttctgctctgatcttagttatttcttgccttctgttagcttttgcatgtgtttgctcttgcttttctagttcttttaactgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgtcttcatttcgttatgtacccagcagtcattgaggagcaggttgttcagtttccatgtagttgagtggttttgagtgagattcttaatcctgagttctagtttgattgcactgtggactgagagatagtttgttataatttgtgttcttttacatttgctgaggagagctttacttccaagtatgtggtcagttttgcaataggtgtggtgtggtgctgaaaaaaacgtatattctgttgatttggggtggagagttctgtagacgtctattaggtcctcttggtgcagagctgagttcaattcctgggtatccttgttgactttctgtctcgttgatctgtctaatattgacagtggggtgttaaagcctcccattattaatgtgtgggaatctaagtctctttgtaggtcactcaggacttgctttatgaatctgggtgctcctgtattgggtgcatatatatttaggatagttagctgttcttgttgaattgatccctttaccattatgtaatggccttctttgtctcttttgatctttgttggtttaaagtctgtttgatcagagaataggattgcaacccctgcctttgtttgttttccatttgcttggtagatcttcctccatccttttattttgagcctatgtgtgtctctgcaagtgagatgggtctcctgaatacagcacactgatgggtcttgactctatccaatttgccagtctgtgtcttttaattggagcatttagtccatttacatttaaggttaatagtgttatgtgtgaatttgatcctgtcattatgatgttagctggttcttttgcccgttagttgatgcagtttcttcctagtctcgatggtctttacattttggcatgattttgcagcagctggtacccgttgttcctttccatgttcagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggtccccactctcttctggcttgtagggtttctgccgagagatccgctgttagtctgatgggcttccctttgagggtaacctgacgtttctctctggctgcacttaacattttttccttcatttcaactttggtgaatctgacaattatgtgtcttggagttgctcttctcgaggagtatctttgtggcgttctctgtatttcctgaatctgaacgttggcctgccttgctagattggggaaattctcctggataatatcctgcagagtgttttccaacttggttccattctccccatcactttcaggtacaccaatcagacatagatttggtcttttcacatagtcccatatttcttggaggctttgctcatttctttttattcttttttctctaaactttccttctcgcttcatttcattcatttcatcttccattgctgataccctttcttccagttgatcgcatcggctcctgaggcttctgcattcttcaggtagttctcgagccttggttttcagctccatcagctcctttaagcacttctctgtattggttattctagttatacattcttctaaatttttttcaaagttttcaacttctttgcctttggtttgaatgtcctcccgtagctcagattaatttgatcgtctgaagtcttcttctctcagctcgtcaaagtccttctccgtccagctttgttctgttgctggtgaggggctgcattcctttggaggaggagaggcgctctgatttttagagtttccagtttttctgttctgttttttccccatctttgtggttttatctacttttggtctttgatgatggtgatgtacagatgggtttttagtgtggatgtcctttctgtttgttagttttccttctaacagacaggaccctcagctgcaggtctgctggagtaccctgcagtgtgaggtgtcagtctgcccctgctggagggtgcctcccagttaggctgcttgggggtcaggggtcagggagccacttgaggaggcagtctgcccgttctcagatctccagctgcgtactgggagaacccctgctctcttcaaagctgtcagacagggacagttaagtctgcagaggttactgctgtctttttgtttgtctgtgccctgcccccagaggtggagcctacagaggcacgcaggcctccttgagctgtggtgggctccactcagttcgagcttcccggctgctttgtttacctaagcaagcctgggcaatggtgggcgcccctcccccagcctcactgccgccttgcagtttgatctcagactgctgtgctagcaatcagcgagactccgtggggtaggaccctccgagccaggtgcgggatataatctcgtggtgcgctgttttttaagcccgtgagaaaagcgcagtattcaggtgggagtgacccgattttccaggtgccgtccgtcacccctttctttgattaggaaagggaactccctgaccccttgcgcttccccccgccgagtgaggcaatgcctcgccctgcttcggctagcgcacggtgggcgcacccactgacctgcgcccactgtctggcactccctagtcagatgaaccgggtacctcagatggaaatgcagaaatcacccgtcttctgcgtggttcatgctgggagctgtagactggagctgttcctattcggccatcttggctcctccaatgtcttctctttcatttcttgttttatttatttgagccttatctttttttcttagtctaaataaaagtttgtcaattttgttcatcttttttttttttttttttgagacagttgctctgtctcccaggctggaatgcagtggcgccatcttggctcactgcaacctccacctcccgggttcaagcagttcttctgcttcagcctcctaagtagctgggactacaggcacatgccaccatgcccagataattttttgcatttttagtagagatggagtttcactacattggccaggctggtctcaaaattctgacctcaagtgatctgcccacctcagcctcccaaagtgctgggattacaggtgtgagccaccatacctggtgattttgtttatcttttcaaaaaaactaactgttagtttctagtaagacaagtctgggtggcaatgaactccctcagcttttgtttgtctggtaaagtctttatctctccttcatttctgaaggatagctttactgggtaaagtattaattggcagggttttttctcttcggcactttgaatatatcttcccactctttcgtggcctatatttctgctgtgaagagcactgctagctttattggaactcctttatatgtgatatgctgcttttctattgttactttcaggatcctctcttttatgttgatttttgacagtttgattataatatgtcttggtgttgtcttgtttggattgtatcttattggagactgatgaccctcctgtacctgtatatttatctttccccaggttcggaaagttttctgttgctattgattgaaatgtgttttccagaccttcatatctcttttctccttattgaactcctataattcagatatttgcccttttgttgttgtcccataagtccctaagcttttttttttattgaggaagatctttttttaatgttattttttttttatttccagcttgtaagttcagggggacatgtgcaggatgtgcaagtttgttacataggtaaacgtgtgccatggtggtttgctgcataaatcatcccatcacctaggtgttaagtccagcatccactaactgttcttccttatgatatccctcctcccagcccccaccctccagcaagccccagtatgtgttgctaacccccatgtgtccatgtgttctcatcattcagcttccacttataagtgagaacatgcagtatttggttttctgttcctgcattagtttgctgaggataatggcttccagctccatctatgtccctgcaaaggacgtggtcttgttcctttgtatggctgcatagtattccatggtgtatatgtaccacattttctttattcagtctatcattgatgggcatacgttgattatatgtctttgctattgtgaatagtgctacaatgaacatacgtgtgcattatttttataacagaatgatttatattcctttgggtatatacccagtaatgggattgccaggtcatatagtatttctgcctgtaggtcttcgagaaatcaccatactgtcttccacaatggttgaactactaatttacattcccaccaacagtgtaaaagtgtaaaagcattcctttttctccacacacaaccttgccagcatctgttgttttttgactttttaataatagtcattctgactggcatgagatggtatctcattgtggttttgatttgcatttccctaatgatcagtgatgttgagctatttttcatacatttgttggccatgtgtatgtcttcttttgagaagtgtctgttcatgtcctttgcccactttttagtgggttttctttttttttaatttgcttaggttccttgtagatgctgggtattaggcctttgtcagatggatagattgtaaaaattttctcccattctataatttatttgttcattctgatgatggtttcttctgctgtgcagcagctctttagtctgggaaggcactttattggcctatcaaggaactatgggtaggctgttttgcatggttcacatgtgtgctgactcctggagtcctttggcagcctggccttgttcctggattagcagctgggtgggcctggatgcctaggtccatggggttggatctggagcctatatccactgaggtggacttcttgattgggtctgaaggattgggcttggagcctgtatccaatggggctggcctgaagtttaggcccccattggctgaccaaacactaaagtggtgagtctgaatctgcaagagccagccaggtgggaatgggccttgtgcctgggtcccctgggataggcctggagcctgagtctgtaggggttggcctggcactggggtgggcctcaagcctgaggactagggcaggcctcagtcctaggtcagtgggtgctggcctggaaccttggtttgtaggggtggttttagagcctcagtccatgggggctagcctggcacctgggtctactggggtggtactagacccttggcctactgcagcaggcctggaccctgggtctactggagcttggggccactgagacagtcctagagcctggagctggcctggagttggggcagatgtggagcctcgggccacaaggactgccttgaagcctgggattgttggtactaaattgctatttggagacacactggctggcctagtgtgtggggctgtggggacctgcctggggcctgggtctgtgggggccagcctgggggatggatgtgtgtatgctagcctggaggctaggtctgtgaggtctgacctgggtcctggagctgcaggagctgtcctggaacctggctgcataggggaagtgctgaggctttgatccatgggggccagcccatccctagggtctaaattggcttggacccttggtctgctggagcagacttggaccgtggctccactggagtgtggagtgacataagcaggtgtgaaggctgtgttcatgagtgctagcctcgtacctatggccaggggtacagatctggtattggggcaggcctgtagcctggggctgtgtgggctgacctagctctgaggtggtctgaaaacctggggtatgcctggatcctggggctgcaggggctggcctggcactgagtaggcctggatcctatatctacaaggagcagcctagaggctgggtccatgggtgctgacctgatgactagggctgtggggctggcctagtgctgaggcagacctgaagcctggggctacgggggatccagcttcatactggcagcaatctggtgcctggaactactgatgtcagcctcgtcctaaggatagagactgcatctaaagcctgagtctgttaggactgctatggcactgggacaggcccaaagcctggggctaatgggtctggtccagcactggggccagtctggagcctgaatccgctggggttggcctggtgatgtggcagtcctagagatcaagtccttcgggcaggtctggagcctgggtctgcaggatatgacctggagtctggggccatgggggcctgcccagtgatgagttttactgccgccagcccattgttgtggtctgaggtaaattccagtactcactttcctcttcttcccctaagtggaggatatctgtcttcatgctctatggcctggggttgggggaggggtgacatgggtattaaaaagctgttgttcctacactcttcaatgcatcttttctatttctgtgccacagccaggtgctgcaatctctcacctagttttcctagctcttgtggaggtatttccatgtgtggatagttgttcaaattgatgttcttgtggggaatgagcgctggaaagtcctattccaccatcttgttgatgttcagtggacacaagctctttatcagacatgtattttgcaaattttttctttttattaacaccgtctttcatgaacagaagttttaaatttcgacatagtcctatttatttttcttcttttatggattgtgcttttggcattgtagttgagaaatctttgcctactgcaaggtgacagaaaaggtctcatgttttcttcaagaaattttacagttttaggtttacatttatgtctatgaacaatttttagttaatttttgtatttggttcaaggtatggattgaaaatttttttttttttttgcacatgactatccaattgttccagcatcatttgtttaacaaactattctttctctgttgaattgcctttgtgcctttatcagaaattagttgtcatatatgtgtggatctctttctggactctattccattccattcttctattcatccatccttacgctattcccatactgtctttatcagtgtagctatgtaataaatttgaagtcaactttaacaaatccatccttacactattcccatgctgtctttattagtgtagctatgtaataaatttgaaccccaactttgttctctttctaattgttttggctattccaaggcctttgtatatccatatgaattttagaatcattattttaagttttgcataaatgaattttgattcgtattacattgaatctatagatcagcttggggataactgacatcttaacaacgttgctgagtcttccaaaccacgaacaacttacatacctccatttatttaggtctttaatttctctcagcaatgttttctacttttcattgtacctgtcttctgcatcttttgtcagatttatccctaagtacactatattttatgctattttaaatggcattttaaaaaaatttggtttccgattgcttattgttgatatgtagaaatacaaatgatttcttgtatattgatcttatatcccacaactttggtaaactcacttattagttgcagtacagtaccttccctgtagattccatcagattttattttatttttgttttgttttgtttgtttgtttatgagacctgttctgtttcgagacctgttctgtcacctaggctggagtgcggtggcatgatctcggctcactgcaacctccacctcctgggttcaaacgattctcgtgcctcagcctcccaagaaactgggattacaggcatgcaccaccacgcctggctaatttttgtatttttagtagaaatggggtttcaccacgttggccaggctggtctcgaactcctggcctcaaggaatcctcccaccttggcctcccaaagtgctgggattacaggcatgagctactgcaccagccccatcagattttctaaatagacaatcatgttgcctgtgggtaaagataatttcacttctttttcaatctgggtgcaatttatttttttcttgctttgttgctcttgttagattctccagtaaaatttgagtaaaactgatgagagtggacatccttatctttttcctgattttagggggaaagcattcagtcttccaccagtaagtatgttagctgtaggtttttcacagatatcctttatcaggttgagggagttccatttggtggtgggaggggtaaggaatggatgttgaatttggttgtatggttttctgcatctgttgaaatggtcaatttttaaaaaattgttaatatagtcagttacattaattgattttcaaatgttaaaccaatgctgtatttctggaacaagccccacttgatcatgatgtatactcctttttatataatttgatttgctaatggtttgtttagaatatgtgtatctatgttcatgaatgaaattggtttgtagttttatattcctgtaatgtttttggttttgctatcagagtaatactgacttcatagggtgaattgggaagtatattctccttttcagttttctggaagagtttgtgttgaaatgatattatttcttcctcaaatgtttttggtagatttcaccagtgaagccatctgggactggagttttctttatgcaaaggtttttaattataaattaaatgtctttaatagatatagggctattcaagttatctattatttattgatttagctttggtggtttgtgtctttcaaaaatttgtttcatctaagttgttgaaattatgggcctaaagttgttcataatatcccccatattatccttttaacacctgtaacctttcttatttctgatatttgtaatttatgtcttctctatttttcttcctggtcagtgtaactaaaggatcaatcagtgtagaaggtcaattttattgatcttctcaaagaacccagcttttggttttactaatttttctctatcagttttgtttttgtttttgtttttgatagagtctcaaaaaaacgaacacagctcactacagccttggcctcccaggctcagtttatcctcctgcctcatcctcccgagtagctgggaccacaggtgcatgccactacacctagctcattttaaaacttttttgtagagatagggtctcaccatgttgcccaggctggtctcaaactcctgggctcaaacgatcctcctaccttggcctctattgtttttatctgatttctatttaatttatttacgttctgatctttatcatatccattcttctgctttctttgagttccatttgctctacttcttcttatttctaaaggtgaacactgaggtcattgatttaagacctttattctggtctatctggacagttaatgctacaaattatcatctaattactgtttagtgacgatacacaaattttgatatgtcatgttttcattttttttttttttcaggttttcctttagcatttttattagacccaaatgaaaacaaaggctaatttagaagccaagcattgattttcccatttgttaatattatgtcttacaatgagttttaacactgaaactcatctaatattaaacagaaacggttgagttacttgttgattttcaatggctgtttttccccctgcattcctccatgcatttatttgtccttgtatcaacaattacttgagctttaccatatgcaaaggggaaggctttacttctctttggaaacatagccttccctgttgcatacagtatttccacaacacacagtcttctgattcggaggaagtgacatgatggtctatatttcaacagttcttttacagtgaactaacaactttatagatgacaccatgacgttaggctttgaaacttatgcgagggtgaggattaaggaaaacagagatcttttcgagatatttataatactctcaaaggagggaccatttggatatcatattagtttcctgttgctgctgttgtaaaggctgccaataaattaccacaaagttaatagcttacaacaacacaatccattatcttacagttcaggaggccgcagtcccaaatcagttcactgggctaaaatcagcgtggaatcagggttggcagaggatgttttcattttaatttggttccaaatactttccaatttaactttggattcctttttaaacttgtggattatttagatgtgttacttattttccaaatatttgcagattttccagagaacattcttttgttgatttttaatttcatttcattgtagtcaaagatcatactttgtatgactttaatccttttaaatatattgagacttgttctagggcctagaatattgtttttcttggtaaatatttcatgtgcacttgagaggaatatacattttgctggtgttgggttgaatgtgttataaatgttagccacatcaagttgatttagtgttaagtgtactgaatccttgctgattttctattctatcagttattgagagaggatattgaaatctttaactataattgtggatttgttcatttcttcttgcagttctaccagcttttgcttcttatattttgaaattttattgggtgcataagcattcagagttatgtcctcatgataaactgattattgtcttgaaataaccttttattgccaataatattctttgctctgaaattcactttatctgatattaatatagccactccagctttcttttgattaccttcactttagtgtatattatcccatcctcttctttcaatcaattttgcttttatatttaaagtgtatttcttgtaggtggcatatatttaaaagatgtgttttgttttgttttcagtcttactatctctgccttttaattggtcatttggtcatttatatttaacatagatattgatacacatagatttaaatttagcatcttattaattatcttctgtttgtcccatttgctctttttccttttttctgctttattttggattaattgaatttttatgattacatttatctccctttttgcttattagtttgaacaaatatttatttgttgcttgaagtctatagtacacatatttaacttgtcatattccacctttaagaatataatggaatataacacacagctactcaattttttattttattctgtattatatttcaaattatggatgtaccaaagtgtgttttgcccattaattatgatggaatttaggctgatttcatattttactctttttttttttttttttctgagacagagtttcgctctgtcacccaggctagagtgcagtggcccgatctcggctcactgcaagctccgcctcccgggttaacgccattctcctgcctcagcctcccgagtagctgggactacagacgcccgcaactgcacctggctaattttttgtatttttagtagagacggggtttcaccgtgttagccaggatggtctcgatctcctgacctcgcgatccaccctcctcggcctcccaaagtgctgggattacaggcgtgagccaccgcgcctggcccatattttactcttataaacaatgctggatgaacatccttatgtgtatttgtttacttttgcaaatatatccgtaagataaattcacagaagtgcatgtgcagttgctcagttgggcatttttctggtgttcaaatcctccttgaaagcttagcaactcacattactttatgaatactaacattttaaaaatgttcttaaaataagttccaaattcattgtggcataattaaccatagatatgtaatttctttgattagagtatatcatttttgaatttttttcttgtttttcagctttgcaggcaataattactttagagaatatattaacagatgaagagtcagaagataatgatctagttgcagagagaggttcacctaccatgcttctaagtttagctgcccagtttgctctagaggtaattcatatgtattcatctactagatttttatcccttttcctttttgaaagacaattaatagaatcattatcagttagacacagaagagacctttactgtttgttttgcctcatattttcatgccaaacttggttgcagaactgctttatttcttctcatttcactataatgcagactaaagtaaatgaaacagtgaggtaacagagttgtgctcaaaacaacataaaaataaacgtagcaaaacattaattttttaaaagaaactccaaattcaaaatgccataccatgtcaataaatagctatctatatagaaacttatctttctcatcaatttgaacaaaatggtttaaatttctggagatcctttgagttcataaccacaaaatagtattagtttagaagtaataaataattgtacccctgtttgttactacagaattctggttttattaatatattgaattaggaaaagcatagtagcatctgtggagctcttagactaggtttgaatactggctctgccatttaatctgtgcttaacttcttcaaatcttaatttcatcctttgcaaaataaagataatgcctacctccaggattgttatgaaaatcgattaagatggctgaaaatgtgctttataaactattaagtttatcttctttttaaaactactttaaataggaaaaccatcttcctgatcagaactacagttccatatttcttccagtagctctctttggctttctacatcaaatgtacatttataaaccttcctttaaaaagataattgcttttgggtttcctctctttcatcttcttccccattctgcacaaatacattccatatctgcatctgccaaatacttttcttccttcaggagttctattacccttctcactaacatcaaaatacatatcattcaaactgtatttagcaactactttgggcaagatattgggctagatgctagaaatatgttccttcaggacctcacaagtcaatttgaacagacaagccatgcattaggaaagtaagtctacagaatatagagttctatgtaagtatatagaataaagaccaaatagctaatatatatgttaaaaattaccaaaattcagagtaggaagagagcactgagaaccagaatcgatttgggaagtctctacagcggaaggaaaccttaagttgggctttggaaagagtagcatttacataagtaagaatgtttttttaaaggaagagatggtataaacaagacatggagaaaggaatgtgattggcttgagagacacagtgtttggttaaagtgatggagggcttatgtttccaccattccagatgttttgcctgatgtaatagtggctttttttttttttttgacaaagtctcactctgtcacccaggctggagtgcagtggcgtaatctcagctcactgtaacctctgcctctcaggttcaagtgattcttgtgcctcagcctcccatgtagctgggattacaggtgtgcgccagccacacctgactaatttttgtatttttagtagaggcggggtttcaccatgttggccaagctggtctggagctcttggccttaagtgatctgtctacctcagcctcccaaagtgctgggattacaggcatgagccactgcaccagccatgacttttattattatgttgatgctataggggaggagtatgagataaagtagaagaaatagctgtgacaagattatatatacattttattctctaaacaataagaaaatattgatggtaatttatgtaaaagtagtgctttaggaaaataatttgggttgtgcatggggaaatgaatggggagaaattatatgtaggacagaatgggagactgtgataataatccagttttaaaataatgagagtctagacaagggtagtgagagtggggtattaagcaggcaaaacattgctttcttttcttttaaaataagctaccttatctttaaatccctttacaaaattcattcccccacctcccaagagaaaatgtggatattctaggttctgaaaactgaagcagtcaggaagagaacttccacagattcctactacctctactcacacaccaggaatcacaccacatagtctgccttctcaactgccaccatagattagctatcatgttccttcctaaagccagtctctaaacttacacacttgtttctatcacctcttgcctttttctcactcactttgtcaacattttattctcttactggtttattcccatcagcatatgaacatgctcatttatcccatatcaaacaaacaaaaagtaagaaaacctcttgaccttccttctctcaccaactactccccaatttctcttcttccctttgtagttaaactcctctaaagatttgcctatatttactgtctccaattctctcttgagcttactccaatcaggcttttgccccaccactctaacaaaactgcttttgtcaaggtcaccaatgacctctttatcgtaaattgcagtggttaattctcagtcctcattgtatttgacctatcagcaacattcaatgcagttgatcactctttcctccttgaaacacagttggcttccaggacaccacattatccttatttttatcctacctcatgagtcactctttctttctcctttgctagttcctcttttctcttcaaccattctcagtgtcaaattatgagctcaggagaggaggtattagggagttgagaagaagggataaggtattaactattcattcagaaaagtaagaaagtgaatgactacggaagtgcaatatgcttgccagtagcactaaggccatttcatgaagttttaaaataaaacaagtagttgtatgtatttttttctggccacattcagctgatgagtggatgtaagcaccaaaatcagtagaaagttggacttaatcagagttgaggttttgccagatgaatacaataaagcaaaagaagggcaggaaaatcaaggaacaagggagtggttataattagtctccatggaatttaaactgggtatgcggtagaacatcaaggggatgagggacagtgaaaaactggtaacatcagtgggttgggggtcttactgcagttgaaggattgctggagtcagggtaatagaggtatcaagttggaaaggtaagaggcggtagacagaaagtagaatgtgtgaaagtaagagctggggtggagaactagggggagggagggagacacctagggcacaaaacttaaggaggaacttattctctgggtggtacaagtaaaggcttggtacttgtacaacactgagagcctccttaaatttttcaccctaggtgcttcactcacctcacctgtcccaccctactcctagccctgactgagagtgtgaaatgattgcaattgttagtaatgacagagtctagtgaatgactgtgggagtaaatggctaaggtaattgttagagtaaaatttcagaaaccaggaaactagaatattgggaggatcctctacctatatattgaaaatgcggaaaatatgccgcgcgcagtggctcacgcttgtaatcccagcactttgggaggcccaggcgggtggatcacctgaggtcaggagttcgagaccagcctggccaacatggtgaaaccccatctctaaaaaaactacaaaaattagccaggcgtagtggcgggtgcctgtaatcccagctactcaggaggctgaggcaggagaatcgcttgaacccaggaagcagaggttgcttcagcctgggtgacaagagcaagaatccatcttaaaaaaaaaaaaaagaaaaagaaaaagaaaatgccaaaaattaagacaggagcagtttttggaaaatataactgagcaataagtaagtcaccaacaaatgagaagaaatgacctgggagctagtaggccacagcaacaatgaagggtagtgggtgatatagtctggttataggaaattcaaagttgaggattttagggaatagaatgggagaataattttaaaatggcaatgaagagcaagaaagacacctactccatctccaggcctatgggtaagctagtgagagcaaaaacagctaccacttaagagggcttcagtggaagcagcatccttggcagaaacctagatttccattagagcaagaatatggaggaaacttttagggaagaggttgctggtagaggagattttgctgaaagtggactgaatttcagagagcatagtggaagggttggaggagtcggggagagatagaaaaagaggacagaagaggggatatatggagacttttgggaatagagtgctggaaatgagggtgacctgacaatctggggttcttttgtttactgctaataagtgggggataaagagcacaataagattagtcctagtggactaagggtagtattggcaaggctttgagtgtttgtgaatagggaggattcggtttccggggctaatgcaaatgtgtcctgtttttgtcagtgagttgcatcttcattctaccatcttgcagtagcgtttttgagaatacaaaatgaacatgtttagatatttgtcttatctttaatgaacaggaatatagataatattttgcagtatcactttgagatgtaatttaacgtattatatttgttctttttagaatggacaacaaattgtggcagaaaaagctttggaatatttagctcaacattcagaagaccaggaacaagttcttacagctgtaaagtaagtaacctacatcctgtggaagagaaagtatttcctctgcttatcttgctcttagtcaataaactgccaaaatagtgctattgagatcaaggaaacttacataaaatagcgaagcagaggagggtgaggttgggacttgataaatacttaatggtatgactgagaaaatgccacagtgagaaataagaaaccagcaggattctagagtggttctcctgttggtcaattacacttgaggccacatttccaaagggaaatggagtcacataaataaaagagtcagaggagtcttgagatacttgcatcccttcagtaaggtaaatatttaaaaatcattcaggagagatagtattttttaaagctttttaggttttaaaactttaccaactaccttattttgtcagtttgtcattatgctgccagatcccttcaaagaatagtgatcccagtttgagacccaaaggccagttctagttcctctacagaaagagaaagataaagactgatttaccatacctgatgttctagcaggtgtttttgagcaatggtataaactgtggaaccatttaagaatttgttataagcaacgcttttgttttaaaactcttttattaaattcctctttcaaaattataaaattggtatgttttcattgcaactgttaaaacaataaaatatatataaattaaataagattaatctcccctttaccctctcttttctcacttctccctcccagagtaatcaaggttagtaacttggtatgtattcattcacacatgtttcttcctaacctaagaatcactttccatattactttgtcatacaggtgtttgcttcgttttcttcttccaaaaattgctgaaatgccggaatctgaagataagtgagttatttcaacaaaaatgatgtattccccattagacaaattatagtaacttacaatataaatcatatattcagagatacttagtgtagtgggtaagatcaatacaggttttggggccagtcttcctgggttcatatcctggctctgctgcttaccagatgtgtaaccttcagcaagtttcttaatgtctctgggcttcagtttccccaactgtaaagtgggaagaataataatacctacaccattgggttgctgtgatgactcaatgagttaaaacatctaaaaggcaaaagacttatgtgatctgcagagaaacgagagtataagttaatacatgtgaaacatttagaagtgtcaggaacttaataagccctcaataatgttatctatgatagaattatgatattgcatctgttccccctttcttaacagatgactcaaatatagacatatctcttactttcccacagaacatataacctggatggcttgttggttatgattctgtatcaggtctgctgagagtattcaaatatatttctgtgcacaatatctttggaataagatattaaaacttaacaattcgttgaagactttggtcaccaatttttcgttcacaaatctcactacctcctgattatttgaaagaaaactctactcggggtgttgattagggataactttcagagaaatatcacccatctctgcattctctgcttagacaagaactctgtaatagttccctctacttcacttttgcagctggaggcaatgtattttttcaaataaattcttttggatatatctttgactgaggtaacataggacagatgacttataactgtcattttcataatgcaaattttacccaattgcatattataagttttgccttttctttataggcttcataaatccattagaagggaattcaaacaaaccaaacaaaagatgaagcaattggaattttgaataatgaccaaatatttgctgatactaagaaattattaacttttagacatgataattgtagtgtggttggttttttaaaagattgcttatctcttacagacacatcttgaaatatgtatggatgaaataatgtgatgtctggaatttgcttcaaaataatatgggagaggaagaagtgggtggaggtatcaaggagataagattgatgatgagttaataattattgaagctgtgtgataggtacatgaggattcattatgcttgtctgttaacatttggacatctttgaagttttcaccaataagaagcttttttaaaaaaggactaaaccatgataactactagattgtaagagtacctttagggctaggactatatttgtatttatctttgtatcactgaaacctagggcagtatctgacacataattgccattcgatttatttaaatgactgaatattagttatttataatatctccagcactggacttaaagatgcttcatatttctcataattgtggcatacagtcaaaccacacacattaaaaccaattgggaaatggggtaagggagggaatcctgtttgaattaatgagaaattacaaacactttttaaaatataccttcattgttttcaagtaaatgcagtgacagagaacatcctctagcaatgttttcaggtagaggttagaacctgatttaacaaatagattagactaacttgtaaaaaatattttaagtgcctaattcaatgagagggctcaagagaattgaattgtaggttcagctatttcaataacttttggtttactgtaggcaatggcaacttctttaacttctctaagctttattttcctcatctgtaaaattttaaaaactggactggataatttttataggccttttctgttccaaaattcctgtggttataaatgagcagtatctacctaagtactaacaactcatatgctaaatcttttaaaagcagtttttctcttaaatagattatacattcctttgcatgtcttcattcttatttgtactgtatatttttattaatggacccttcctagattatttgatatgaagtcaccgaattaagcagtgaagaaatcaactttagcttggctgaaattcaaattaataaatttactgtaagaagttactttatataaaccagacttctaagatttatccctgaaaaatctgctgcttttcctgaccacagtctttatatgttaaacctctactgataaggccagtcttatagtatgttctacccttcttcctgtaaacttccttagttgagtttgccaatactttcgtattcattcctttgtttgctttaagtttttatttcattttattttttaagtttaatattttatttttatttatatatatatatatatatatatatattttttttttttttttttttttttttttttttgagaccgagtttcactctttcgcccaggctggagtgcagtggtgtgatctcggctcactgcaaactccaccttctggtttcaagtgattcttctgcctcagcctcctgagtagctgggactacaggcatccgccaccacacccggctaatttttgtatgtttagtagagacggggtttcactatgttggccaggctagtctcaaactcctgacctcgtgatcctcccacctcagcctcccaaagttctgggattacaggtgtgagccaccgtgcccgaccctaatattttatttttttagttaaattttaggttcacagaaaagctaacaggaaggcacagagattcccatacatcccctctccccaccacatgcatagcctcctccattccccgccagagtgctacagttattacaattgatgaagctaaattgacatatcataatcatttgaagtccataatttatattagggttcactcttgatgttgtacattctatgggtttggacaaaggtataatggcatgtatgtatcattacaatatcatacagagtattttcactgccctaaaaattctctgtgctccacctattcattcctccttcatcaaccccttactgtctccatagttttgtcttttccagaatgtcatacagttggaatcatacaatatgtagccttttcacattcgcttctttcacttagtaatatgcatttaaggttcctccatgtatttttgtgtcttgatagcactgaatgatattgtattgtatgaacgtatcacattttatttatccattcacctactgaagggcatcttgatttcttccaagttttggcaattgtgaataaagtttctgtaaacattcatgtgcaggtaactttttagctcctttggtaaatattaataccgaggagcatgattgctgggtcatatggtaagactatgtatgtttggtttgtgagaaaccggtagactgtcttccaaagtggctgtacccttttgcattccttcctgccagcaatgaataagagtccctgttgctgtgtgccctcaccagcatttggtgttgtcagtgtttgagattttgaccattctgataggtatgcagtggtaactcattgttttattttgtatttttctgatgatgtatgatttggagcgtctttttatgtgtgtatttgtcatcgtatatcttctttggtaaggtttctgctaaggtctttggcccattcttttctcccaaggattttaggacccttgccagcaacctcagaccaaatacacttctaattataccacagtataataccacagtataaagatccctggcgtttgaccacagatcccaaatataacaaaaggatcataacggttaaaagacactggcacatggccgggcattgtggctcacaactgtaatcccagcactttgggaggccgaggcgggcggatcacaaggtcaggagattgagaccatcctggctgacacagtgaaaccccatctctactaaaaatacaaaaaattagctgggcgtggtggcaggtgcccagctactcgggaggctgtagtcccagctactcgggaggctgaggcaggagaatggcatgaacccgggaggcagagcttgcagtgagccgagattgtgccactgcactctgggcaacagagtgagactccgtctcaaaaaaaaaaaaaaagatactggcacattactggagtcccattcagtcattaataatttgtccagtccatcattatatcatgaaattgtctcccaggtcccagggcaaggctactgaggtttccaggcttctgtttggtcagattccaaaagcaggagtggtctccacaatatatggcttcaccttttcaggcatctggtataattgaactaagagacaatatcatcttttgctttgagactcttttgaggtactgatgtaatattggatttcccttactacataactcatttgttcatttcttactctcatctactattcctccttttttctatttataaccaaacttttccacatttgaaagaacattaggtgctggtccagattacaggcaacactactaatctagcaaatgcctccccctcagtccactcccatttatataaggtagggttatatagatacagaactagtggactatcttgaccattaagcaatacaactgcatttactcttaaccccaattttgctagatagggtaaagacacaccctgcccccaagaggcccttaggaattctgacataaagatttaaaaatatagttaggtttcttgcttaggaatctgccctgtttccaacacttgtagttgcagccatggtcttgctcatgtttcatcaggtaggaaacataaagttgaggtgatatgaggaggaaagaaagaaagaaaaaaatattgtcatcatgccagtgtcctacacccttgggaagaattgcagtcatactagcatccttccccaactcctcttcctcagactcagcagaaaaacagaggagtctatctagtggggacacttccttagccccaccccccatattgagtgtgagcttgtgaaggcatgtaagccagtccttcatccctatgtctgcccccattttagacaaccaatgtttcaattgcttgttccggcttccctttctaactattattccaaggaggatatatctctgcccgttgttggacattatgggttgtaaagtgtgtttcttggtctgagaaaatgtgactcagcagcccaaattggtgcagtatattctgttccagttcttttattacactctgagcatttgcatctaccactgcgtaagcaaaggccaatccagagttagtgtctattcctgtcgaaactcataccctggggctatcagcatcagtctgacttgctagctgtgttcaaggccttccccgtgaggaatctgccacatagccatcttaagtctctgtctcttttgttggaaaacagaacagttattggcattttgtgcttcagagggtacaagaggaatatgtccaggttcaacttcagaggttacaagaggaatatgtctaggttcaactcatttctttttgctgagtccccagatgcccactaatttcgtggacccagggggccgcctcaagggagcacacagagatatccacttgttgattctcatcaccttccaaacctggaaggggattcttctgatggatatcaacatgtcctacattaatgcacctctcagatttccatagtgattttccatagagtcatacaccatacaaacatcctgttaatggaccagttttccatttcccttctgtaagactacatggccaggtcattggccactgccaatgagtcagtcaaaacccaaacacaggggcttttaccactgttcaattcttccttcactgctaggaaaacagcatgcagttctgcctgctaagatgatttgtttttaccttctttgatctgatggtagccttccaaacagaatattgtttgttcaccttggaactgccatgcataaattaagcagctctttgtcaatcagttgagaactgtttatagggcactgtcccaatgacaatagaatccagcagctcctcatgcatttccaaagtcagtcctaggggaaatgagactctgctcatgagtacctcctccttgcattcacaggtagcatgatcatgtatgtataaaccacttccattttattatggagtttttctgggcactgccctcccaattagagtgtttttccaatatcacccaaggcttcatcatgggtatttcagctttcaggattattttcctccaccatccttcccatccttccaagtctccaatgtctattttatccctttctgtgtccatgtatacacattatttagctcccacttatacttgagatgtggcatttgactttctgcttctgagttatttcacttaagataatggcctccagttctatccatgcttctgcaaaagacatggtttcattccttttatggctgagtagtatctcattatatatatataatgtatatatatgtattgtatatgtgtatatatgtattatatatgtgtatatacatatatgtgtatatgtattatatataatatataatgatatatatgtatatataatgatatatatatataaaaccttcacttattcttcttttgatgcttttcctatctttatgtagatctgagtttctgacctatatcattttccttctctctaaataacttcttttaacatttcttacaaggaaatctactggcaacaaattccttcaactttctttgtctgagaggttttctttcttttaatttaattgttaattttttctgggtacatagtagatgtatatatttatgggctacatgtgatattttgatacaagcatacaatgtgtaataatcacttcagggtacatggggtatccatcacctcaaacatttattgattatacacttttagttgtttttaaatgtataattaaattactttttactatagtcacctagttgtgctagaaaatactagctcttatacattcttcctaactatttctttgtacccattaaccatcctcacttccttctaccccccgcaacccttcccagcctctggtaaccatcgttctactctctatctccatgagttaaattgttttaatttttggctcccacaaataagtgagaacatgtgaagtttgtctttctgtgcctggcttatttcatttaacataatgacctccagttccatcccagttgttgaaaatgacaggatctcaattattttctatggccgaatagtcctccattgtgtatatgtaccacatttcctttatccattcatctgttgacggacacttgggttgcttctgaatcttggctattgtgaatagtgctgcaacaaacatgggagtgcacatatctctttgatgtactgactatctcttccttctttccttctgtcctgtcttccttttagtgaaggtgatttttctctggtggtatgatttaacttctttgtttttttgtgtgtgtatctgttttatgttttttatttgaggttatcatgaggcttgcaaataatatcttttaacccattattttaatctgatgacttaacactgcttgcataaacaaattaactactaacaagcaaaagaaaaataatacaaattctacagcttaacttcttcccctcactttttaactttttgttgtttctatttatatcttatactgtctatgtcttgaaaagttgttatatttattatttttggttggttcatcttttacttttagtttttctatttaagggtagtttatacactgtacttacagtgctataatattgtgtttttttctgtgtatttatatattactagtgagttttgtaccttcagatgcttttttcttgctcattaacatcctttcatttctgattaaagtactccctttaacatttcttttaggacaggtctggtgttgacgaaatccctcagcttttgtttgtctgggaaagcctttatttctcctacatgtttaaaggatatttttgccagataatactattctagggtaaaagttttttccttcaacactttgaatacgtcatgccattgtctcccagttgtaaggtttccatggaaaagtttgctgccaagcatattgcaacgccattgtatgttgtttcttttctgttgcttttaggattctttctttatcctgaacctttgagagtttgataattaaatgtcttgaggtagtcttctttgggttaaatctacttggtgttctgtaactttcttgtacttggatattgatatctttctctagatttctctagttttctattattatccctttaagaaactttctacccatgtcactttctctgcctcttcttcaaggccattaactcttacatttgctcttttaaaactgtcttctagatcttgtagctgtgcatcatttttaaattcttttttcttttttcctctcaccgtgtgttttcaaatagtgtgtctttgagctaactagttatttcttctgcctgatcagttctactatttagaaactctgatatattcttcaattgcatttttcaactccagaatttctgcttgattcttaattattttaatttctttgttaaatttatgtgatagagttctgaatttcttctctgttattttgaatttgaatttcctcaaaacagctattttgaattctctttctgaatggtcacatacctctgtttctccagaactggtccctggtgtcttatttagttcatttggtgacatcatgttttcctgggtggtcttgatgcttctgggtgttcatcagtatctgggcactgaataattagtattattgtagtctttgcattctgggcttatttgtacctgtccttcttgggagggctttcgtgatatttaaaagtacttgggtgctgtgatctaagctgtatctgcattaggggacaccacaagcccagtaatgctatagttcttggagactcatagaggtactaccttggtggtcttgaataaggtccggaagaattctctagattaccaagcagaaactcttgttctcttcccttactttcccccaaacaaacggagtctctctctctctctcgctctttctctgtctctctctctcactctctcctgaactgtctggcattgggggtatgttgatacaagcacccctatggccattaccactagaactgcactgggtcagacttgaagccaacacagccctggttctcacccaaggcccactgtaagcactacctgactaccacctgtgttgttggttcaaggccttagggctctgcaatcagcaagtggtgaaaccagctagtcctgtgtcctcttcagggcagcaagttcccccaggccccaggtgagtccagagaagctgtccaggagccagggacggcagtcaaaaaccttagaagtgtagctcagatgttctcttctactgtggctgagctggctgtcaaaccatgagacacagtccttcccactcttccctcccacttccacaggcccatggggagtactgccagcctaccgctgatgttcacttaaagcctgaggacttttcagtcaccttgtggtaaatgctgccaggccttatttcacctttcagggcagtgggctcccctctggcccaaggcaggtccagaaataccactcaagagccaaggcctagaattggggatcctgagatcccgcttgatgctctaccctactgtggctgagctggtacctaaggcataagacaaagtcctctttacttttccctctgcttttctcaagcagaaggagtctctcaccatagctgccatagctgggaatgtggtggatctcacctgaagccagcacatctcagagtttcacccaaggcctacagtgtactacttgggatcactgctgattattcatggcccaagggctcttcagtcaacaggtgatggatccttccgggactgggtccttcccttcaaggcaatgggttctcttctggcccagggtgtgcatcaaaatgtcatccaggagctagagcctggaatgggggtctcatgcctctgcccagtgccctatcctactgtggatgatctgatatccaagatgcaagacaaagtcttccctctcttccctctcttctcttcaagcggaaggaagaggtctcctttggagccacaagctatgctacccagggttggggaggggtggaacaagcacccccttagctaccccagctggtggctcagtaagttgcgtgcccccaagtccattggttctgagcccagctcagcactaagacttgcagtccttgtggcctagactgtctttcaagtttatttagagccccagagcactttagcccatgatgacgaggcttgctggaattcagattccaacgactgggatgggagattccccacttgctacagctggtccaaatgttccctctgttagcgggagttggctgtgtttagcccagttttccttcctgctgtgacagggcagcactgagttcagtgcaaagtctgataatctctgcactctctctctctttctcaagtgcgcagatttctctgcaccaggcagctgctgggggatagggaaggggtggcattggtgattaaagactgtctttcctaccctcttcagttcctctttcaacaatatgaagttggaaccagatactgtgagtgctcacctgatttttggttcttatgagagtcattttttgtatgtagacagtggttaaatttggtgttcctacggtgggggaggatgatgggtgggccttctgttccataatcttgctccacccctgtgtctgagagtctttattttccttcacttttgaagtataatttcacaaggtacaaaattctgggttagtgggattttctctcaacatttaaataatttgcttcagtctcttcttttttgtgtggtttctgagcagaagtagaatgtaattcttatctttgttcctctttaggtaaggtattttttcctcaggctttttttcagaattttgtctgtatattttatttcctgtagtttgaaaataaaatgcctagatgtctttttttgtcatttgtcctgtttgatgttctgagcttcctgaatctgtgatttgatatatatgacattaatttggggaacttctcagtcatattatttgaagtattttttctgttgcattacctattcttctccttctggtattcccattacacatatgttacaccttttgtagttgtctcacagtccttggatattctgttctatttttttcagtctttgttctctttgcttttcagtttgggaggtttctgtttatataccctcaagggcagagattttttttttcctcagctttgttcaatctactaataagcccatcaaaggttttctcatttctgttacagtgtttttgatcactagcattcctttttggttcttaggatttccatctctctgattactttgctgatctgcccttgcatgctgtccactttatccattagagcccttagaataattatcataatcgtgatcaattatcatagttgtcttaaattcccagtctgataattccaacgttcctgctatgtctagttctagtgcttgctctgtgtcttcaaattgtattttctgccttttagtatgccttctaattttttcttaaaagctgggcatgatgtaccaggtaaaaggaactattagtttcctaataaataggcctttagtaatgtggtggtgaattgtggggagaggggaagcattattattattattattattattgagatggtgtctcgttctgtcacccaggctggaatgcagtggcatgatcatggctcactatagccttgacccccacccaggcccaagtgatcctcacacctcagtctccagagtagctggaactgcaggcatgtgcaaccacagctggctgatttttaaatttctgtagaaatgtggtctcactgtgttgcccagactagtctcaaactcctggattcaagcaatcctcccgccttggcatcaaaaatgctgggattacaggcatgagccactgcacctggctgggaagcattgtttagtcctatgattggtcttttagcaagcctatacctctggactgtgaacttcacaagtgcttctcaggtttttttctcccccattaagtgggacaggatggctagagtggactgaatttgagtatttcccttctccgagatcagttaggctctgatataccccagaaggtcaggctgtggttaagcagtttctcttgagggcaagacttgttaagaacagggtgctctggcatgttttaaagtgttttgtttcctctgccccctgcaagatgcataaagagattttgctccaatattcactgagtagctaaccaagctcctggaggcaaaactcacaaaactgtggaggcctccttatgactgggtcctcctgagtcttttaattcagacttgtccacactgagcctccagtggtttgtcagttacgcttcaggttttcctactccagcattggttcccatggtagtttccacttttgaatctctgctctagtaagctatgactccctatcttcgcccttctctccaatttttgtggcagtggttttccctttttcctctcgtctcttataggtccaagaagagttactaatttttcagtgtgttcagcgttttacttgttaggagaaactggcaacttccaagctccttacatgcataactagaaaccggaagttctcttttaaattttatatgcttaaagaagcttgacagaggggtcaggaaacctgggtctactcttttcttcatctgtaaaatgatgtgtctgtacaagataagttattttttaagctgcattccttagaaccgtggaaattttgtggcactgcatcagggacttccaggaaggtgaaactccaagcctccacccactcctcgttcaaccacagcagctcaacttttatcttttatcttttcttgtatattagacttttatacaactttatttgaaataagggttctagttccccccttcaaaaaagcttataaatcacagagatcaccagctgctctcaagtgttatgaccctacaatataaaaccttgtcattgaaatcctttgctgagagtttatgaagaagtagaagagagaaaaaatatgagggcactgggaatgagtaactgtatcctacagtggggaagaagattgttgaaatggtagattggagtcctgagcaaaaaacttcacaattttgcattttcttagttcaattctcaggcacaaatagtgtccctttttagttatgttttatagtaaagatttggagcagttggaaaatatccttttctttatttttaggaagaaagaaatggatcgacttttgacttgcctgaatagaggtaaatatctccctggttatattcagtccttcatcttgcctctattctctgttgaattctccaagtacactaagcacagcaactttaaccttatgtttgagttaagcttcatgctccttattaatctttgccacaggaatctattttggtttcttcattcacaagcagagaaaagtgtgtcatcattagcattcatctccaaatgtgatttcagttctgttttaattcctatttgttttaaggacatttccttccctccctccctcccgtccctccctccctccctccctctcttccttccttccttccttctttctctccttcccccttccctccctcctttcctttccttctctcccttcctcccttctctccctccctgtccctctacctttcttttctagtagccacttgatcctaacctaagaattgaacaggtgaaaaaagatcaagacaaataaaaatactctgaaccctgctgtttttttcataccctctgaatcaaattcaggttgcatattctcttattttgaagctgtccacccaagtctgtgccatctcccttatctactaataatttttccctgtccactttattcaagctaatctcctagttgtatcacattttttttctaactacatgcttttttacatggcatcccttttaacagatctcccatttttactgtccatgtacctctttccttatgtccaaaacacaccaaaaagttcatatcttagaaattctatcctgctcagtgcagtagttcaattttatacctcaaatacctgtcagcagggtgttaaacatagcaaagtggtttagaaaccagaccacttcttttcaaaagagaaaaactttgctggttggcattcttatttctcagaaagagaatgccttctgatagtgatagcacattctggttctgtcctgagcttgctggctcagtaaatattatgccagcatattgatacccttctaattttcaatctccagttcagtcttttaaacgattgtttctattttttatttcctcacatgtaaatcatatctttctacctcaggtggtgaatgattgcactaattaaaattataaatctctccaaagacatgtttgttccccagagtttgagttaacaacttcttggaacttggtaatgctttctgtcattttaattacttttggtatgcacccctacacacatacacaaaaaagaactttctaaattcaaactcctgtgagactgttcttaaagcaggattaaacaattttgctagagtataaaataagaccatcagtatcaaattttcctgtttgatgcagcctttgtgaaactttctcagccttttggtgaagaagccttaagtttggagtcaagagctaatgaagctcagtggtttcgaaaaacaggtaagaggaaattctgtggctctgggaaacattgtggggtggtggaattagacagatgtgatttcaaattctggatctttcatttgtagctgtgggtacagagataacttgcttaatctgttttattacttataaaatggaaatagttatatatacttcatgcagttattaagggttttaaatgaaacagcatatatacttttttcatagtagatactcaatggacattagttgtgtcccttttctatagaaatgggtctaagatgaaactaatgaactgtaactacaggtcctcaaggttgtgctcctaaacttggtttagaatacttaatttttttttttttttttttgagatggagtctcgctctgtcgcccaggctggagtgcagtggcttgatctcagctcactgccagctccgcctcccgggttcacaccattctcctgcctcagcctccctagtagctgggactacaggcacccgccaccacgcccggctaattttttgtatttttagtagagatggggtttcaccgtgttagccaggatggtctcgatctcctgacctcgtgatccacctgcctcggcctcccaaagtgctaggattacaggcgtaagccaccgtgcctggcctagaatacttaatttatttctgagtgtgattgaccaaaaatgaactatatacaacaatatggatgaatctcacaaacataatgttgagcaaaagaagctagatattgaagaatacatattgtgttgttcattttatttataattttttaaatgggcaaaactaatatatggtgttataagtcaggataatggttaccctggaaaaggagttggacttgaaagttgtaggagcttcagggtttctggtaatgttcaagatctttcttaatgtgggtgccagacgcatggatatgtccactttgtgaaaattcatcaagctgtacaattatgagttgtgtaatatactttataatggctctatttcaataaaaatgattttaaaacttgcggaggcagttactacagtgataagtaagcatgagcaattaagcagcagtgccacaaagtggactgattctacatgaacctctccctgtgttatgaggtttaatagggctttaatcctgggagaaagggaatgaatactgcaatctgacttctaagaaactgatgcaaataatgaaaaataacaaacatttaaaatatagacaagtttggtgactttaatcttttgaaggtttgaaaaggaatgtttttactttactgcattttaatttggattttccaaggggaagatgatgctgactgatgcctgatgagggcttctactgctctttggaagatatgaatctctccagtaatttttctcaactcttgattacagtgtaccttgttcttaggtgaattttaacttactttcaccactgcgagttagtgagctctatccatgttgatcttcatttttagatagattagtgtcaattaagaattttttttttttttgagacggagttttgctgccagactggagtgcagtggtggcatcatagctcactgtaacctcaaattcctggtgtcagtcttctgggactatagttgtgtgccaccacacctggctagttttgttttgttttggtttgttttttaatttttttgtatagacggagtctctctctgttgcccaggctggtcctgaactcctggcctccagcaatcctcctgccttggtctcccaaagttctgggattataggaatgagccaccaagcctggcctcagctaagaattcttattgcatgtccccaattttaaaaaattcagcagtacctcccttggtcattggtctagtgttgaagattggaattgacgagggtctctaaatttacctggaaaatttttctttaaaacctaaagttaattgtttaaaccttgagaaaccccttactagtatgttaatatcaaaggtgtaagtatcagaaattgtaatggtacagactaaatggtagattttcataatttcatattattatgttatttcatgttaatttccagcttggaacttggctgtgcaatgtgacaaagatccagtgatgatgagagagttttttatactttcttataaggtaagtttcttttaataagtatctcatgtatggaccacaacaaggctataaccactatggctatagtaaagggctaaatatagactaggattgtctcttgatctaggaacttttaatatatatgtaagcaggaatgacctaagaagaatttgttccttttagggtataacataagaatgtggggcatatctttctataccaaaatatcagaaacattcatcagggagcctaaagttctaccatttaagacttatttctttgcctttgaagggatctcagcctcccaaagtcctatattaaaatgtaaatatctttaggaggggaatactctaagtagttgttaattaccaacacattatgaagagttatgggaataagtctacaagaacatagaataagtatctggggatagcaggggctgaaaaaagagataagaagcttaggcctcctttataactttcctatagcaggtcctgagtgtagcgatttgtgagtttgttatttaattataagcatttttaaatagtcgttggcctccaaggtagaggttaaatgccagaaagaggaccaagtattgacaggaagataaaaggagaaggactaaagaatatccttcatacacattcaggaatacacagtatgatatgttgagatcaattaaatgttaagagttttagagctagaaagaactataaagactatctagcacaactccttcatctcacataagagtaatcagagacctaaagagattggttgtcttaaaatgctattaatttaataacaatgatgattatgatcactgaatgtttggggagattaagaaatagtctttgcaagtttaggcataactgccattttaattaagtgaaataaattggttttagttttggcatttgtgatgggacttgtaggattggcgtgtaagaatccaaatggcctagagttttattgtagtagctgggagtttttcctaaaactatacaatgttaatgatgaggtcatgactaatgcctgtcaagatttgacaatgcctctttcaaccatgacaatatatgaactaattttggctctattcaatacaaaggtggaaatcttatttgccaggggaaaaatcacttacaaattacaacataaaccaagaagtaaatcactagatagaaatacaagggcgaatgatactacttgtcactggaaaagataggaatactgtgaagaaatgaagctttttatctctaggaaggtactaaaaacaatggaaagtaatataaaattaaaagcataaatcagtattatagtttatatcatttctatggtgacatgtgcttttccagctgaattttctcattcaaacaggaagttgctgattttcattctgattgtttgtgttcacctggcagaattctcactattcattgatgttctggttacttcttatcagatgtcccagttttgtccttctgatcaagtaattctgattgcacggaaaacatgtttacttatggcagttgcagttgatctagagcaagggagaaaagcttcaacagcttttgaacaggtaatgtgcaaccttcaaagaaaagacaagagttcagtgtgctatttgatatgtttgccttccctgatgcagttctttttgattctctttagagaatccttttctccactccagcatcgtcttgatttcaaaagtttgtaatggctaattccttcctaagcaaaggttacttttggtgtggcctcttcttttaagaagattagatatctcttcttttaaaattccccttcctatggaccactctttccaaaaatgtttttaaatatcttttatcttcattgtctgcctgtgattatatacgcgtttggactccacttttgtttcttaccacatcttctaaggaagaactcatctgtttccatagctttgatagccatctgaaattattacttatctggtttttcttctctcaattgcatttgctttctttttcccacatccttaaatatctcattaacttaatttctacaagacagaattccttacctttgcctgaattcccctatcagattcttaaatgttaccccttttaggagctatcaatatcaccgtctcccatacaccagattattggtttgcttttagctgtttacctttcttctttcaatctaagaaaattgtctccaaatcagaccaatagcatttttgtatgatttttaagatctagatctctctgcttggtttctcgtacctggacaaagaaaacttcctaatctcccatacttgtcaccttccctcctctccaagtaatataaaccctttgctgtttattctcttcctcctgttaatctcttatttcatattgttctttggatctgaaacaaactctcaccagagctatgccaactatttcgcttcttttcccttccattgttgagttcaactcaaaaaacatttgagcaccagacacttttctaggtactggggatacagagataaagaagccaaagtccttgcctctgaggagtaaagggggccctcttttaagagtctttttattttaaaagaagatgagaaaagactctaccttccccagagcaaaataaacaaacaaaaattctacttaacaggcaaaggtaaatgtaatttaattctcaatagggacttttgctttactaaaaaataataataacatcttatttttatatagtgcttttaaatttctaaaagtttttcctttttggttggtaatcctgagtttgtttaattttttatcttagtgaatagagatcaaattgatgtgggggaaatttcacaaactcttaagtacaatcattattttgtttgtttctaactaccgttcttttttattctgtgttctttctcatgtacacctctgtgttttctcagaactctctaaactagtaacctttctataatcttctttgcttttgaaaggatgtctatatacataattgaagatgcacttctgccttttatcatctaagtgtggtccctatgaatcggacagtggtactctgtctctctaaagaatacttgttcatgtccttcgcccactttttgatggggttgtttgtttttttcttgtaaatttgttggagttccttgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggctttggttgccactgcttttggtgttttagacatgaagtccttgcccatgcctatgtcctgaatggtaatgcctaggtttcctttagggtttttatggttttaggtcgaatgtttaagtctttaatccatcttgaattgatttttgtataaggtgtaaggaagggatccagtttcagctttctacatatggctagccagttttcccagcaccgtttattaaatagggaatcctttccccattgcttgtttttctcaggtttgtcaaagatcagagagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcctttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttccttgagcagtggtttgtagttctccttgaagaggtccttcatatcccttgtaagttggattcctaggtattttattctctttgaagcaattgtgaatgggagttctctcatgatttggctctctgtttgtctgttattggtgtataagaatgcttctgatttttgtacattgattttgtatcctgagactttgctgaagttgcttatcagcttaaggagattttgggctgagacaatggggttttctagatatacaatcatgtcatctgcaaacagggacaatttgacttcctcttttcctaattggataccctttatttccttctcctgcctaattgccgtggccagaacttccaacactatgttgaataggagtggtgagagagggcatccctgtcttgtgccagttttcaaagggaatgcttccagtgtttgcccattcagtatgatattggctgtgggtttgtcatagatagctcttattattttgaaatacatcccatcaatacctaatttattgagagtttttagcatgaagggttgttgaattttgtcaaaggccttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggatttggtttgccagtattatattgaggatttttgcatcaatgttcatcaaggatattggtctaaaattctcttttttggttgtgtctctgcccggctttggtatcagaatgatgctggcctccagccgccccatccgggagggaggtgggggggtcagccccccgcccggccagccgccctatccaggaggtgaggggcgcttctgcccggccgcccctactgggaagtgaggagcccctctgcccggccaggaccccatctgggaggtgtgcccagcggctcattggggatgggccatgatgacaatggcggttttgtggaatagaaaggcgggaagggtggggaaaaaattgagaaatcggatggttgccgggtctgtgtggatagaagtggacatgggagacttttcattttgttctgtactaagagaaattcttctgccttgggatcctgttgatctgtgaccttatccccaaccctgtgctctctgaaacatgtgctgtgtccactcagggttaaatggattaagggcggtgcaagatgtgctttgttaaacagatgcttgaaggcagcatgctcgttaagagtcatcaccactccctaatcttaagtacccagggacacaaacactgcagaaggccgcagggtcctctgcctaggaaaaccagagacctttgttcacttgtttatctgctgaccttccctccactattgtcctatgaccctgccaaatccccctctgcgagaaacacccaagaatgatcaataaaaaaaaaaaaaaaaaaaaagaatgatgctggcctcataaaatgagttagggaggattccctctttttctattgattggaatagtttcagaaggtatggtaccagttcctccttgtacctctggtagaattcggctgtgaatccatctggtcctggactctttttggttggtaagctattgattattgccacaatttcagatcctgttattggtctattcagagattcaacttcttcctggtttagtcttgggagagtgtatgtgtcaaggaatttatccatttcttctagattttctagtttatttgcgtagaggtgtttgtagtattctctgatggtagtttgtatttctgtgggatcggtggtgatatcccctttatcattttttattgcatctatttgattcttctctctttttttctttattagtcttgctagtggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacctagtagtcattcaggagcaggttgttcagtttccatgtagttgagcggttttgagtgagattcttaatcctgagttctagtttgattgcactgtggtctgagagatagtttgttataatttgtgttcttttacatttgctgaggagagctttacttccaagtatgtggtcaattttggaataggtgtggtgtggtgctgaaaagaatgtatattctgttgatttggggtggagagttctgtagatgtctattaggtcctcttggtgcaaagctgagttcaattcctgggtatccttattgacattctgtctcattgatctgtctaatgttgatggtgggaagttaaagtctcccattattaatgtgtgggagtctaagtctctttgtaggtcactcaggacttgctttatgaatctgggtgctcctgtattgggtgcatatatatccaatacgaagacatttatgcagccaaaaaacacacgaaaaaatgttcatcatcactggccatcagagaaatgcaaatcaaaaccacaatgacataccatctcacaccagttagaatggcaatcgttaaaaagtcaggaaacaacaggtgctggagaggatgtggagaaataggaacacttttacactgttggttggactgtaaactagttcaaccattgtggaagtcagtgtggcaattcctcagggatctagaactagaaataccatttgacccagcaatcccattactgggtatatacccaaaggactataaatcatgctgctataaatacacatgcacacgtatgtttattgaggcattattcacaatagcaaaggctaggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacagaaaaccaaacaccgcatattctcactcataggtgggtattgaacaatgagatcacatggacacaggaaggggaacatcacactctggggactgttgtggggtggggggagggggagggatagcattgagaggtatacctaatgctagatgacgagttagtgggtgcagcgcaccagcatggcacatgtatacatatgtaactaacctgcacaatgtgcacatgtaccctaaaacttaaagtataataataaaaaaaaaagaatacttgttgatttctgttgtatacatctgctccctgttctctaaaccctcataagtgggaatatttccaaataagtagctgatgaaggaatatagatggactgcatagttttatcaacattgcctctacccttctgagtatgagttaggagaaattgagggataggtaaaaaacatattctaattgtaatttgtcaaggaaccacaccttcttcctagagcaggagtgggtaaactactgccagctggccaaatcaggcccctggggggttgtagttgaaaataaagaaaataaagaaaaatatttctttattttatttatttatttctttattttctttatttcttttcttttatttgtatatggctaggaaagcctaaaatatttactgtctggccttttgtacaaaaagtgtcctgatccctatccttgattatattttaacagacttattgaggcataattcacataccttataattcacccacttaggtatacaatttattggtttttagaatattcttagaattgtgcaactgttgatacaatctaattttagaacatttttatcaccctaaaaagaaaccccttacccacttagcaatcacttctcattgcctgccaccagcactaagcaaccatgtactttctgtctatataggcttgcctattccagatatttcgtataaatgtcatcatcatcatattttacacgaaagtcaaatgttttttgatgtgtagtcttttctgactggctccttgtataaatgcctgaataacattttcaaggttctttgtgttgtagcatgtatcagtgtttcatttctttttatggctgaattatattccattgtataaatatatcacatttttaaaatccattcatccattgatggacatttgggttgtttccaattttcagctcttgtgaataatgccgtgatgaacaatttatgtacaaatttttgcatggaaatctgttttcatttctttcaatatgaaatatacctaggattggtattgctgggtcatacagtaactctatgtttcatcatttgaggaatgctggagtttttcaaagcacctgcaccattttacattccaaccaggactgaatgaggattccaatttctccacctccttgccaccacttgttattatatctttttaattatagccgtcctagtgaatataaattgatacctcattgtggttttgatgtgcatttccattatgactaatgatgttgagaatcttttcgtgtgtttattggccatttgtatatcttctttggaaaatatctattgaaatctttttgcatttatctatttatttagagatggagtcttgttctgtcacccaagctggagtgcagtggcacgatctcagctcactgcaatctctgcctcccaggttcaagtgattctcctgcctcagcctcccaagtagctgggactacagccacacaccactgtgcccagctaatttttgtatttttgtagagacagggttttgccatgttggccaggttggtctcaaactccttatctcaactgatccccccacctcggccttccaaagtgcttcatgctcattttaaattagcctatttgtctttttaccactgagttgtaataattctttatatattctttatactatactcttatcaaatacatgatttgcaattattttctcctgttctgtggtttgtcttttccatttcttgctagtgccctttgaaatacatttttaattttgatgatatccattttatttattttgttatcatatctaagaccattttctaatccaaagtcatgaaggtttacctcaatgttttcttgtaaggttttttatattttcagctcttacatgtagatctgtgatccattttgagttaatttttgtgtatggtgtgagataggggtccaactttattgttttgcatttgaatatccatttgtcctagtactatttgttgaagactgttttttccccttgaattatcttcgtgccattgttgaaaatcacttgaccacaaatgagaaggtttattctcaattctattccattgacatctatgtctatcctcagggcaataccacattgccttgataattatagctttatgtagtacattttgaaatagggaggtgttagtcccccctcattgttcttctttttaaagattgttctggctattctaggtccctggaatttccattaggaccaacttgttgatttctgcaaaaaagccagctgtgattttgataggggttgcattgaaactgtaaatcagtttagggagaatattaaagcctctgattcatgaacatggaatatctttccatttatttaggtttttcacttctttcaacaatgttttgtggttttcagattataaatttttcactactttttgtagtctcttcagattttgtatttcctcttgagtcagttttagtagtttatctttctagaaatttatccattacatctaagttatagaatttgttggtttacagttgttcatagtattcccttatagtcctctttatttttgtaaggtcagtagtgatacctcctcttttactcctaattttagttatttgtgtcttctctctttttgttcttggtcagtatagacaaaagtatatcaatttgttgttcttttcgagaacaacttttggtttcattttttctattgcatttctagtctctatttcattaattcccactcaaatcttccttctgcttgcttacagttcaatttgctttgtttttacagcttcttaaggtaaaacttggagttactgatttgagatatttcttttttttaatatcaacttttgcagctataaatttcccttcaagaactgcattaaactgcatcccatacattttggtatgttgtatttttttcattcatctcaaaatattttctaatcttaattatgttttcctgtttgacccatttattatttaggaatctgttgtttaattttcacatatttgtgaatttcccaaattgttttctcttgctgattttaaattttattccactgtggtcagagtacatactttgtgacttcaattattttaaatttatttgaagtttgtgttatggcctagcatgtcagctatcctagagaaagtgccatgcatatgtgcttgagaagaatgtacattctacttgggttagtgaaatgttttatggctattaggtctagtaggttgatagtgttgttcaagtgttctatatccttgatggttttctgcctacttattctattcattacttaaagtgggctattgaagtctccaactaataaaagttgaagtatctatttctttcttcaattctacccagttttgctttatatttttggggctctgttgttaggtcatatatgtttataattgctatacatttccaatggattggcccttttaacattataaaattttcctctttgttcctagtaattttttttttgttttagagtctatttttgtcttattttagtagtgtcaccctaacattcttatggtcaatgtttccataacataactttttccatcctttcacaatcaacctatttatttgtctctgaacctaatatgtgtctcttgtagacagaatgtagttgggtcatctttgtttcaatatgataatctttgtcttttattgggttgtttaatgcactcacatttaatgttactatttttatggttgaatttacttatgccactttactttttggtttctatatatctcatgtattttttattcctgattttctcctttactcttttcttttgcattaagtgaatgttttctaatataacatttttgttcttttaatgatttttacacaatatttgagttattttcttagtggtcactctggggcttacaatatagatcttaatttatcagaatctacatcagattataaacccaatttcagtgagatatagaaatgctattcctattaactctgttctctcctctttttttatgctattttgttatacacattacatctatatatgctccaaacacaacaatacatcttatagtatcactttatagaattttaagtattttaaagaaactcagagaagaagccgggtgtggtagctcacacctgtaaacctagcactttgggaggccgaggtgggcagatcacttgaggtcaggagttcaaaatcagcctggccaacatggtgaaaccccatctctactaaaaatacacacaaaattagctgggcatggtggcaggtgcctataatcccagctactcaggaggctaaggcaggagaatcacttgaatccggcaggcagaggttgcagtgagccaagatcgcgccattgcactccagcccgggcaacaagagcgaaactctgtctcaaaaataaagaaacttagagaagaaagtatatattatggtttcttatattaagcatcttacttaccttttatgcttttcctcattttttcctgtagattagagttactatatggtctctggattagtctgttctctcacacactatgaagaaatacctgagactgggtaattcataaaggaaagcggtttaattgactcatagttccacatggatggggaggcctcaggaaacttagaatcatgatggaaggcacctcttcacagggtagcaggaaagagaatgaaagccgagtgaagtgggaagccacttacagaaccatcagatcttgtgagaatttactatcacgagaatagcatgggggaaactgcccccatgattcaattacctcccactgggtccctcgcaccacacatggggattatgggaactacaattcaaggtgagatttgtgtggggacacagccaaaccatatcagtctcattttcttactccaaaacaactttcttcccacctgcctcttgtgctgttattgtcaaatatatttcatttctatatatcagaggcccaacaatacaaatatatattcacatatatgtgtatatatattgtttttttaaaacaagagaagaagaaatatacatttatattaatactatcttttataattatataattaatgctaccagtgctctttgttttttcatctggattcaaattactgcctggcattacttgcttttcagcctgaaagattgtctcttagcaacgaattctctcagctcttatttatccagggacatctttatttcaccttctctgaataatagttttgctaggtattagattattagtagacttttatttttctttgatcactttggatatgttgtcccactgccttctggcctttattgtttttaatgagaaatcagctattaatcttaatcacccgtacatgtggcgagtcatgtttctctttgctagtttcaaatttttctttgtcttttaccattttgtaatgtatcttggttggatatctttgtgtttcttgatcccacctagagttttttgggcttcttgagtgtgtagattattgtttttcatcaaaattagggaattttcagccatttgtttaaaatattttttctctttttcgctccttttcttttggtaatcccattatgggtatattggtgtgcctaatggtgtcccatgttttactgaggcttggtttattttttttctttttcattctgctctcatattttgtaatctctgctaatctatcttcatgtttgctgattgcttcctctgctaagtcaaacctaatgttgataccctctagtgagttttaaaatttcatttattgtagttttcaactccagaatttccatctgatttttataatttttatccttttattgagattcatttttgatgaacatttttatcataccttctttctttaagtgtggtttcatttagtatttgaatatatttaaaatagctgctttgaattctgtgtctattaagtttaacatctgggctttttcaaaatcagttcctgttacctgcttttttcctatgtagaagtcacactttcctgtctctttgcatatcttgtaattttctgttgaaaactggacgttttagataatatgttgtagtatctttgggtactgatctccccatggggtttgtggatgttaatgtttgcttctttatttgtttagtgaattagctatagggaaatagtgaagtctattttccccatggtacatagactctgatgtcactctttggaaggcacagtctttgcctgtgcaaagactgcttatacctccctctggtaaaggatgacagtgattttaggagagttctttattactcttttcctgatctgacctcttaagcttctagatgaccttcttctattggtagcacatccagctgttagtcttgactaattgctaggtgattactgtgtgtgtgcgtgtgcgtgtgtgtgtgtgtgtgtgtgtgtgtgtgtgtgtgtgtgttaaaatgctcttgtgcataaattgccccacagcctgttccaattaaaagaagacccctttgaaggaatagaaatcttcttagctgtctcttcacatacttctctctataaacttctagttggtctattattttcttcttaatatcattgagctatcaatctcctcttaattgctcactaccaaaatctccatgattttttacagtgtccttagacttgaacttccccacgctctgttccaattaaagtcatttcctttagggagtgctatagatctgcctctcctactgggcagaaactgaaccactgttttggagctaggggcagggacagtggcccacttctgtcagagtgacaatccaattgtatgagtggaagactggacaagagttgtagtccctgatagtcttggcttgctgctcccagcatggacactctatcctataagcagctgagatgagagctgagatgagagagctgagatgagatgagattgagacccaggatcctgagcttgcaatgcctgggatagagcttttgccttacaaatagaggctgggtagagaaagagagttctaggcctctgagctatgcttgtttataatagagcttctacaatagagatctggggggatgagaagtgccagcattctggcccttcagagaatccctagcccagaaactggaggtagagagagtcctatcttcttggccacacccacctaaagtagtgcttacatcacactgagctggcggatggtgagtgaatcatagcttaaatgtcacaggctcttactgttcttactaagacttagtagatttcctggaataaatgtttcttcattttctgtataccctcagggcaatttcctgagcctttacatgattatgttttctaattttcactagttatgatgattgttttgctgaggagaggatccatggagctcctcacacaaccattctagaagtgtttctcttctgttctagattgttaaagaaattgataatgctcaagattttctatttaatcctcatttttctgaaacagtaaggaaatgtgcaaatagaggctaatatttctatataaactccaaaatgttcagtttaaactatcatttttctattaatttatttttacctgtttttaatgaaaatgatatgagattatattaatttgcttaaagttcttttttgttgggactaattaacttgttgcactgttgccaaacagaccatgttcctgagtcgtgcacttgaggagatccagacatgcaatgacatccataatttcctgaaacaaacaggtacagtaggaactggaagtttggtaacacagtttgaaaggagcttagaatcgaataaacaagtcttttgtcaccagaaatttgtgccactgcagtacttgataaccagtcaaatgttttttttttctgttgttttgtttgttttttcgagtcagggtctcactgtgtcacccaggctggagcgcggtgatgtgatcttggctcactgcaacctctgccttctgggttcaagcaattttcccacctcagcctcctgagtagctgggaatacaggcatgcactacaacgcctggctaaacttttctattttttggtagatatagggtttcaccatgttggccaggctggtctcgaactcctgacctcaagtgatttgcccacctcggcctcccaaagtactgggattacaggtgtgagccaccactcccagcccagatgattctttaagagctgattttttccccactctatatcagtattgactctgtaacacactacttagattaagaatattttttactttgctttatatgaaagtatagcattaaatattttattattgtttaacataatattatcaatcttagatcactagatttaatgtctaatttaatcaagctttaactttgactaaatgtaggctagtcttcacaatcaagataacagatactgctaatattttgttataaaattatctaaataggctgcatgcagtggctcacgcctgtaatcccagcactttgggaggccgaggcggacagatcacctgagattaggagtttgaggccagcctgaccaacacggagaaagcccgtctctaccaaaaatacaaagttagccaggcatggtggcacatgcctgtaatcccagctactcaggaggctgaggcatccttgaatctcttgaacccaggaggcaggggttgcagtgagccaagatcacgccattgcactccagcctgggcaacaagagcgaaactctgtctcaaaataaataaataaatacataaatacacaaataaataaataaataaaataatctaaacagtagtaagcctttggaagttatataatatcttgattctatttcctgattaaatatggtattggcttttaggtttagactgaagtttttacaatgtgtttttctgtccctgtttcagaatttgttaaaatcaatggatattcaattgaattacatgctttttcagactttatggagatagtcatatttttctcttttgaactattaatatattgagttataataatagattttataaaattaagtcatcatttcattcctggaataaaccctatttggtcatagtatgttattattttaatatattgatgaattctgttttccaacatttagaaattattggtctgtcactttgtttttgcttatgtgttatgtctttggcagtttgagtatcaaattataggaattataaggaagaacataaacatatgaaatttaatttacttctcgtagtctatgacagtcacttaaatgaataaaaacaacaaaaagtaaagatagagaaaacccaaataaaatacttattatagaagatttaatgggagtaaaactctgtagcctgaaaatatactgtgtatcctgagaacagaaaacatatcatcttttcgtgtgccttttgaagttttacaaaattgatgtcaaggaagacctgaataaattctaagacatgtaaataaaacagacaacatcgtctgatcacaatgcaaaaactagagattaacattggaatcattcttttgaaataccctaccacctggacattttttaaaaacccaaactacagtatacctaggctctaatggtaatgaaaataactcatagtagaatttaaagtgctaaagcagtgctcagagcaaattcattgcctccgtgacttttctttaagcaagtatgcagtggctcacgcctgtaatcccagtactttgggaggccgaggtgggtggatcacatgaggccaggaattcgagaccaccctgccaacatgacgaaaccccatctctactgaaaatacaaaaaccagccaaatatggtggcatgtgcccgtaatcccagctacttgggagcctgagacacgagaatcgcttgaaccccgcaggcggagtttgcagtaagcctagattgtccactgcactccagcctgggcagcacagcaagacactgtttccaaaaaaataaaaaataaaaaagtatgtcagaatgctaactgtccaccaaaaaaaatgaatttcttcttttttaggaatacaactaggctatagatagagtagatagagagatatagtgagatagagataaatgcctctctatatatacatatatatagtctaagtatatttttatacacacagctagactatatacatatatatatgtatctatatagtttatatatagacttcaggcaatcttcagagtttttttaactgtctatacattatagagatttaatggctgtagttaattaaggtgactaatatcagaatgaaggaaagtaaaattccctattggaaaacagtacattatttcatgaaagttttgtggtaaaatatatataacataaaatatgctattttgaccatttttaagtgtacagttgtacaaccattaccactatctatttttaaattttttcatcatcccaaacagaaactctgtatccattaaagaataatttccccattccccctttctccagcccctggtaacctctcatatgcttactgcctctatgaatttgcctattctagatatttctttctttttttttttttttgagttggggttttggtctgttgcttaggatggagtgcagtggcacaatcatagctcactgcagccttgaaccctgcgctcaagctatcctcccaccttgacctccttaagtgctgtgattacaggtgtgaaccaccatgcccaaccctagatatttcctttaagtgaatcatacaatatttgtctttttgtaactggcttatttcacttagcataatgtattcaagattcgtccatgtcatagcatgtgtcaaaattcccttccattttaaggctgaattctattccatcatatggtgtattagtccattttcatactgctgtaaagaactgcctgagactgggtaatttataaaggaaagaggtttaattgactcacagttcagcatggctggggaggccttaggaaacttagaatcatggcagaaggcgaaggggaagcaaggcaccttcttcacaaggtgatgggaaggagaagtgccgagtgaaggggaagagtcccttataaaaccatcagatctcatgagaactcactatcacgagaagggcaagagggaaattgcccttgtgattcaatcacctccacccaatctctcccttaatacatgggaattatggggattacaattcaagaagagatttgggtggagacacaaagcctaaccatatggttccaccccggaccctcccaaatctcatgtgcctttcacatttcaaaaccaatcatgccttcccaacagtcccccaaagtcttaattcattccagcattaactcataagtccatgttcaaagtctcatctgagacaaggcaagtcccttccacctgtaagcctataacagcaaaaccaagttagttacttcctagataaaatgggggtacagatattgggtaaatacacccattccaaatgggagaaattggccaaaacaaaggggctacaggccccaagcaaatctgaaatccagcagggcatcaaatcttaaagctccaaaatgatctcctttgactccatgtctcacatacaggtcatgctgatgcaagaggtgggttcccatcgtcttgggcagctctgcccctgtggctttgcagggtacagcctccctcttggttgctttcacgggctggcattgagtgtctgtggcttttctgggtgcacagtgcaagctgtcagtggatctaccattctggggtctggaggatggtggccctcttcttacagctccaccaggcagtgccccagtggggactctgtgtgggggctccaaccccacatttcccttcctcactaccctagcagaggttctccatgaggactccacccctgcagcaaacttctccacggacacccatttgtttccatacatcctctgaaatctaggtagaagttcccaaacctcaattcttgacttctgtgcacccacaggcacaacaccacatgaaagccaccaaggcttggggcttgcaccctttgaagcaatggcctgagctgtatgttggccccttttagccatggctaggatgtggctagaagtcacagttccaagagtacacaaagcagagaagccctgggcctggcccaggaaaccatttttccctcctaggcctccagacctgtgatgggaggagctgccttgaaggtctctgacgtgccctggagacattttccctattgtctttgtgattaacattgggctcctcattacttatgcaaatatctgcagccagcttgaatttctccccagaaaatgggtttctctcttcagttgcattgtcaggctgaaaattttccaaacttttatgctctgcttcccttttaaacataagttccaatttcagatcgtctctctcaagttcatagttccagaggtctctagggcagaggcaaaatgccaccagtctctttgctaaagcatagcaagagtgacctttgctccagttcccaagaagttcctcatctccatgtgagattatgtcagcctgggcttcactgttcatatcactataagcattttggccaaaaccattcaacaagtctctaggaagttccaaactttcccagatcttcctgtcttctaaaccctccaaagtgttccaacctcttacctgtcacccagttccaaagtcacttccacatttttgggtctctttatagcagtacctcactctactggcaccaatttactgtattagtccattctcgccattttacattcccaccaggaaatgtatcttaatttctccacctccttgccaacacttgttgttttccattttttattattatagctattctagtaggttaaatagtatctcatggttttgattagtatttctctgatgactaaagatgttgagcatcttttcatgtgcttattggttatttgtatttcatctttgagggagggaaaggacttgtctattcaagttctttgcccatatttaaaattgggttgttttttggtgttgcgttttaggatttctttatatattctgtatattaaacccttatcaggtatatgatttgcaaatattttctcctgcatgttttcttttcactttcttgataatgtcctttgatgtaaaaaagtttttaactttgatgaagtccaatttatctaccttttcttttgttgcttgtgctttcagtgtcatgtcaaagaatccattgccaaatccaaagtcatgaagatttattcctataaattcttctaagagttttatggttttagcttatatgtttgggtaattgatccattttgagttcatttttatattcaatggtgtagtaggcatccaacttcattcttttgcctgtggaaatccagttgccaccatgccatttgttgaagagactattattttttgtttgtttgtttgttttgagacggagttttgcttgttgcccaggctggagtgcaatggcacaaccttggctcactacaacctcctcctccctggttcaagtgattcttctgcctcagcctcccaagtagctgggattacaggcatgcaccaccatgcctggctaattttgtatttttagtagaggtagggtttcaccatgttggtcaggctggtctcgaactcctgacctcaggtgatccacccacctcggcctcccaaagtgctgggattacaggtgtaagccaccacacccggcctgaagagactattctttgtcccatataatggtcttgacacccttgttgaaaatcagtcagccatagatgtatgggtttatttcttaactctcagttctattctattggtctatatgtctatctgtatggtagtaccacactgttttattactgtagctttctaataagctttgaaacagagaagtgttggccctccaactttgttatttttcaagattcattttgaactattggggcaccttacaattccatataaatttgagaattgactttttcatttctgtaaaaagaggctggtggaattttgatagggatcgcttagcgtgatataagttttgaaatgttgacatcttaacaatattaagtcttccaatccataaatgtaggctgtcttttcatttatttaggtcttctttaatgtctttcatcagtgtgttatagtaatcattgtacagatcttccaccttcttggctaaattcattcttttgaatactattgtaaatgaattgttttcttaatttcctctttagattgttcattgctgatgtatagaaacacaattgatctttgcatgttcatcttgtacctgcaactttgccgaatttgtagctttcttgtggtttctttgggattttctatacgtagggtcatgtcatctgtgaacagtgagagttacacttctttctttttactttggatgccttttgtttctctttgttgcctaatttatctggctaaaacttcccgtacaatgttgaatagcaaacttcctgtacaatgttgaatagcggtagtgagagagggcatccttgtcttgttcctgatcttagggctaagcttccacctttgagtataatgttaactgtggaattttttttaatgccctttatcagattgaggctattcccttccattcctagtttatcttgaaaatattttggatttcatcacatgatttttctgcatcaatgaatatgaccttttttccttttttctattgatgtggtatattacattaattgatttacttatgttgaacttgcgttcttgggataaatcacacctaatcagattgtataatcctttaatatgctgtaagatttggtttgctagtattttcatggggtttttttaattgatatccataaagaatattggtttgtaattttcttttcttgtgatgtctacatttggctttagtatcagggtaatgctggcttcatagaagaagttaggaagtattccctcctcttccattatttggaagagtttgagagaactgctgtttattcttctttaaatgtttggaagaattcaccagtgaagccatctggtcctagacttctgtttattgggaggttttaaattacttatttaatctctttacttgttataggtctgttgagattttctatttcttctaaagtcaatttagtaatttgtgtgcttttagtaatttgtcatttttttttttttttttgagacggagtctcgctctgtcgcccaggccagactgcggactgcagtggcgtaatctcggctcactgcaagttccgcttcccgggttcacgccattctcctgcctcagcctcccgagtagctgggactacaggcgcccgccaccgcgcccggctaattttttttttgtatttttagtagagacggggtttcaccttgttagccaggatggtctcgatctcctgacctcatgatccacccgcctcggcctcccaaagtgctgggattacaggcgtgagccaccgcgcccggccaggaatttgtcattttatctaagttatctaattttttgatgtacagtagttcatagtaatctctatttgtgattcaatttttggaaggtaaaatcaagagttgttagaggcaaattgggccttgattaaaataggatctggtagttctgtttttagttctttgagaaatcttcacactgttgtccatggaagctctactgatttacattcccaccagcagtgtaaagcatttccttttctctgcatccttgccaacatcgttattttttgacattttaataatggacatcctgactggtgtaagatgatatgtcattgtggttttaatttgcatttttctgatgacttttcaatccagcaatgccattactaggtatctacccaaaggaaaagaaattatatattaaaaagataccagcacccatatatttattgcagcactattcacagttgcaatgatatggagtcaacctacgtatccatcaatggaagattggacaaagaaaatgtggaatgaagatacacacaattaaatagtactcagccataaaaatagaatgaaatcaggtcatttgcagtaacgtggatgaaactggaggccattatcttaagtgaaacaactcagaaccagaacgtcaaatactgcatgttctcactcataagtgggagctaaataaagtatgcacatggacatagagtgtggaataatggacactggagactaggaagggtgagatggtgggagggggttaaaggatgagaaattacttaataggtacaatgtacattatttgggtgatggttacagtaaatacccagacttcactactacttaatatatccatgtaacaaaactgaacttctgtcctttaaatttatataaattaaaaataaaaataaataaataggatcatgagtgcccaataaacaatacttggttacctatttaaacaaagtgacaatcaaacatttaaaaataaacatagggctttggaaggccgaggtgggtggatcacctgaagtcaggagttcaagaccagcctggccaacatggtgaaaccccgtatctactaaaaatacaaaaattagctcggtgtggtggtgcacgcctgtaatcccagctactcgggaggctgaggtaggagaattgcttgaacctgggaggtggagattgcagtgagccaagattgtgccactgcactccagcctgggagacagagtgagattccatcacataaataaataaataaataaataaataaataaataaataaatgtacataggaggtaacacaattctaacataggaggtaacacaattctaaagaactttagctctttgacaagtgaggaacctttgttctttgttagtttgccactaaataatcaaaaataaagaaaaagacaacataaagctcagagaattattcttgtaaaacacagagtctgctatctaggcagattacacagaagatgaagaataacttttgcattgtggtgaaggcattaatcaataaattaaggaagcaagcccatcaaaatttagataaggttgctacaattttaacacattgcatagctttatttcagacctaggtttaaaccagggcaaaaaaatttaactttcccagtttgtccttcattatgctctttgatgttctggaacaaactgaccatctttcagagcatctgctaggtcaaaactatttttattataatactaagatgtgtagtttttcaggggcagtatgatgtgtgatattgtaatagattgaatgcagaagcagatagtagagtctaattatttctattaagttgggcattagggaactttgcaaaaatgtgaagcaatcttcttatttttaaaataaaattatttttattaaaattgacatcaacatgcaacagattcatctcaaatcaattcaatcaataaatatatttaattttttctgttttaatttataatatggtaagtattgatagttacaacatacatgcggaaaacctctttggaagtccttagtaatatttcagagtacgaagaggtcctgagaacagaaagtttgagaactactgtcttagaaacaaactacttttccctttaaaacagaagcatatacccatttgtcactattgctcataatataatctcaaccacttgttttaattttaacttttaaccaaaataatatctatttcaaagagaaaatttgaggggtgcaattgagaactatctctcacaaacattatagcagattaacagagctcacgaacacatgtagcactttcaatgtacacacccatcccttttaaagaggaaaatgaacacaaccattaacatgacccaaagatattgcctctttatagcatataaaaataagaagcaacagtatataggaccaggcgcggtggcttatgcctgtaatcccaacactttgggaggccgaggtgggtggatcacgaggtcaggggatcaagactagcctgaccaacatggtgaaaccccatctctactaaaaatacaaaaaattagccgggtgtggtggtacatgcctatagtcccagctacttgggaggctgtgctaggagaattacttgaacccagcaggcggaggttgcagtgagccgagatcacgccactgcactccagcctgggtgacagagcgagactccatcttaaaaaaaaaaaaaaaaaaaaaagcaacagtatataaacttaaaactgcttagtgaggccaaggtagggagattgcttgagctcaggagttcaagaccagcctgggcaacataggaagaccctgtctctataaataattttttaaagaattaaccaggaatagtggcacatgcttatactcccagctactcgggaggctgtggcaggaggattgcctgagcctggaaggctgtggctgcagtgagccatgattgtgccaccgcactccagcctgggtgacagagtgagaccctgtctcaaaaaaacaaaacaaaacaaaaacaaaaacaaaaaactgtgcttagtaatcaataagcagtctatattaattaaaatttatgtaggtatccaatgattatccattaatgaactcaatttaatatcaaaccagtgtttaagttaattagattatcttaaatctaacataccacagaatgtaattactgctgaaataaaagtttgtcagaacagggattcaatttcagttgaacacaaatttacatctttcataatcttaaatattacatataagtaacattatcttatttgattagtaaatctgtatacatttaggaaaaacagaccgaagtaaaataaaatgtatgcttgttttatacattacataaataaatcaccaaaaatgacataactcttttaaataaaaattatttttaatgttttatttttaatttttgtaggtacattataagtgtatccatttattgttacatgagatattttgatacaggcatgccatgcgtgataatcacattagggtacatgaagtagccatcacatcaaacatttatcctttgtgttacaaacaatccaattatactcttttagttattttagaatgtacaattaatactgactgtggtcaccctgttaggctagcaaacactaggtctattcattctttctatattttttacccattacccatcctcacattctcccctactatctttcccagcttctggtaaccatcattctactctctatttgcatgagttcagttggcttaatttttagcttccacaaataagtgagaacatgcaaggtttgtctttctatgcctggcttatttcacttaacataatgacctccagtcccattcatattgttgcaaatgactagatctcattctttttaatggctgaatagtgctccattgtgtatatgtaccacattttctctatccattcatctgctgatgggcagttaggttgcttccaaatcttggctattgtgaatagtgctgcaatacatatgggagtgcagatatctcttcaatatgctgatttcctttcttttgagtgtatacctaggagtgggattggtgactcttctccacagtggttgtactaatttatgttcccaccagcagtgtacaagggttcccttttttccatgtcatcgccagcatttgtttttgcctatcttttggatataagccattttaactgggatgagataatatctcactgtagttttggtttgcatttctctgatgatcaatgatgcggagcaacttttcagttgcctgtttgccattcatgtgtcttcttttgagaaatgtctattcagatcctttgctcattttaaaaattagattactagattttttcctatagagttgtttgagctctgtatatatatctgcttattaatctcttgtcagaggggtagtttgcaaatactttttcccattctgtggattgtctcttcagtttcttttttgtttttttttttttttgttttttttgtttttttgtttttgagacggagtcttgctctgtcgcccaggctggagtgcagtggtgcgatctcggcttactgtaagctccgcctcctgggttcacccaccattctcctgcctcagcctcccgagtagctgggactacaggcgcccgccaccacacccagctaatttttttttttttgtatttttagtagagatggggtttcaccgtgttagccaggatggtctcgatctcctgacctcgtgatccacccacctccgcctcccaaagtgctgggattacaggtgtgagccaccgcgcccggcccagtttcttgatttaaacaagaattattaaacaaatctcatttgccaaagatataccttaattctggattctcaaaatgtttgagctagcagaattttttgtgaaaatatttttagtttagcacattttagtattaaaagttcaacttctggctgggcgcagtaaccagcactttgggaggccaaggcgggtggatcacctgaggtcaggagttcgagaccagtctggccaacatggcgaaaccctgtctctactaaaaatacgaaaaattagctgggtgtggtggtgggcgcctgtaatcccagctacttggaaggctgaggcaggagaattgctcgaacccgggaggcagaggttgcagtgagccaagatcgtgcaattgcactccagtctggacaacaagagcaaaactctgtctcaaaaaaaaaaaaaaaaaaaaaaagaagttcaacttctttttttcttggagttaaaaaaatatgtatgtaagttcttatttatgtctataaaccaattagaacagagctcctttaatttaggaaactttatgatataacttattaatactccccagagataggaaaatattttacactcacacaatgtgaggtcaaagcctttttcagttgtagacacatagacatagataaagcgatcttatgaattctgatctacaatttcagctataagttaagagtaaacacagaaatatgccagtccagatattacagtgttcaccttccctgcgggtgtgaaattactgattaatttaagttcaaaatgaacaaatagaacaacaaaaaagacaaattctctgttatttcccacccatcagtgactagataagtgactagataatccgttagtccaattacaaagaccaccaaatggtcaaaccatataatcacattcccagtcattgctgctaccaaggaagaatataacttactgactatacacaaaccagaaactaaaacaaaacataaactcaatagaaaagaaaaaagaaagaagcagagattcaacaaatttctgctgccactttggattcaacctggaagccaagaaaagattaatgtaaacaatctaggagttacatttctccagtaacacaatttacctggccctgtcaagtgtatccattgggcatctcagtcagtacttttaagatataaccttggctgggtgtggtggctcacacctgtaatcccagcactttgggaggccaaggcaggcagatcacctgaggtcaggagttcgagaccagcttggccaacttggtgaaaccccatctctactaaaaatacaaaaattagcttggcgtggtggtgggtacctgtaatcccagctacttggtaggctgaagcaggagaatcacttgaacccaggaggcggaggttgcggtgagcagagatcctgccactgcactccaacctggtgacagagtgagactgtctcaaaaaaaaaaaaagatataatcatgactctcttaggaatattaaatgaacacatcaaggattttatttaattcattaactgatgaggaaaccgagaagatgttacaaccaatttcaatttgcatttcattttggttgcttggtttttcctgttttctgtctcttactgtttattcagcggtatcttttttccctttgctgcttccacttccttttgctgcttccagttttacttttattcctgtggtggctttatttttttaccttctttgtctctgaaatagctcatattccatttccttttgttgtgtaccaactcttccctgagttctagcatttctgttttatattcttgttttatagagatgactacttaattaatattactgaatttatgctgatatgtttagtcacaattttaatctgcatatggcaacatttctctggtaagaattctccatctgccattttttttttctgtttcttccatcccattttcatgtagtatctttgtgtataaactgtgctggagttgtttgttttgttttgctttgcttgataacatctttaattgcaatgaggtctctttagaccttctacttgcagatgatacatgtggagaggagctcaggacctgatcaaggataatagaaatttttacttaagttctaaggttgttgtgtatgtgagttcttgtaggctctacatcttctcagccagtggatataggcagctatgggcttctcataacaaagactctttcctccccactgcttcactgacctgttgctcactctttattctctgcttctcaaaaccaaactaaggccagacgagttccctttaccagcctctaaactcttttcttgttattgtagataaaggatttgcacttcagggtgtgctcctccccttggagtgttgtacttttgctgactttttctgattctatttttatttttaaaacatatgtgtgtatgtgtacacaaataccctagactataagctccacaaggacagatactgtgtctgattttgcttacctttgtattgtgcgcctagcacataataggtcttcagaatatgcacacatatatatattcttataaaatgtgtgtatatgtatatatatttatgaatgcatatttcatctataaagccttggaaggatacacaccaaacttaacacttgatagctcttggaacaagtattagtgtgtttaagggactttcactttttattttgttttttgtttctgcatttgaatttttcaatgaatacatagtactttaataattaaaatgaaagatacatttagaaaaattattctgacttgttaaaggtttgtttcttgagattttgtatttccaatgaactaatgcttaaaataatgagcccagtatgtcagtaatgtaaataaatcattaagctaccaactgcaaatagataaattgagggaaagtacaaagccagtgaatcataaattcttgagggaaaattggaaaacgccatccttttaaaaatctactccaaatcagagttaattaagagctgtataaacagtgattaaaattttagtgctatgggaattggcttttacaaaaggattaaccctgacatgccattatattagtgacctaaggaaagcagctcaccacatttattctgcaaagtatttattaaattcctaaggactactatgtattgtggaaataaggaaatgtattactgtctctgtccctaacaaatttacagcaaagaaaggtcagaaacataatcaattatacatatataaggcaaaatgaaataactatactaatagggatacagaatatatgggaccacagaggaagaaatgatctattccaaaaggtgatatttgaacttactcttcaagaataaatagaattttaatggtaggaatcaagtgaacagaagccaggagtaatacaggagaacattgttagtttggggattatctcttattcaggggttatatagtgggagatgagtccatgtcttagtctgtttctgctgctgtaacaaaacacctcatgcagaccgggtaacttacaaaagagaaaaatttttttttctcacatttctggaggctgggaagtctacggtcaaggatccagaaggttcagttttctggtgagggctgctttctgattgcaagatgataccttgttgctgcatcctccagaggggagaaacactgtgtcttcacagggaggaaagtggaagggcaagaaaagttagtgctgtgtggaagcctcttttttaagggccataagggctatctgtaaccctgttcatgagggaggagccctctgggtctaataagctattaaaggttccacctcttatcctatcacattggccattaagtttcaacatctgaattttggaggggacacattcaaaccacagtaggctgaaagtagtgtgatttgtgatgtgcccattctcaataacaaattaggccactagtatcacctagttccaagctatctcatgtctcacttggaccactgcaatagcttcccaagtgtcctctctgctgcacttcttgccctcctaataaattcaatagccacacagcagccagagtattttaacataagtcagttcatgtcagtctccttgcacttcccatttaaatggatttaaaataaaatcccaagtccttaccataatctacaaggccatagataatccggtccttagataccttcctcgccacctctcctgccactctgcctcatagctccatgtactctagccctactatgtctcgataacaccttgtacttccctgcttctgggcctttgtatttgccctttcctttgcattggacactcttgtcctagatattcatatgccttgctccccaacttgctcaagttttaccccctcagagaccacaccctttcaaaaatagcaactttcaatactatttaaccccttaacctgtgtgttgactacttgacatattctatgttgcttattgtttgtctccctaaatagaatccaagttccatgcaggcagaaaagttgtctgtcttgttcattctttatccatacctcctaaagttttgcctggcatataatagggctcaataaatatttattaaatgaaattctgctataacaccagaaattatatcattagagagtcatttattttagtcttagagtgttttgatcttagagaaccctctgcaaagatccttgggagagctcacaatttagtcattatcagcgtatactctgggagaggaacatttagaaaaaagtacttaatggagattgaacttgggatttagagcagagaagggcaggtttccaggggtgaaaaaggaaatttaaggggaagttgggtttgtaccaaagatgactttgcttatagtgagaagatactcaaacctttcttacttgaggaagctcacagcttctgaatctctctttctggctgtgaaaagaaatttcctcttttgggtctcccttgaagattatcatttttggatgttgctaagagcatccttggagtcagagtctctatatatagcaaatcatcaaatgttagggctagaagtaatcttggtgatttggtttcttaaaactatttattttataacatgagttaaacatttatcacaaaaacaggaagatagagaaaaggctttagtttttgtaggtcattgcaaggaagaatttcgcttatctccagtgctataattttgactttggtataaagtattcatcaagtgtcatcatcgaaagtattagtggttatgacaaacaaggcaaacctcctgagaactttagaacaaagcccagcatggatgttctgccagcataaatgcagttcagctggcagagcagaggattatctatgtttttatgtattatatattacatatttatatattagggtctcctcaacccataactggaaaggtcattctaatttatccaaatacagtagataaaagctgccatttaacaaggtgtatgctagaaatagaaatattttttgtcttttccattgtacacaccaaaactaggattgaatgcttattcctttgcaggcagtctttgcttggttccttcattggcttaatacagcaatcagtcatgcattacttttgtctcagagattagttctcatgggtaagaaattctcagagatgaaagttttgagatcagccaaaagaaaaggcaattggagctgatcctcaggcacattaaacagaatggcaaaacttgagtagattttctagtgtacattttgagccagaacttaggccacagaaataggagaacctgagtttaggatttttcctggaaggaaattagacaattagctggagatacccaagtatctctgataaaaatggatcctaaaagtcttcacttttggcagcattccatttaaatcatgcctcatagtcagcataagcttaccctaatgatgcaatccaaagccttaatggcagtgagtagagactttgatacagggctatggagtcactgaagaaatatagtaggggttccaggttgaggagacaggtttgttatggttcccagatacttatggtgatatatactattccttctcccaagtgcctgatctaattaggaatgtcagtccaatctccctgttcccaatatatatcttattatggtttgcttttagaaaggacaaatgtgaatctggaaattttatttatttatttatttattatactttaagttttagggtacagatgcacaacgtgcaggttagttacatatgtatacatgtgccatgttggtgtgctgcacccatcaactcatcatttaacattaggtatatctcctaatgtcatccctcccccctccccccaccccacagcaggccctggtgtgtgatgttccccttcctgtgtccatgtgttctcattgttcaattcccatctatgagtgagaacatgcggtgcttggttttttgtccttgcgatagtttgctgagaatgatggtctccagcttcatccatgtccctacaaaggacatgaactcatcattttttatggctgcatagtattccatggtgtacatgtgccacatttacttaatccagtctatcattgttggacatttggcttggttccaagtctttgctattgtgaatagtgccgcaataaacatacgtgtgcatgtgtctttatagcagcatgatttaaaatcttttgggtatatactcagtaatgggatggctgggtcaaatggtatttctagttctagatccctgaggaatcgccacactgacttccacaatagttgaactagtttacagtcccaccaacagtgtaaaagtgttcctatttctccacgtcctctccagcacctgttgtttcctgacattttaataatcgccattctaactggtgtgagatggtatctcattgtggttttgatttgcatttctctgatggccagtgatggtgagcattttttcatgtgttttttggctgcataaatgtcttcttttgagaagtgtctgttcatatcctttgcccactttttgatggggttgtttttttttttcttgtaaatttgtttgagttctttgtagattctggatattagccctttgtcagatgagtagattgcaaaaattatctcccattctgtaggttgcctgttagatggtagtttcttttgctgtgcagaagatctttagtttaattagatcccatttgtcaattttggcttttgttttcattgcttttgctgttttagacattttcttgtacagttatcttagcacaatgtctcctgatcagaataagttgtgtactatacctcacctacacattcattacttattttcacaagacttcccaagctttaaacttcagtccaccactaactgattatatatatatatcacaatacatattcttttcaagtgtacttgtaacatataccaaaatagatcatatgctgggccaaaaagcaagtctcaacaagtttcaaaggattgaaatcatacaaggtatgttatccaaacaaagtacaattaaatgagaaagcaacaacagaaagatgattaggaaacccccactgttggaaatctaaaagaaacatttctaaataacccatcagtcaaagaaaaaatcaaaatgaaaacgatggaatagattgaacttaacaaaaatgaaatatgacatcaaaacttgttggatacaactaaaataaaggaaaagacatagctttaaatgcatatattagaaaagattaagggttgaaaattgatgatctaagcttccaacttgagtctagggaaagaacagcaaattaaagatagtagaaggaagaatgtaacaaagataagagcagaaaacaaagaaatgaaaaataacatataacacagaaaatcaggctgggcacagtggctcatgcctgtaatcccagcactttgggaggccaaggcgggcagatcacctgaggtcaggagtttgagaccagcctggccaacatggtgaagccccgtctctactaaaaatacaaaaattagccaggcatggtggcacatgcctgtaatcacagctactggggaggctgaggcatgagaatcgcctgagcttggaaggtagaggttgcagtgagccaagatcacgccactacaatccagcctgggcgacagagaaagactctgtctcaaaacaacaacaacaacaacaacaacacagaaaatcaacaaagctataggttgcttgtttggaaagattaatacaattgctaaaagtcttgcaagatggatcaagaaagaacacaaattaccaatatcagtaattcaaaagtgggcatcactacaaatccctcagacattaaaatcacaataaaaaggatattgtgaacaactttatgccaataaatttgacagtttggacaaaatggacaaattccttgaaaagtacagctaccaaaattactttcccgccccccattacttctcagctttttggctaagatcaagtacaaaattgtgcccccaaaaataatctgagtagtcctatttagactattttaaatagtcctaaacctactaaagaaatgcaaccttaaataccttctcacaaaggaaatggctttaccagtacattattccaaatatataagaaagaaataatagattttgggttggagccaagatggccaaataggaacagctctggtctacagctcccagcgtgagcgacgcagaagacgggtgatttctgcatttccatctgaggtaccgggttcatctcattagggagtgccagacagtgggcgcaggacagtgggtgcagcgcaccgtgagtgagctgaagcagggcgaggcattgcgtcacttgggaagtgcaaggtttcagggagttccctttcctagtcaaagaaaggggtgacagacggcacctggaaaatcgggtcactcccaccccaatactgcgcttttctgacgggcttaaaaaatggcgcaccaggagattatatcccgcacctggctcgtagggtcctatgcccacagagtctcactgattgatagcacagcagtctgagatcaaactgcaaggcggcagcgaggccgggggaggggtgcctgccattgcccaggcttgcttaggtaaacaaagcagcctggaagcttgaactgggtggagcccaccacagctcgaggaagcctgcctgcctctgtaggctccacctctgggggcagggcacagacaaacaaagacagcaataacctctgcagacttaaatgtccctgtctgacagctttgaagagagcagtggttctcccagcacacagctggagatctgagaatcagcagactgcctcctcaagtgggtccctgacaccgacccccgagcagcctaactgggaggcaccccccagtaggggcagactgacacctcacacagctgggtactcctctgagacaaaacttccagcggaacgatcagacagcagcatttgcggttcacgaaaatccgctgttctgcagccaccgctgctggtacccaggcaaacagggtctggagtggacctctagcaaactccaacagacctgcagctgagggtcctgtctgttagaaggaaagctaacaaacagaaaggacatccacactaaaaacccatctgtacatcaccatcatcaaagaccaaaagtagataaaaccacaaagatggggaaaaaacagagcagaaaaactggaaactctaaaaatcagagcgtctctcctcctccaaaggaacgcagctccttaccagcaacggaacaaagctggacggagaaggactttgacgaggtgagagaagaaggcttcagacaatcaaactactctgagctacaggaggaaattcaaaccaaaggcaaagaagttgaaaactttgaaaaaaatttagacgaatatataactagaataaccaatacagagaagtgcttaaaggagctgatggagctgaaagccaaggctcaagaactacgtgaagaatgcagaagcctcaggagccgatgcgatcaactggaagaaagggtgtcagtgatggaagatgaaatgaatgaaatgaagcaagaagggaagtttagagaagaaagaataaaaagaaatgaacaaagcctccaagaaatatgggactatgtgaaaagaccaaatctgcatctgattggtgtacctgaaggtgacggggagaatggaaccaagttggaaaacactctgtaggatattatccaggagaacttccccaatctaacaaggcaggccaacattcagattcaggaaatacagagaacgccacaaagatactcctcgagaagagcaactccaagacacataattgtcagattcaccaaagttgaaatgaaggaaaaaatgttaagggcagccagagagaaaggtcgggttacccacaaagggaagcccatcagactaacagctgatctctcggcagaaactctaaaagccagaagagagtgggggccaatattcaacattcttaaagaaaagaattttcaatgcagaatttcatgtccagccaaactaagcttcataagtgaaggagaaataaaatactttacagacaagcaaatgctgagagattttgtcaccaccaggcctgccctaaaagagctcccgaaggaagcactaaacatggaaaggaacaactgggaccagccacggcaaaatcatgccaaaatgtaaagaccatcgagactaggaagaaactgcatcaactaacgagcaaaataaccagctaacatcataatgacaggatcaaattcacacataacaatattaactttaattgtaaatggactaaatgctccaattaaaagacacagactggcaaattggataaagagtcaagacccatcaatgtgctgtattcaggaaacccatctcacatgcagagacacacataggctcaaaataaaaggatggaggaagatctaccaagcaaatggaaaacaaacaaaggcaggggttgcgatcctattctctgatcaaacagactttaaaccaacaaagatcaaaagagacaaagaaggccattacataatggtaaagggatcaattcaacaagaagagctaactatcctaaatatatatgcacccaatacaggagcactctgattcataaagcaactcctgagtgacctacaaagagacttagactcccacacaataataatgggagactttaacacccctctgtaaatattagacagttcaacgagacagaaagttaacaaggatacccaggaattgaactcagctctgcaccaagtggacctaatagacatctacagaactcttcaccccaaatcaacagaatatacatttttttctgcaccacaccacacctattccaaaattgaccacatacttggaagtaaagctctcctcagcaaatgtaaaagaacaaacattataacaaactgtctctcagatcacagtgcaatcaaactagaactcaggattaagaaactcactcaaaactgctcaactacacggaaactgaacaacctgctcctgaatgactactgggtacataacaaaacgaaggcagaaataaagatgttctttgaaaccaacgagaacaaagacacaacataccagaatctctgggatgcattcaaaacagtatgtagagggaaatttatagcactaaatgcccacaagagaaagcaggaaagatctaaaattgacaccctaacatcacaattaaaagaactagaaaagcaagagcaaacacattcaaaagctagcagaaggcaagaaataactaaaatcagagcagaactgaaggaaatagagacgcaaaaaccccttcaaaaaattcatgaatccaggagctggttttctgaaagcatcaacaaaattgatagacctctagcaagactaataaggaagaaaagagagaagaatcaaatagatgcaataaaaaatgataaaggggatatcaccaccgatcccacagaaatacaaactaccatcagagaatactacaaacacctctacgcaaataaactagaaaatctagaagaaatggataaattcctcgacacatacaccctcccaagactaaaccaggaagaagttgaatcactgaatagaccaataacaggctctgaaattgtggcaataatcaatagcttaccaaccaaaaagagcccaggaccagatggattcacagccgaattctaccagaggtacaaggaggaaccggtaccattccttctgaaactattccaatcagtagaaaaagagggaatcctccctaactcactttatgaggccagcatcattctgataccaaagccgggcagagacacaaccaaaaaagagaattttagaccaatatccttgaagaacattgatgcaaaaatcctcaataaaatactggcaatccgaatccagtagcacatcaaaaagcttatccaccatgatcaagtgggcttcatccctaggatgcaaggctggttcaatatatgcaaatcaataaatgtaatccagcatataaacagaaccaaagacaaaaaccacatgattatctcaatagatgcagaaaaggccattgacaaaattcaacaacccttcatgctaaaaattctcaataaattaggtattgatgggatgtatttcaaaataataagagctatctatgacaaacccacagccaatatcatactgaatgggcaaaaacggaagcattccctttgaaaactggcacaagagagggatgccctctctcaccactcctattcaacatagtgttggaagttctggccagggcaatcaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaagaatccaacttacaagggatgtgaaggacctcttcaaggagaactacaaaccactgctcaaggaaataaaagaggatacaaacaaatggaagaacattccatgctcatgggtaggaggaatcaatatcgtgaaaatggccatactgcccaaggtaatttatagattcaatgccatccccatcaagctaccaatgactttcttcacagaattggaaaaaactactttaaagttcatatggaaccaaaaaagagcctgcatctccaagtcaatcctaagccaaaagaacaaagttggaggcatcaagctacctgacttcaaactatactacaaggctacagtaaccaaaacagcatggtactggtaccaaaacagagatatagatcaatggaacagaacagagccctcagaaataaagccgcatatctacaactatctgatctttgacaaacctgagaaaaacaagcaatggggaaaggattccctatttaataaatggtgctgggaaaactggctagccatatgtagaaagctgaaactggatcccttccttaccccttatacaaaaatcaattcacgatggattaaagacttaaacgttagacctaaaaccgtaaaaactctagaggaaaacctaggcattaccattcaggacataggcatgggcaaggacttcatgtctaaaacaccaaaagcaatggcaaccaaagccaaaattgacaaatgggatctaattaaactaaagagcttctgcacagcaaaagaaactaccatcagagtgaacaggcaacctacaaaatgggagaaaattttcacaacctactcatctgacaaagggctaatatccagaatctacaaagaactcaaacaaatttacaagaaaaaaaaaaaccccatcaaaaagtgggtgaaggacatgaacagacacttctcaaaagaagacatttatgcagccaataaacacattgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcaattcctcagggatctagaactagaaataccatttgacccagcaatcccattactgggtatatacccaaaggactataaatcatgctgctataaagacacatgcacacgtatgtttattgtggcactattcacaataggaaagacctggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactattgcaagaacaaaaaaccaaacactgtatgttctccctaataggtgggaattgaacgatgagaatacatggacacaggaaggggaacatcacactctggggactgttgtggggtggggggaggggcgagggatagctttaggagatatacctaatgctaaatgacgagttaatgggtgcagcacaccatcatggcacatgtatacatatgtaactaacctgcacattgtgcacatgtaccctaaaacttaaagtattataataataaaataaaataaaaagaaagaaataatatcaatctcatacaaatatctcttatggaaaatagagaaaaaagtaatacatggattttatgaggccagcatactctgattccaaaaactaaaaagaaaaatacaagtcagtgtcagtgtcttttttgtttgtttgtttttgtttttgtttttttgagatgaagtctcactctgtcgcccaggctggagcgcagtggcacgatctcagcttactgcaatatttgcctcccaggttccagcgattctccagcctcagcctcccaagtagctgggactacaggcatgcaccaccacgcccagctaatttttgtatttttagtagagatggggtttcaccatgttggcaaggctggtcttgaactcctgacctcaggtgatccgcccgcctcggcctcccaaagtgctgggattacaggcgtggaccaccacacccggcatcaggccagtatcttaaatgatagatgcaaagatcctaaatacattttagaaaattgaatccagcaatatataaaaaggatactgcatcatgaccaatattgcttatcccaggaattcaacattcaaaaatgagtgcacattaacaaaataaaagaggaaaatataataatctcaatagatgcagaaaaagcatttgaaaaaaattccatacccattcatgacgagaacactcaacgaactaggaatagaaagtcacttcctcaatctgataaacattacttgaaaacaaactactccttattttgtatttaatggtaaaatatgaacactttctcactgatgtcagggaatgaaacatggatatacactatcaccacttccattcaatattatactggaataattccaggcctcctagtaacccatttcacatcttaggtctaattgatcactctctccatgctgcctcttaaagacaatatgttcttttttaacttcagttgtaaaccctttatatgctttaagacggtttccaaagcatttgttaagctctgtcttcttcagatcaactatttcagaaataggttctattttccaaccttctagtcatagccattcttctcctttacatgttttccagtagtggattgtgaatcagaacatgtgggattagggtcctggctctccattaatttgctgtttctatgggtaggaacagcatttagtttctcagccataatcttctcatctggaaagtggggttaataacccctgccctgtgtatgcattagaagggcatttcgcctatccgaagaactcagaataatggagcaatttctaaaccatgactttgaaaacactgcagagacccagccaatctaccatttccaggagcttacaacataattccaacaacaaatgtaacctgaaatagataaacaaactgtacatctctataatggaatactactcagaagtaaatgaatgttaaatgcatttgccaagtgaaaaaagacagatccaaaaggctatgattccatttatatgatatcctggaaaaggtaaaaccataggaaaagaaaacacatcagtgattgccagaggttggacattggagtaggagttccctataaaggggtaacatgagagaatctttagggtaatgaatgttctataaggagcagtgatagtggacacacaattctatgcatttttcacaaccaatagaactatatgccacaaagagtagattttaccggatacaattttaaaataaatcaatcaggatgtggagggaatcccagatggaattcagactgtgacaaatgaatctgactctattacgaatgaactacatagccacatggaagggggtgaggaagaaagaagccgatttaagtaactttgaaaaactctgttttgattagatgcaaggctaaagacaaaaagaactatgcacaatactgtattctagttggtaacttttttcacgtggatatggattagcaataatgaaaatactttacatatttagtcagttttgctgttacatggcatatgcatgcctaaaaattattacagtatccaaaattgtgtaataaagaccacagggcttacgggaaaaaatggggttggggtataacactaaaaaatttggtctgtgacatattaaaaaaaagataagagcctaataaaatgacagcatggttttatatatgttaaatgactaaaaatacatgaatactacaataaatatggctatttaccttaaaaaagacctggcatttgcttatggaagtgaatatcagaaggactgcagcttgtgagatactgtgaagtggtgggaggaggttgtctgaaatctgatggaaagttgtagcaacagatgtggatgagtgtggcccataacacattcagtgaactgaggtagtggatagaagtttgagttgtgcacatgtgtgtgttatgcatattcctatacagcttggttcagccagatgctgctttctgcattcacttactatttcacatagactaaattgcacataagcaagtacttaatttacataatttacattaattgttacctaatatatcaatcatgttggaacaaattcacattttcaaaacaaacattataacaactgtatgtatgtgtgtgtatatatagtatgtattatgtatatgcaaatagacatgcatataatatggttttctttatctgtgatttggaataaagttttaaaaataagtaaatttgggctgggcacggtggctcacacctgtaatctcagcactttgggaggccaaggcaggtggatcatgaagtcaggagttcgagaccagcctggccaatatggtgaaaccccgtctctactaaaaatacaaaaatcagctgggcatggtggcacgtgcctgtagtcccagctactcgggaggctgaggtagaagaattgcttgaacccaggaagtgagggttgcagtgagctgagatcacgccaccacactccagcctgggcgacagaacgagactctgtcaaaaaaaaaaaaaaaaaaagtaaattgatatggttgttggatacaggtttatatataaataattaattatatttctgtatactagcaagaaattattggaaagtgacctttaaaatacaatttttgatagcatcaaaatccatcaaatgcctagtaatctataatgaaagatgtataagacctctgcactgaaagccacaaaaccttgaaacatggctgaaagaaatttttaaaggtctaaataaatgcagatatatgccatgttcatgtgttagaaaactcaatattgttaggatatatcagttttcccaaattgatctatagattcaaagcaatcccaatcaaaatcccagctggggctgtgtgtggtggcttacagtactataatcctagcactttgaaaggccaaggtgggaggattggttgagcccaggagttcaagtatggcctaggcaacatggcgagaccctatgtttaccaaaaaaaaaaaaaaaaaaaaaaaaaaaaaaaaaaaccggtgtggtggcatgcacctgtggtcacagtggtcacagctacttgggaggctgaggcaagaagatcacttgagcccaggaatttgaggttacagtgagctatgattgcaccactacactctagcctgggtgacaaagtgagaccttgtctcaaaagataatgaaataaaataaatgaaaaatcataggagaatatcttcatgactttgtggagacaaaagtttaccaactataaaagaaaatattgataaagtggacttcattacaagtgagaactttggtctgtcaaaagataccgttgagaaaagaaaaagacaagccacagataggaagaagatatgccaatacataagcttgacaacttccagaatatataaagaattcttacaattcaacaagaaaagataaataacccaataaaaaaatggacaaaagaattgaatggctgggcacagtggctcgttcctgtaatcccagcactttgggaggctgaggtgggtggatcacctgaggttgggagttcgagaccagcctgaccaacatggagaaaccccatctctactaaaaatacaaaattaagcgggcgtggtggcacatacctgtaatcccagctactcagtaggctgaggcaggagaatcgcttgaacccgggaagcggaggtcacggtcagctgaaatcacgcctttgcactccagcctgggcaacaagagtgaaaatccatctcaaaaaaaaaaaagaattgaatggaaatttcacccaaaaaaaatgtataaatggtcaacaagcaaaggaaaagatgctcagcatcattactcatcaagaaaatgcacattgagaagccgctgcaccctcactgaaatgactaaaaaaaaaatcaagtgttaatgagggtgggaagcaactggagttctggcacacaactagtggaaatgtaattggtacaaccactttggaaaactgtttggcagtatctgctaaaaccaaacatgtttctatcccagcagtgaccgtcaaatctcacttttagatatatactcaggtgaaatgagtacatctcttcaccacagtatgtacaagaatgttcaagacagctctattcatagaactaaaaatttgaaacaacattactgttcatcagcagaatgatagattaaataaattgtggtatgttcatacaatggaatactacaaagcaataaaaagaatgaacgtctgatagcatacaaaaatatttatgaatatgacagacattatgagtaaaagaagttggtcccaaaagaatacacaatataaattcaatttttcaaacaattgtattgagatataactcacatgccatgcagttcacccatcaaagtgtacaattcaatacactttagtatattcacagatatgtgcaaccaccactgacaatcaattttggaacattttattacctcaaaaggaaagcaacgtaccctttagtttcccttgcatttctcccacaagccctgaacaaccactaatctactttctgtttctatagctttgcatattctgaacacttcatttaaataaaattatataatacatggacttttgtgactgccttatttcacttagcatatttttgaagttcattcatgttgtggcatgtcagtacttcattactttttatggtcaaataatattccattgcctgggcataccatgttttattcatccattcatcagttgatggacatttggatcatttctatcttttagctattatgaataatgctgctgtaaactcttgtgcacaagtttttgtgtggacctattttcacttttttgtgtgtgtatacctaggagtggaattgctgggtcatatggtaaccctatgtttaatcatttgaggaactgccagagtgtttttcaaagcagctgcatcattttacatttccaccagcaatgtatgaggcttccagtttctccacctccttctcaacacttgtattacctgccttttttattctagccatcctagtgaatgtatagtgatatcttattatggttttgatttcctgatgactaattttcctgatgaccaatggtgttgagcatcttttcagatggttattggccattgtatatcttctttggagagtatctattcacaccctttcccaatttttcattaggctgccttttattattgaatagcaagagttatttatgtattctagatacatgtctttgatcagatatatgccttgattttgccccactctgtcaattgtcttttctctttcttgatcatgtcctttgaaatacaaaattcgttaactttgaggaggtccagtttatctatttttctttcattgcttatgcttttgatatcatatctaagaatccattgccaaatcaaaagttatgaaggtttacccctctgttttcttccatgagttttatagtttagctcttatctttaaatatttgatctatttcgagttaattcttgtatatgctatgaggtgagggtctaacttcattctttatcatgtggctatccagttgtcccagaactatttgattaaaagactatcctttccctcattggatggtctttgccccttttggaaaatcagttgaccacagacacattgttttatttctgggttgtcaattctgttccatatatatatatatatccttatgtcagtaccatgctgtcttgattaccattgctttctattttctttttcttttcctttcttttttgttgagactgagtcttgctctgttgcccaggctggagtgcaatggtgccatctcggcttactgcaacctctgcctccttggttcaagcaattctcctctcagcctcccaagtagctgggactacaggtggccaccaccacatctggctaatttttgtatttttagtagagacagggtttcaccgagttagccaggctggtctcgaactcctgacctcaagtgatctgcccacctcagcctcccaaagtgctgggactataggcatgagccactgcgcccagcctccattgctttctagtaagctttgaaatcaggaagtgttagtcctacaactttattcttggttttcaagattgttttggttattctgggtcccttgaatttccatacgagtttcaagatcaactgtcagtttctgaaaaaaataactgagctgggatgctgatagggattgtgttgaatctatagataattttggggagtgttatcatcttaatgataaatcatcaaatccatgaacatgggatatgtttccattttgttacatcttgtttatttcaatgatgttttatagtttttgtttataagttacataacaaaatggaaactaagttacataacttatacactaaaaactataaacgtacacactaattctttctttttctttttttttttttgagacagagtctcactctgttactcagactggagtgcagtggtgcgatgtcagctcactacaacctctgcctcccgggttcaagtgattctcatgcctcagcctcctgagtagctggaattacacacatgcgcccccacacccggctaatttttttttttttttatagagatgggattctgccatgttggccagactggtctcaaactcctggcctcaagtgatccacctgccttggcctcccaaagtgctggaattacagttgtgagccactgtgcctggtccttgttctttatttctaagtattttcttctttttgatgctgttataaagggaattgtttcaattttattttcagcttactcattgctgctatataaaaatagaattggccaggtatggtggctcactttgggaggccaagactggagtatcacttgagctcaggagtttgagaccagcctgggcaacatagtgagaccttgtctctaataaataaataaataaatacttgattgttgtatattgatcttgatgaacttgctgattagttataatggcattttactggattccctaggaattttattcacaagattatatcatcttgtgaataagattgatgtttttattccttttgatgctattgtaaatggatttattttgcagagcttcaaaacacttgaagcaaaaactgctagaactaaaatgaggaatagacaaatccataactacttggaaacttgaatattcctttcttagtaatcaatagaataggtcaacaaatactcaataaagatgtagaagacatgagcaacactatcagccaacttgacctaattgacatttagaacactctacccaacaacagcagaatacagttttttcaaattcacaaggaacattcatcattgtaagccatattctgaaccacgaaacaaacttcaaaaaatttaaaagtattgaaatcataaaattattgaaatatccaagtattttctctgaccacaagagaattatatatctataatacaaagttatctgtaaaaccttccaatatttggaaattaaacaacatactttaaaataatccagtaggctaaagaggaagtgacaggggaaattaggaattttttttaattgaatgaagatgaagacacaacatataaaaatgtgtaggctacaactagagcagtatctagacaaaagtgtatagcattaaatgctcctattagaaaaaaaaagaaaggtctcaagtaatctaagtctccaccttaagaaactagaaaaaatgagcaaattaaacccaatcaagcaaaagaaaagtaataaaaataagagcacagatcaataaaatttaagacagaaaacagtagataaagtcaatgaaaccaaaagtttttttttcttttgaaaagaccaatacaaatgataaacctctagccaggcagatcaagcacaaattaacaatatcaggcataaatgtggagacctcactagagatcctacagacattttaaaaggtaataagggaatattatgaacacttttatgtccatgaatttagaattttaggtgaaatgtacaaatttcttgaaagtcacaaactaccaaagctccctcaagaagaaatatatactcctatgcctattaattaaattcatagtttaaaatcttccaacaaagaaaactgcattgaagaattctacctaacatttaaagaagatgtaataccaactctatacaaactcatcctgaaaggagggcccaattcccagttcatcttatgagactattatcctgataccagtagtagacaaagacaatataagaaactgcagaccaagattcctcatgaaaatagatgcaaaacataaacgcagaaaagcaaagatagttgctaccttggttggatggtattgactggaaaggagcacaaaggaaccttctgtattgttggaagtgtttgttatcacaatctaggtagttattacacgggtttaaacacatgtaaaaactcatcaagctgtttaaggttagagcacttctttcagtttgttgtatatatgtcatacctcaaaacatttttcaatgttcaatctaccaagaaggatgaatgaaaagtgtctcacatagtttagtgtatgacacctgacatgaaattctttctatgctgatgcccaagaaattctgtcgactaatgaaacagtttggaaactctcctctattctgcttaaaataaagtcactgttggtttatacagcactgtatcttctggttaactcggccattagagtgagcaccagcccagttgaaagttcacaagaagcaagtaaacactggatttgatttagaatcaataatagcagcagggttttctcaggctgtttagaagcatcgtggcaattgtttgagaaaatataggtagttctagtgaatgcgctacagaatgttggaagtagcggttagcttagagattttaaaatgttagaatcaaataaaaaacaaaaataaaatttagaatctgtctacagcagtgaagatgaccttcaaattgtaagtaaaattaatatttcttagaaggaaaacctctccagttagtgaaattacaaccaaagagaataatataatataatcacaaagaatgttgcatttttgcctctttcttagggaccttctcaaatgattcatgtgagaaattgcttctgctgtacgagtttgaagttagagccaaattgaatgatccattactggaaagcttcctggaatcagtgtgggagttgcctcatttagaaactaaaacttttgaaacaattgcaagtaagagctatatttatgcttttgtaaggctggtgcccatttagatcgtatgactttttttcttctctttactcttctttcttacctccaggtaggaaataattttttctcatagcactttgtttctccttctctaatgccattcttagactattttgtattatgatcatttgtgcatttatcttcttcactctatgagattataatctctttagggtcataaacaataattacttaatttgtacttacaaaccctagcgaagttcattgctcctaataggtgctcaaattttttctgtgtggaatttaattatgtaactacacaacagggggagctcaaactttagaaagtttttctgggctagctagaaataactgagtgcttcaacaatcaaaagtgatgcaatcttagctgtttgttgaaatgtacagagaaatactggtaatattttttaacacaattgccactctcaaatttcaggccaaactttacgtgggtttgggggcatagagcctttttgggagtacactgcaggaaacagcctaattatcttccctttttatctctcaccctcttcaggagcatgtgtgtggttaataaaaatattaggtagctccaagtgcacaagagtcacatttgcctttccttggtcttgccaagacagaattcctagagccatggagcagatgatatatactttatggacatgtgacagcaaccactgctccttgtataatggaactccaattctaaaaatctgttaaatgcatctggaagtcttagggttagttacctctgatactcccttgtcaagtgtttcctatttttagtatcagataaaaataggacattttagtacaaacctgtttcaattagtgcccttttactgatctgctttctgtttccttcttagtgtgcccttccttgactgtcattcataagattattgcttcacctgtatgactgtgtgcaaggtcatacaaacagtaggttttctgttgatgtttgctgaaaaaaggatgttacctggtaatcccaccatgctactctgcccagaaagtagaagctatttccaaaagcgactgtagatttatcatttataaaattcattgttgtttatttttgttcatctgtttcagcccagtttcattagagaaagcaagtggtagcctgggatgaaaactgtgatgggtgacattatcatgttcacaacctttttccttttcttactctagtaatagcaatggaaaagcctgcacactatcctttgattgctctcaaggccttgaaaaaggctttattgctctacaaaaaggaagaaccaattgatatatcacaatacaggttagtaaatacaatccagcctttttgctagccaaaagaactatagtcaatgcctcaaaagtaaccaatcgttcttaattgactcaactttaaagatgatatggggatgatctgggggcattcttgtgaacagctccatactgagagttgtattacagaccaataattatttagcaaagtcaaggagcttggttttcccaaaggagaaaaaaaaggggaaaagttgcttctttgtgtgaatctgtgtatataataaaactgctaagtacctttctttctttgtttcatcactaaataatattccaaatgtacagaaaagcacaggggttaatataacaaacaccaacgtatccaccacccagatttatttgttttatttttagagatggggtctcgtgatgttgcccaggctggattcaaactcctgggctcaaatgattctccacctcagcttcatgagtagctgggattacaggcacgcagcacccagatttaacaaatgttaacatcttgctatgtttgcctcattatttttctaagcactttaagcaccgataagtgctgtataaaatattatctattggagacttttttgttttctgtgtccagacatggggaaaaatagatgttgtgtgactttttttgtctggaaaacatcattacagtcttcctgtgttaaggcacgaaagacagttcttgtggaatcattccactttaaaccccagttcccttgcccatttgaggaagtaccgagatgctttaaaatgcctgtaaattgaaccagctcataaaatataatagacagccacaactccttcgtgcaggaaactaaaaaaagaatgaaagacaaccataggcatgaaaaaagaaaggattggtcaacctgttttacagcttcaaaaatctgtcttctgaggttggaggccagataaaaccgagggaagaacagaagtgttttgaagctgttagtctgggatgagatccaggttttacttatcttagccatgaagccaatgatttctttccttatgggatgagttttctctttttgattttcagcaaatgtatgcacaacttggttaacctctcagtgccagatggggcgtcgaatgtagagctctgtcccctggaagaagtttggggctattttgaagatgctctgagccacattagccgcactgtaagtcaaatagtgatattaaactttcagttaattttaaagaactgaactgtcttgtgtactataaattatatacaataatgctttctgatatgagttttaggataaattcatattacaattttgtagttacacactacagaattttcctgggtttctgaaatataaatagttgaaagtagacattttctaacacaagtgtattatggattaggtccaagtagcagtaccaccaggcattttgaattattttatattttcaaatcatggtgggatgattactttctctgtgatgatatgaaccttttgaaaaaagttattgctattcccatcctttctcagaagcatcctttctcagaagagtagaaggaacattgaagacctgtattctagtccctcctctgctgatttctttttcttttctgtgcaggtttattcagttgttttaaaattaggtttcttgaggtataattcacatatcataaaattcacccatggcttgtgcacaattcagtaaatttatagagttgtgcaactatcactacaatccagtgttttttagttttaaaaatgttttatttttaatttttgtgggtacatagcggtgtacatgtacccatacttatggggtacatgagattttttggtacaggcatataatgcataataatcatatcaggataaatggggtatccatcacctcaagcatttatcctttgtgttacaagcaattcaattatacttttagttttttaaaatgtacaattaaattattgttgattataatcaccctgttgtgctattaagtacagatcttattcattctattttttgtacctattaaccatttccacatttcccccacccctcctctggtaaccatcactctactctttctctccccagcagttcaattattttaatttttagctttcacaaataagtgagaacatgtgaagtttgttttttgtgtgtgtgctgggcttatttcactcaacatactgacctccagttccatccatgttgttgcaagtgactggatcttattttttttatggctgaatagtactccattgtgtataggtaccacattttctttatccattcatctgttgatggacacttaggttgcttgcaaatcttagctattgtaaacagtgctgcaacaaacataggagtgcagatacctctttgatatactgatttcctttcttttgggtatatatccagtagtgggattgctggatcatacggtaactcaatttttcgtattttgaggaacctccgaactgttctccatagtggttgtactaatttactttcccaccaacagtgtgcaagggttcccttttctccacatcctcaccagcacttcctattattgcctgtcatttggatataagccattttaactggggtgagatgatatctcactgtagttttgatttgcagttctctgatgatcagtgatagtaagtaccttttcatatgcctgtttgccatttgtttgtcttcttttgagaaatgtctattcagatattttccttattttaaaactcgattattagattttttttcctatagagttgtttgagctctgtatatattctggttattaatcccttatcagaggggtagtatgtaaatattttctctcattctgcaggttgtctcttcactttgttgattgtttcctttgctgtgcagaagctttttagcttgatgtgatcccatttgtccatttttgatttggttgcccatacttgtaggatattgctcaaggaatctttgcctactccaatatcctggagagctttcccaatattttcttgtagtagtttcatagtttgaggtgttcgatttaagtctttaatccattttgatttgatctttgtataaggcaagacatagggatctcaactttcctccttctgcatatggatatccagttttcccagcaccatttattgaagagactcttctttccccaaagtatgttcttggcacctttgtcaaaaatgagttcactgtagatgtatggatttatttctgggtttgctattctgttccactatgttgagctgcctggggctggaggaggggtgatacaagcacccttgtggccactgccactgggactgtgctggtcagacctgaagccagcacagcactgggtctcacccaaggcccactgtaaccactacctggctaccacctatgtttgctcaatgccttagggctctacagtcagcaggtgatgaagccagccaggctgtccttcccttcagggcagcaacttccccctggccccagagatgacatgcaggagccagggcctggagtcagaaaccctagaaatctacctagtgctctattctactgcagcttagctggtatccaaaccacaagacaaagtccttcccactctttcctctttccacacgcagaagagtctctccccgtggccaccaccatcaggtggtgtggggagttctgctgggctactgccagtgttcacttaaggcccaagggctctgcaatcagcttgtggtgaatgctgccaggcctgggactcatacttcagagaagtgggctcctctctggcccaggacaggtacagaaatgccatccaagagccaaggcctggaaccggggaccctaggagcccacttggtgctctaacccactgtggctgagttgatatctaagctgcaatacaaaatcctctttactcttccctctgcttttctcaagcagaaggagtctctcctcatagccaccacagctgggaatgtactgggtcacaactgaagccagcatgtctcagagtctcacctaaggcccacagtatgtactacctggctactgctgctgatcactgagggccaaagtgctatttagtcagcaggtgatgaatcctgccgagactgggtccttcccttcaaggcagtgggtaccttttagcccgaggtgtgtctcaaaatgttatctgggaactaggtcctggaatgggaccttcatgactatgccaagtgccctgtcctactgtggctgagctggtatccaagatgcaagacaaagtcccccttaagcttccctctcctctcctctagtggaaggaaggggtctgttttggagctgcaaactgcactgcctggggttgagggaggggtcgtgcaatcactcccttggctgccctggctggtgtctcactaggtcgcatgtcccccagatgcactggctccaagcccagcacagcacaaagatttgcccaggagttgcagtccttgtggcctagactgcctctcaaatttatttagaaccccagagcactttagctctcagtggcaaggcttgttggaactcaagttccaactactgggatggacaattgctctctagctagggctggtctaaatactccctccatgagcatcagttgagttctgcccagtgttactttctgctgtgacagggcagcactgagttccaagcaagatcccacaatcactgtgctctcccttccacaagcacacagattcgccatgccatgcagccactgttggggcataggagaggggtggcattggcagttcaagattgtccttcctacactcttcagtggctctttcggtgatacgaagttaaaaccaggtgctgtgatcactcacctgattttttattattattttttaaattttattattattatactttaagttttagggtacatgtgcacaatgtgcaggtttgttacatatgtatacatgtgccatgttggtgtgctgcacccattaactcatcatttagcattaggtatatctcctaatgctatccctccccactccccccaccccacaacaggccccggtgtgtgatgttccccttcctatgtccatgtgttctcattgttcaattcccacctatgagtgagaacatgtggtgtttggttttttgtccttgcgatagtttgctgagaatgatggtttccagcttcatccatgtccctacaaaggacatgaactcatcattttttatggctgcatagtattccatggtgtatgtgtgccaattttcttaatccagtctatcattgctggacatttgggttggttccaagtctttgctattgtgaacagcgctgcaataaacatacgtgtgcatgtgtctttatagcagcatgatttatagccctttgggtatatacccagtaatgggattgctgggtcaaatggtatttctagttccagatccctgaggaattgccacactgacttccacaatggttgaactagtttacagtcccaccaacagtgtaaaagtgttcctgtttctccacatcttctccagcacctgttgtttcctgactttttaatgatcgccattctaactggtgtgagatggtatcttattgtggttttgatttgcatttctctgatggccagtgatgatgagcattttttcatgtgtattttggctgcataaatgtcttcttttgagaagtgtctgttcatatcctttgcccactttttaatggggttgtttgtttttttcttgtaaatttgtttgagttcattgtagattctggatattagccctttgtcagatgagtaggttgcaaaaattttctcccattctgtaggttgcctgttcactctgatggtagtttcttttgctgtgcaggagctctttagtttaattagatcccatttgtctgattttttattcttaatttttgtgtagatagttattaaatttggtgttcctgcagagaggatgattggtggaggcttctaatcagccatcttgctccgtccttcctcccacaatccagttttagaacatttccattaccctagaaattttccccttgcccatttgcagacaattcttgctcccaccttcagctccaggcaaccacagatccgctttctgtctctgtagattttctctttctggacacatcatataaatgaaattatataatacgtggcctcttgtgtctggcttatttcattgagcataacgtttttgaggttcgtccatgttgtagcattatcagtattccattcctttttttttttttttttttttttttgctgaataatattctagggaatggatataacacactttgtttatctgttcatcagttcatagatatttgagttgtttccactttttggctatcatgaataatgctactataaatattcatgtgcaagtgtttttgtgagcatatgtgtttaattctcttgaatatatacctaggaatggaattgttgggtcatcaggtaaatctatgtttaacttttggaggagctgcagtctgtttgccaaagtggccataccattttacattttcactagcggtgtatgaggattccagcttctctacattctcaacacttgctattgttcatcttttcttttttttgttatagccattgtggttttgatttatatttccttgatggctaatggtgatgatcattttttcatgtacttattgactgttcgtgtattgtgtttggataaatgtctattcaattattttcccatttttaaaatggaattttttattgagttataagagttctttatatattctggatacaagtcctttaccagatatgtgatttgtaagtattttctcctagtctctggcttgttttttcattttcttaagggtatcatttgaagagccaaagtttttaattttgatgaagtccaatctatcaattttttcttttgtgggtagtgttttggtcatgctgagaaatctttgcccaacccacgtttacaaagattttttcctacgtgtttctgtagaagttttatacttttatctctgacatgtagctctatgattcattttaaattttgttatagtgtgaggtagggtctaaatgatgttttgtttgtttgctgttgcatattaatatcactcctctgctgtttgacttcagttttcacatttgtaaagtgggaataatacctgatctgactctcccacactggggttgtaaggatcaatgaaaataatgtatgttttgtaaactttaacagcttgtacacatgtaaggcagtattgttattataagagagctataaaacattaagaacactacatgccttgcttaaagttacacagaaagtcattatttgagtccatgttaatatctgaggatcctgactgctcttgactcaactacttcttaatatataaatatagtcatgtgccacataatgacatttcataatatataatggtggtcctgtaagattataatggagctgaaaaattcctgtcacctagtgacatcatagccatcgtaaggcaacacattactcacatgtttgtggtgatgccagtgttaagaaaacttactgaactgccagtcatataaaagtacagcacatacaattagatacagtccataattcttgttaatgatataacaaattactatgttactgtttcatgtatttactatacttttatcattattttaaagtatattccttttatttataaaagaaagttaaaactgtaaggcagcttcaggcaagtccttcaggagatattccagaaaatggcattatcatcctaggaaatgacagctccatgtatgttttgcccaagaagcctttccagcaggacaagatgtggaggtgggagacagtgatattgatgatcctggccctgggtaggcctaggttaaaatatgtgtttgtgtcttagtttttatcaaaaagttttaaaagttttttaaaaaattaaaaataggaaaacacttatacaataaggagataaagaaaatatttttgtacaactgtataatgtgtttgtgttttaagctaaatgttattacaaaagagtcaaaaagttggggttttttgttttgtttttgtttttttgagacagagtcttgctctgtcacccaggctggagtgccatggcgcaatctcggctcactgcaacatctgcctcccgggttcaagcagttttcctgcttcagcctcccaaatagctgagactataggtgcatgccaccacacccggctaatttttgtatttttactggagacgaggtttcaccacattggccaggctggcctcaagctcctgacctcaagtgattgtcccacttcagcctcccaaagtgctgggattacaggagtgagccagcatgactggccaaaaaaaaaattttttttttaattaaaaaggttttttttgggtttttttgtttgtttttttgggttttttttttttttttttttttgagatggagtctcgctgtcactgacgctggagtgcgaaggcacaatctcggctcactgcaacctctgcctcccaggctcaagtgattctcctgcctcagcctcccaagtagctgggattacaggcgtgtgccaccacatctggctaattttgtatttttaggagagacagggtttcaccatgttggtcaggctggtctcaaactcctgacctcaagtgatccatccgcctcgacctcccgaagtgctgggattacagtttataaaggaaaaaagttgcagtaagacaaggtcaatttatatttatatattttttgagacaaagtctctgtcacccaggctggagtgcagtggcatgatctcagctcactacagctttgacctcccaggtacaatcaatcctcccacctcagcctcctgagtagctgggaccacacgtgcgcaccaccacacccagctaatttgtttgtatttttagtagagacagggtttcaccatgttgcccaggctggtctcaaactcaggttcaagtaatttgctcaagtaatctgcccaccttggtctcccaaagtgctgagaatacaggtgtgagccaccacacctggccaaagttaatttattattaagaaagaaaaataccctttaataaactgagtgcagcttaggtatacagtgtttataaagtctgcagtaatgtacaagaatgtcctacaccttcatgttcactcaccactcactcactgactcacccagagcaacttgtagtcctgcaagctctattcatggttagtgccctatacaggagtaccattttttatctttcataccacatttttcctctaccatttctatgtttagatacacaaatacttacctctgggttacagttgcctacagtagtcagtagagtcacatgctgtatgggtttgtagcctaggagcaatgggctttaccatatcgcctaggtgtgtaggaggctataccatataagtttgtgtaaggacactctatgatattcacacaatgacgaaatcacctaatgatacatttctcagcttgtgtccccattgtgaagtgagacatgactatctgcaaatcacaacagatggtggaacattatagcagggtgacaatctgatacaaactagcattgacttaccaaagcctagaattctcctggagatgtgtaattatggcctgtgtgaatttaagtttaaaaataaaaacttcaacattggacatttggattatttattttactgtcttctcggatgaataggaaattctatttctaagccatgagcctcatctggacctttcaggtgtgtttgccatagtgaccaatacaaactgaaattagattgtactataactccaagttgatcaatttccatagtctctctataaggccaaaatttctctgtgcattttgtttttgccactttcattctgtccaatatattgcagttccaattctctggctcttgggttacctgttagagagcttaatgtttttctacttttctcatgagtttcccatccatttattgctcatcccctgaaacatgactggatagttagctttttaatgcagtgattaatttattttttaattttttaatttttatttatttattttttatttatttatttttttgagacggagtctcgctgtgtcgcccaggctggagtgcagtggcgcgatctcggctcactgcaagctccacctcccaggttcacgccattctcctgcctcagcctcttgagtagctgggactacaggcacccgccaccacacccggctaatttttttgcatttttagtagagacggggtttcaccgtattagccaggatggtcttgatctcctgaccttgtgatccgcccacctcggcctcccaaagtgctgggattacaggcgtgagccaccgcgcccagcctgcagtgattaatttaataaccctcttggctctttatattatatatgttgctttatcctatttgattgaatgtgccgtgcatctcctttgtttcaaatgcttgggacaaaattctgcctttgtttgactgacttttttaatgaccagtcactcattcattattcactgagcagataacctttatcaagtgcctccacacactggcaaaatggctatcatacaaatataaaacctcatgcctcacaatattatgctttagactgagcagagtactcttacgtccactctctcgtacaacctccaacagcaattatagaagtagacaatgctgctattgttatccctaatttatcaatgagggaattttaagattcaaaaagtcaagtaaccaatttacctaaggtcattcatgactaatgagtgagagtcaggactagaatgcaggtcttctgagctcctgtcttagtcaattcgggctgctataacaaaaataccatagagtgggtggatcataaataacagaaatttatttctcacagtttgggaggatagaaagtccaaaatcaagacactggcagattcagtgtccagtgagggtctgcttccccatagacggtcctttctgactgtaagctcacatggcagaaggggtaaaggatctctctagggtctcttttataagggcactaatcctattcatgagagcactcctcttatgaccttatcacctcccaacagccccacctcctaatatcatcaccttggaggttaggattttaacatactaattttgaagggacacaaacattcagtccgttgcacatcaactacagggctgtttccactggaggtgcgtggcttctttaccagtttttgctaggaaattttagtttaaaggagaagctcaagttgatatttagaagctagtggtaatgaaaaagcagggagatgactcccaggcttaagcagacaaacctatcaacctatgtaggttcatattctagataatttttaagaagaagtcgattgttcaagtttttttaaatcaaaattttattttgaaataattgtagatttacacgcatttgtaagaaataacacagagagatctcgtgtactctttttattgtttgtttgtttttgagacagagtctcgctctgtcacccaggctggagtgcagtggcgccatctcggcttactgcaacctccgcctcccaggttcaagcgattctcatgcctcagcctcccaagtagctgggactacaggcaaatgccaccatgcctggctaaatttttttgtattttcggtagagatgggttttcaccatgtaggacaggctggtctcgaacttctggcctcaagtgatctgctcgccttggcctcccaaagtgctcatgtactctttacccagtttcccccaacgataacaaaactatagtacaacatcacaatcaagatgttggcattatcacaatcaagacatagagcattgcatttctgtcaccacaagtattcctcatgtttcctttgtatagccctcacactcttctctcccactctcagctcctccttaaaccctgacaaccgcaaatctattaccaatttctataattttgtcatttcaagcatgtcatataaatgtgatcaaacagtatatagcttttgagatttggaatcatacagtacataactttttgagattggctttttttgagacagggtcttgctctgtcacccaggctagagtgcagtgaagctgatcatagctcagcctcagccccccaggcttaagcgatcctcccacctcaactccccgagtagctgggaccacaggcatgcaccaccaagcccagctaattttttaatttttttgtagagatggtctcaaactcctggactaagcgatcctccctccttggcctcccaaagtgctgggattataggcatgagccaccacacctggccaagattggttcttttcacttagcataattctctagagattcatcaagtcattgtttgttacaaaaggacaaatattgtatccttctatttatatgaagtacccagagtggtcaaattcatagagatggacacctgcaggggaggctccccaggaagagctgactgggtgtttaatggcctcttcttgcaggctcaagattgaccttagcttggagtcactgggcttgagcttctatttcccagtcagggttgttcactcagttttacatgagaaaatactcagtgtttgaagaatccagcaaaattactcaaactcagtgtttatggaagggaataaaatagtaaggcatttacattttatatctccataaacaagcaaaagtgtctatctctttcagacaacaaacatgtcatttaattatctccataataaaaaaaattatttaataaacaattgaaaaaaaaagaaagtaaagtggtagtcaccaaggactggggttattacataatgggtacagatctttagctttgcaagatgaaactggttctggagatggatggtagtgatgatagcacaacaatgtgaatgtacttaacgccactaaactgttcacttaaaatgattaagatggttaaattttgtgctatatgtattttaccccattttttaagtcatagaaaagaatctttgtcaggtatcgtaacatttctgtcatctcagtgttggcatcaattcattgtcttttttcgttatttgagatcttcctgattattggtataatgagtaaatttgttaaacctggacaatttcatattttgttctgagactctggatctcatttaaaccttctgttttaacttggtttctctgacctgctttagcaagggagtgggcccagccttgttacttccaggtagaagtagaaacaagcctaagtttctaacttgacctccatcattgatactcaaggtagaggactcctttttactactggtcccttggctagagacagcagacttttcttggggcttttttctttctttttctttttgggtctatgtctgttggcatctctagcaccaagtttggggtatatgaagcaaaaagaaaacccagagaacttatcactgtgtcaatccttggctccaaggtcttccctttctctacacctttcagaggtttcttatgtttgttttatgtataatgttcaagagttagttttatttagcaggaagaatagggataagtacatttattccatctcatggaagtggaaatttcttggttcatttttaagaatatacaaagacttaaataatggtgggggggaaacctacacttaaagagaagggacaaacctaatcctcacagctgatgtcagagtcacagagtcacaaaggcgttttgtaaccaagaagcccagaagaacacagactctttccttttacaagggaagctaaggtgattcaaactactgagctacattctctaagagtttgcttcccaaagcgtgatcagcatcccctaggagcttgttagaagcatggaatcttaggccccagacctactgaatcagtctgcgttttaactatacttccggccgggcacggtggctcatgcctgtaatcctagcactttgggaggccgaggcggatggattacttgaggtcagagttcaaaaccagcctggccatcatggtgaaaccctgtctctactaaaattacaaaagttagccgggcgtggtggtaggcgcctgtaatcccagctacttgggaggctgaggccgaagaattgcttgaacctaggaggcggagattgcaatgagccaagatcacaccactgcactccagcttgggcaacagagtgagactccatcttaaaaaaaaaaaaaatatatatatatatatatatttccaagtgtcttgtatgcacattaaagtttgagaaggtcatttatcagtatcttttgtctcttgtttggccttctacttgttcaatttcatctcagttcctacttctgccaatcttatataagttcatagattaggcaattgggatctaaaggaaatataaggtaaagcttcattcaatgactgagaaaatttagaactggaaactaatgatctttgcagttacctaatttaagctcattattttgcaaattgaggcattgaaaggttaaatatctgacacaaggtcataccactatataatggcaaagctaaaaattgcagccgtgttatttcttcataggacaatggtccttgggttttctttcatctattttttaataaaatttttttaattgagaggaggtcttactatgttgcccaggctggtctcaaattcctgggctcaagcaatcctcctgccatgtcctctcaaagtgctgggattacaggtgtgagcccctgcacccagccttctttcatctaaatcttcctccttccaagcctcacgtctccctgagactggaattgaggttcatacaaagccatctttgagtcagactttgatattgtgtctctcctacagctttgtagtttcctaattggtctctggctctttcttctcttctccattttttcctgttcatccctatcaaatatatctccgtaaaacacaacttttgctctatcactccctttccctcaaatcttttaacaactctgtatttcccaaatccttacctagacccttaaggctatctatccataacctcattcaacccccaaaacaagacagagtttttcccaggcaatagtcaatattctctttatcatcaaccttcacctccttctctcccttcttcttagaacaaagcagaatcttccctgaagaaaacgtgtccctcactacgaatttttatggaggtctcatcttttccaactccctttttctcagcagaagggactaaattacctggatctttgctccatggtggcactttgtactatttatataccaccttcctacggcttctcttcacttaaaacctatatctcttcatcaccaatgttgtcatgtcctggacccaccttttccttccttggtaacttcattgttatttattatcctaagtgactttggcatccatgttagcaattcttgtacctcacagtttccgtttttcactttttagccactgtctacctcccatataagccacccactgtggcactgctccatcttcaagattggtaactaacgcaacacttttctattgagtctaatctcccttacttccccatatctattctctgttctcacttgaacttcaaatcactcgtcttttcccactctattatagtccagtctaactaccttttttttctttttctctttcttttcctttctttctttctcttttctttatttctttatttgcttccttccttcttccctcccttctttcctccccttccttctctctttctctcttcttttgattattcctgctgtttcatttttttccaaacctggtaccttgccaccatcagttcttctgctcctgatcttgagcagcagaagcactaaagaaagttacagaaccatctagatctggcccagtacagattcattctgttaagctttcagtgggttctcattgctgctcagaaattcttttattcttgtcaactttttggcaaactcaagtaaagtggctgcttcaaaccttttctaatctcgtaaaaacttagacctacctcattccccattagatgatctcatcatatcatttcagttgagaagatcaagggcatcacatatgagatccctcattggcccatgtctcaaccataacattctaccactgtacctacctactcacctttcctcttttttcaaaagaaattttctcaaccttgcactgtcagttcaatccccttctacttcctgaggcattttactgcctgtccatcatttttactctctgcctacagatggttccattctgctttcaagaatgcataagtctcaaacaaatggaaatatataccatgttcttggacaggaaagccctaacagtataaagtcagtttccctaaattcaatgcaataaattcagtcaaaattaaaatctcaataggatttttaatgaaacttgatgattctaaaattcttccctaaaagaaaatgaaccaaaacattttttgtaaaagaacaaggaaggacttgccttatcaaatacttttaaaactataaaatgatattaattttaaaagtatggcattagtgcaaaaatctacaaagagattaatagaacaggactgagcccagaaggagatccacatatctatgagaattttgtatgcaatggaaaaggtatatcacatcactgagggaacaattggtaaaatggtattgggacaatttaaaaagcaaagttacgtccttatttttaaactgaggggcgttatagcatagtggttaagagaacagactttggagccacataaccagttcaaataaattctggctacaccatttattagctgtatgactttggtcttattaattaattatgtatacctctgtatcctcatctgtaaaataaatataataataatctcagcactttgggaggcaaaggcaggagtatcgcttgaggccagaagttcaagaccagcctggccaacatagcgagatcttgtctctatgaaaaataaataaataaataaaagctaaaaaaagtgcctaccttacagtattattagtattaaataacttaatatatataaagtacttatagcagcacatagtaagtactatataagtgatagtattatttttttgccttataccatgcacaaaaataaagtccaaaaggaagaaataaagaaaatccagatagattaaagagctaaacataaaatcaaagctataaaagcattaggaaaaaacagaggaaagcatttttttaaatcatggaatggagaggacccactcagaagctgtataagaaacaaatagttttggttacatgaattaataaatagcacaagataccacaaaacattttaggcctggtggagtggctcatgcatgtaatcccagcactttgggaggccgaggtgggaggttcacttgaagccagaagtttgggaccagcctgggcaataaagtgacactctgtctctatgaaaaaaaaaaaaacccataagttttgtgggtttttttttgaaatggagtttcactccgtcacccaggctggagtgcaatggcatgatgatggttcactgtagccttgacctcctgggctcaagagatcctcccacctcagcctcccaagtagctgagactacaggcacatgccactacacccagctaattttttgtatgtttggtagagatgcggtttcaccatgtctcctaggctggtctcaaccttctgagctcaagcaactcaccctccttggccttccaaagtgctgggattataggcatgagccaccacacccaggcagatatgtattttatactttgggttataatacaatattactttattttattgttcatattgttctagctttgaaaaagtctggcagcttcccagaaggttaaacatagttaccctgtgacccagaaattccactggtaggtgtatacccaagagaaatgaaaacatgtgtccaaagactcatagcaaatgttcatagcaaagttattcatatagcccaaaatggaaacagcctgaatgtctgttagccaatgaatgggtaaacaaaatgtggtatttccattcaatggaatactatttgtccattgaaaggaatgaagtactaacacgtgctataacatggataaaccttgaaaacatggtaagtgaaagatgtcagtcacaagggcccacatactgcctggccccatttatcttaaatgtccagaaaaggccaatctataagagacagaaatgagagtagtggttgcccagggcttagtggggtaggggggcaggttgagaggaaatggaaggatattggctgggggcagggggaatatggagccaatgggcatgggctttccttttggaggaatgaaaatattccataattgattgtgatgatggtggcagaactctgtgaatactgtgaatatactaaaaaccaccgtattgtacactttagataaactatggtattttatttaattgtatcttaataaagctgatgcacatactatttactttgggaatctatggagagcctaaaaggacaggcatttgtgctccagaatacctacgattcagttagagatctacgtggctgccatatgtattaagatgttgaggacagagaaaactggtttaaaatatgtggccccaaaaaccatcagagcaaacacctcagtttgctgacattgatttgtattacacgtaggcaagtccatgtggctttcaggtcagtagctgtgtggatgcatttctttattgaggattaatgattttcataagcaatgctgggcatgagggcaactaatgcaaattaaaataaaactcgagtgttccctaactcattggatgacaccatcattcttctggttgcccaagccagacatctaggagtcatcctcagcacctccctcactcccacttctaatctatcaccaagtactatcaatcaatttgacctcccaaatatctctcaaattcatctacttcctcctatctttcaccatcagtaacctagttcaagttacacaccttttatcttagctagtttagtgatctcaggaaccttttaactggcctcacatctactcttgctttcttccttcctttctttgcccagcaaccaaggtgatcttttacttttttttttttttttttttttttttgagatggagtctcgctctgtcaccaggctggagtgcagtggtgcaatctcggctcactgcaacctctgcctcccaggttcaagcgattcccctgcctcagcctccccagtagctgggactacaggcacccgccaccacgcccagctaatttttgtatttttagtagagatgaggtttcaccatgttggccaggatggtctcgatctcttgacctcgtgatccgcccacctcggcctcccaaagtcctgggattacaggtgtgatccaccatgcccagccaatcttttacatttttgagtatgcatgaccttttgaaatcctctttagtagtttcccattgctcttaaaataaagaccaaaatcttgaatgtggtatacaagatcctactaacctatctgtcctcatcttgagccactctttccctcacattctgcactgtcagccacactttacaagaccacaaattaccaccgtctaggcaaatatgatggtctcttttccctggccttcgttattgaccactgcctccttattgaaattctgttttcctttgtcctttattttctcgccactcctctgcgttcttttccctcttaccacccaactatgaacatttccaatattctctactctttgctactctgtattctgtactctgtcctttaagtgaattaatacactttaactattacctgagttccaatccatatctgcaacagcctgcttatctccagagttacctcaagccaacttgtttaaaatagaacttattgttgtcccttatccccagaaacatgtccttcaattttttctttcagtgatgccagcattctttcagccattcaaactacataccttagagccattttcacttgacctgtcattccccatatcaaatcagttaccaaattctattgattcttcctttaaatgattcttacatccgtccatctaaattgtcactattttagttctgaccctcatcacttcattcttagatcacacaactccttttattttattttattttatttttatttatttatttttttgagacagaatctcgccctgtcgcccaggctggagtgcagtggtgcgatcttggctcacttcaagctccgcctcccaggttcacgccattctcctgcctcagccttccgagtagctgggactacaggtgcctgccaccacgcccggctaatgttttgtatttttagtagagacaggatttcaccatgttagccaagatgttcttgatctcctgacctcgtgatctgcctgcctcggcctcccaaagtgctgggattacaggcacaagccaccacgccgggcctttattttattttttgagacggagtttggagtttcactcttgttgcccaggctggagtgcaatggcacaatcttggctcaccacaacctccgcctcctgggttcaagcgattctcctgcctcagcctcccgagtagctgggattacaggcatgtgccatcacacccagctattttgtatttttagtagagacggggtttctccatgttggtcaggctggtctcgaactcccgacctcaggtgatctgcccgccttggcctcccaaagtgctgggattacaggtgtgagccactgcgccaggccataactccctttaaacacgtctccctgtctgtgttttcccacacggaggtctgttctaaacaccactggcatttctatcttattaaaactacactttcatcatatcactctccttctcaaaaagtttcagtgccttcccgttgccagcaggataaatttcaaaatctgaagcctgtaatgcaaaaacccttaacactccagcccacaagatgttagcaaacgttccacataccctggattagacaaagttccatggtttctttactgtaaaacttccctaaactttcagtgaactagtgtgcattataatgctccaaaagggtgatatatagaatgcggcatttccaaaatgtatttgactaaagaactctattttcatagaccatctgttaacatttctcatgacactagtgttctgaggaagaacattgaggaaaggcttaggaagctccatcctacatttccagtcttatttcccgttaactcctctacataaatcgtctgcttaggccaaagaactcttggtcttcctaagacatgcttgttctcaagtacaatccaagtcttcatttattctgttctacccacatggaatgcccttctctttctctgaatatctatatttttctttttaattgagatttagttcatatatcataaaactcacattaaggtatacagttcagtgagttatagtatattcaaaagattgtgcaaccatcaccattatctaattctagaacattttcatcatccccaaaagaaactctatacccattagcagtccttccccatacctcccttccccagcccctggcaaccacaaatctcctttctgtctctatggctttgcctattctgcacatttcatataatctctgtatatgtagatcctactcatctaccctaagatcatgtttgtttgtttgtttaagtcatttttttcattcacaacattaaaatcacaacactcataccctgtatcagacactgtgccaagcaaaggcaaatgtcattttaccttcaaggggctccctgcctagtgggggagacaggcagtacagtgttcaaagtactattatggtgctgtgaacaaagtagcagaggggcaaagaggtttgagcaagaaattgtggagagccagggaaatcctcactgaggaggtggcatctgactggatattgattcatttgttcattcattcattcagcaaacatctgttgtgcctcttatgtgccaggcacagtgctggactctgaagatacaaaaatgcacaggaaaaattccctgtacctcaaggaactcaatagtctggaggagataaatacatagcatttcaaaacaatataacataagttatattagaggaatggaaagctcactgtgggaacagacaactaactgttcttgtgaatttgaagaaaaagtataagtctatgaagtggacaaggatgaggagtagtgtttcaagcagagactagaccgcctctgactggaatatcctagtgctcatttctttaactgaatgagagcacctaatgtttgtgtctcttaatcacataccttgtgaagtcgtctttacatgtggatgccttgtgtccccaaaagcattgcacaacctttaggataaaagttttgtcttttccctcttagtgccctcattatcacagtgttttatgtatagtaatttctttttggatccaaatgaatgaaaggatgacagctgagacagcattcttgacactctcaaaaagctgctgcctaatgtgtctcctatcacatttctcccttctggggctttaacatgaatgctttctttgtgttccatctcctatgcaagaaccaagaaagtagcttcttagactaatacttttcactattgcaaagtattgtgaagaagcaaatataatcttgtgattagtcatgttaaagaccactgataaggctaagggaccatcttagaaatgtgtgctgtgttcatagctaggtagatatcgttaactctgaagatgaatataatttctactccaaatatggactaattctggtgacagaaattaagaaattcaataaaactgcttcttgacaaccttatccgaaaagtagaggtaggtattagggaggtaattgactgaagacagaatcaagggaagccccaaacagtatgcaagtttttctcgtgcctcaggaagattaggaatctttctaattctttccttcagtcagagaggacctcggtttacgtctcttcatgagatcttgctatggaacattctacagctgacaaaccttcaaagtgctctcctcctgcactctccaggagcacagaccttcctaaacatcagcagagctcctattgtttgtttagtaataaagggacatagcatggatacaggtagtgccacaatgaactgtgacagtaataactgcaaaatttctgttcttggattatagaaagactacccagaaatggagattctctggctgatggtcaagtcctggaataccggagtacttatgtttagcaggagcaagtatgcatctgctgaaaagtggtgtggcctggccttgcgtttccttaaccaccttacctccttcaaggaaagctatgaaactcaggtaaggagggagagggctagggcagatgacatgacctagggggcaagaggttatggctgggctctccacaaggactcaaccccatcctccttggctaggaaaggatcttgctcattgttcctctcaatggttccacataacttcaagaatcaggagaccataaacagtaattccttagagcaaaaaccaagaaggacagagaacagggggaaatttaaggatagcaaatggaatctaattaagaggaatgccaagagtgagctctggaaagatgcatcactgtcagtgccagtgcatgtgggaaaggactggcctctgctcaaagcaataactgttgaaaaaggcattttctccaggaactattctcagttgcagagttctgggccattggctaaccaggagaggtttggtagagaaaaagccttgttaccaaataagagcaaaggatattttatagttaagtatcttctcccttataataggggattccttttcctcaagagaggactgtattttctccccaaatctgagatgcttcagatctccgaaggtaacggttagactttcatgccatcaccgtgggtctgggaagctttcccacatttctttttcccctcaagaaatctatttgttgttctctttcccagatgaatatgctgtatagtcagcttgtggaagcattgagtaacaacaagggcccagtttttcatgaacatggctactggagcaagtcagattaggcaagctcatggccacatgaagaagatacattgtcccgagatgctgactgtttaaatttttgccagagtttctcttgagcttttgtttctgtttgctcagaccctgttttcatgttgttgaataaactttctaaaataaaagcatgctgaatt
